United States Patent 10,696,975 (GENES AND USES FOR PLANT ENHANCEMENT) - sequence listing, part 2

SEQ ID NO: 3081 - protein, 756 aa, Mesorhizobium sp. BNC1
MRDIGGGPRVLLKRLRELMAEPVEPQQRLDRIVREIAQNMVAEVCSLYVLRADSVLELYATEGLNPTAVHLAQLRLGQGLVGTIAASARPLNLSDAQKHPAFAYLPETGEEIYHSFLGVPVLRAGRTLGVLVVQNRTMRHYREDEVEALETVAMVVAEMIATGDLARLTRPGIELDLRRAASFKGLPLNDGVGLGHVVLHEPRIVVTNLFNEDSDRERERLEEALSSLRLSIDDMLSRRDVAFEGEHRAVLEAYRMFANDRGWVRRLEEAVSNGLTAEAAVEKVQSDMRARMLHMTDPYLRERMSDFDDLANRLLRQLLGRGPEALADIVPKDAIIVARSMGAAELLDYPRERLRGLVLEDGAPTSHIVIVARAIGLPTVGQVKGAVAMSENGDAIVVDGEDGQVHLRPQADVETAYAEKVRFRARRQQHYRELRDRPAVTKDGVPVQLLMNAGLAVDLPQLAQSGAEGIGLFRTELQFMVVSTFPRVEAQEGLYREVLDAAGEKPVTFRTIDIGGDKVLPYFKGAQQEENPALGWRAIRLTLDRPGLLRTQIRALLKAAGGRELKLMLPMVTEIDEVRQARAIIDREVRHLSRFAHLLPTSLKLGAMIEVPALLWQLEELMQAVDFVSVGSNDLFQFITAADRGNTLISNRFDPLGVPFLRVLKQIAAAGQATHTPVTLCGELAGKPISAMALLGIGYRSISMNSASIGPVKAMLCELPLQKLSERLEAALANRSGKIDIRAELQQFASEYDIPL

SEQ ID NO: 3082 - protein, 369 aa, Gluconobacter oxydans 621H
MTVEIRVPALGESLTTATVARWLKKSGDYVQHDETIVELETDKVSVEVTAPSAGRLEDCVAVGTEVEIGGLLGAVDETAEAPAAPEPAPVAEAPAEPAAPPPAPEPVAQPARVAPPAPEAPKPAAVAPAPKLSSHEARERRVPMSRLRQTIARNLKAAQNTAAILTTFNEIDMSAAKALRAQYKEEFEKKHDGARLGFMSFFARAVVGALKDYPAINAQIEGDEIVYRDFVNLGIAVGTERGLVVPVLHDADQMSFAELERRIADYGKRARTGGLKLEELSHGTFSITNGGIFGSLLSTPILNTPQSGILGMHAIQDRPVVRDGQIVIRPMMYVALSYDHRIVDGREAVSFLVRIKQLVEDPRRLLLDL

SEQ ID NO: 3083 - protein, 288 aa, Staphylococcus aureus subsp. aureus MW2
MNEQWLEHLPLKDIKEISPVSGGDVNEAYRVETDTDTFFLLVQRGRKESFYAAEIAGLNEFERAGITAPRVIASGEVNGDAYLVMTYLEEGASGSQRQLGQLVAQLHSQQQEEGKFGFSLPYEGGDISFDNHWQDDWCTIFVDKRLDHLKDELLNRGLWDANDIKVYDKVRRQIVAELEKHQSKPSLLHGDLWGGNYMFLKDGRPALFDPAPLYGDREFDIGITTVFGGFTSEFYDAYNKHYPLAKGASYRLEFYRLYLLMVHLLKFGEMYRDSVAHSMNKILQDTTS

SEQ ID NO: 3084 - protein, 84 aa, Glycine max
MNHAGRGLVNDTYKMDLILVHPPHLIALACIYIASVLREKDTTAWFEELRVDMNVVKNISMEILDFYESIECSLMRESMLLFRS

SEQ ID NO: 3085 - protein, 328 aa, uncultured haloarchaeon
MRILVTGGAGFIGGHLAERFITDGHDVIVLDNLEPFYDTRIKQQTIEVCRTCADDGSGSYRFIEGDVRDVDIVSELVSDAEYVYHQAAQAGVRQSVSDPRKYDEINVEGTLNILDAARDTETERVVLASSSSVYGRPEYLPYDESHPTTPVSPYGASKLAAERYACAYSEVYDLPAVALRYFTVYGPRMRPNMAISNFVSRCLNEQPPVVYGDGTQTRDFTFIGDIVEANVTLLTESAADGEAVNIGSTDNIDILTLAEEIRDQLAPEQEITFSERHDADAEHTHAAVEKARDVLGYEPTHTIREGVEEFVEWYHENRDWYEPLVLQS

SEQ ID NO: 3086 - protein, 489 aa, Zea mays
MAMRKENPVLNACQASNGRITRAQAAANRRSFGAFPSVPLPAKTERKQTAQGKAKRGSSYDNTSASVALSGPQPKRRTVLRDVTNLSNANSNKSFAAAPKLQTKPSLRTGRTVSKSKPCAKKIPKKPPPAGNGSALTNVLNIAEETQAEKILAERVEPVLLLENRGPLSLQNVERNRDSACHEVFFEERNLRDKCEPSVSKNGDSYVLDIVDIDKDNGNPQMCASYVVEIYSNLMASELMRRPSPNYMEGLQRDITKGMREILIDWLVEVSEEYKLVPDTLYLTVYLIDRFLSRNYIERQRLQLVGITSMLVASKYEEICAPRVEEFCFITDNTYTKAEVLKMESQLLNDLGFNLSVPTTKTFLRRFLRAAQASRKTPSMTLGFLANYLAELTLTEYEFLKFLPSLVAASAVFLARWTLDQSDLPWNQTLEHYTSYKCSDIQLCVCALRELQHNTSNCPLNAIREKYRHQKFECVANLTSPEFPRSFFS

SEQ ID NO: 3087 - protein, 170 aa, Oceanobacillus iheyensis HTE831
MEFKNYIEIVEDWPKEGIKFKDITPLMADGKAFKSAVDEIVDYANTKEIDLVVGPEARGFIVGCPVSYALEVGFAPVRKEGKLPREVIKVDYGLEYGENVLTIHKDAIKPGQRVLITDDLLATGGTIEATIKLVEQLGGIVVGCAFLVELGYLDGKDKLEGYDVLTLMKY

SEQ ID NO: 3088 - protein, 223 aa, Mycobacterium sp. MCS
MMAEQATNAGPATSDGRGSRGDRDGRGRRDDRGGRGRDGGDKSNYLERVVSINRVSKVVKGGRRFSFTALVIVGDGNGMVGVGYGKAKEVPAAIAKGVEEARKGFFRVPLIGGTIVHPVQGEAAAGVVMLRPASPGTGVIAGGAARAVLECAGVHDILAKSLGSDNAINVVHATVAALKQIQRPEEVAARRGLPLEDVAPASMLKARREADALAASSSREGSV

SEQ ID NO: 3089 - protein, 368 aa, Thermotoga sp. RQ2
MTVMIVEDDDITREAMGQYLKLSGFDVIEAENGEKAVKLSENVDVALVDVMLPGMSGIEVVNEIKAKNPSCVVFVVTAYDDTEVVKKCVEVGADDFIKKPVNLELLRLKITHALRNRVFHMYRNSYLKSLKKKLFLLEKTAEEFFTEYEDFLFEVLEILNMLSEYRDMETHKHTERVGWLSGRIAEEMGMSEVFVTEIQFAAPLHDIGKIGIPDRILLKPGILTPEEFEIMKQHTTIGFRILSRSNSPILQLGAEIALTHHERWNGAGYPRGLKGREIPISGLIVAVADSFDAMVSKRPYKNPKPLEEAFREIESLSGKLYSPEVVEAFLKLEKEITDVYRREKDEDTSNNGRRSHQSSSGEGVEGIR

SEQ ID NO: 3090 - protein, 535 aa, Burkholderia mallei ATCC 23344
MPIIESKLNPRSDEFRANAAALEALVADLREKIDRLALGGGQAARDKHLSRGKLLPRDRIAQLLDPGTPFLELSQLAAYGMYNDDAPGAGLITGIGRIAGRECVIVCNDATVKGGTYYPVTVKKHVRAQEIAAENRLPCVYLVDSGGANLPNQDDVFPDRDHFGRIFFNQANLSAAGIAQIAVVMGSCTAGGAYVPAMSDESIIVRNQGTIFLGGPPLVKAATGEEVSAEDLGGGDVHTRLSGVADHLAQNDAHALALARAIVGNLGARGGAAPAMREPLPPRYDARSVYGVIPADTRKPFDVREVIARIVDDSAFDEFKARYGTTLVTGFAHIWGQPVGIVANNGILFSESATKGAHFIELCCQRKIALVFLQNITGFMVGRKYENEGIARHGAKMVTAVSTAKVPKFTVIIGGSFGAGNYGMCGRAFGPRFLWMWPNARISVMGGEQAASVLATVRRDEIEAKGGEWSAQDEEAFKQPIRDQYERQGHPYYASARLWDDGVIDPAQTRDVLGLALAAARNAPIEDTRFGVFRM

SEQ ID NO: 3091 - protein, 209 aa, Ustilago maydis 521
MIVLALIAKGSNILAETHDPAHDRFLPAAQTILSRIPPNSSKLSYAFEDWLFHYVSQDGMVYMAVADADTGRRMPFTFLAHIQKHFLSTYDVPEAGDSDMDYSSLTTTLSKLIKQFNSDPQAVDPIAQAKTELAGVKDIMTQNVEQILSRGERIELLMDRTDNAANQSMAFRRRAVGLRRQMWWKNAKVMALAGFSGLVFLFFLWGMFR

SEQ ID NO: 3092 - protein, 591 aa, Oryza sativa Japonica Group
MAIAARLLSTAPCRSPSSWPLPPSKPYLRFPSAPLLLLLRSPAAASVIHLSPPPVTPLAVACDDRHALPDSDEPRNRNPPDHPAPLLAAAAAAAAAVASPHAALALSGGSMGGCSDTSSSYSSSFSSSSSSDSFSSWSSSSDSWRSSSSSSSSPPKKKKVVVVESADLETHESVGTAASPPPPPPVALTPWEKFWISVAVVLGVGGLVFGLIFLIKRSIPPPRTISVVKLQIALGGVAAAKSFQKDLNRIAERVQGSSRRWYKFILSDTISSLHRHKDYCISTSLSVDIKDSDSWNGHFKKISLEERGKFDEETLSNLEGVKRNKEYSTKMDGSKNEYIVLTILVATDGTMDFPKLITNAADLKVALTKLYSTPETGLETSYEISFCRRMNSFTREPRPPPPPPLPRPHPAPPPPCPAASLQMSEMHSSRQEEGVLLTFSVADCIARLRTTTKPIAKKKNIKNCKQTNKELRRIFLHSHEYSVITNQCTFSDQPKKLQEPPLNSCAPARIQGAKSLKEKAAARPHPAPPPPRPAASAAAASTPGHAPTLGHIRRGRPQPSHRRRRSSLSCHAAASEKCQEKRKRERKRKKV

SEQ ID NO: 3093 - protein, 61 aa, Glycine max
MVRVATFFGMTFGAFLFWESMDKVHVWIALHQDEKQERMEREMEIKKMQADLIAQAKESES

SEQ ID NO: 3094 - protein, 271 aa, Robiginitalea biformata HTCC2501
MDRLPKIALPAVITIILLIILISKSAVTIGSGEAGVLYRTFGDGVVTDEPPLGEGFHIVAPWNKVFIYEVRQQEVFEKMKVLSSNGLDISLDASAWFQPKASDLGKLHQEKGEEYKERILLPAIRSAARSVVGRYTPEQLYSSKRDAIQQEIFSETQKIVDDQYIQLNEILVRDVTLPATIKEAIERKLKQEQQSLEYEFRLISADKEAQRQRIEAQGKADANRILSASLTDKILSDKGIEATLKLAESPNAKVVVVGSGEDGLPIILGNN

SEQ ID NO: 3095 - protein, 424 aa, Mesorhizobium sp. BNC1
MARIVMKFGGTSVADLDRIHNVARHVKREVEAGHQVAVVVSAMSGKTNELVGWVQGMPKAAGAKSPFYDAREYDTVVASGEQVTSGLLAIALQSIGIDARSWQGWQIPIRTDNAHGAARITDIDGSDIIERMERGQVAVVAGFQGLAPDNRVATLGRGGSDTSAVAVAAALRADRCDIYTDVDGVYTTDPRIEPRARRLAKISFEEMLEMASLGAKVLQVRSVELAMVHKVRTFVRSSFEDPDAPGMGDFDNPPGTLICDEEEIVEQQVVTGIAYAKDEAQISLRRVADRPGVSAGIFGPLAEANINVDMIVQNVSEDGSKTDITFTVPTGDVEKALSVLEKVRGTVGFDAIQSEAGLVKVSVIGIGMRSHAGVAATAFSALAEKGINIRAITTSEIKISILIDGPYAELAVRTLHSVYGLDKH

SEQ ID NO: 3096 - protein, 745 aa, Zea mays
MGKSSKKSSVKAAPAAVSVPEGKSAKKGKRNAEDEIEKAVSAKKQKTVPEKAVPVKKQPPPKKVESSSSEEDSSDSEVEVKVQPKKVIQPKKSTQPAKQESSDDSSSESSSDDEPSKKPVAGSKKPPASSSSSDDSSDSDDSSSDEEPAKKPTVLSKKPTVLSKKPTVLSKKPVTAVSNGSKQVKPDSSSSDSSSDEDEKPAASLKKPVVASVQKKTQESDSSDSDSDEDESEDDIPAKAQVVAKKKEESSSSSDSDSDSESEDEKPAANLKKPPVPSVQKKTQESDSSDSDSDEDESDDIPAKAQVVAKKKEESGSSSDSDSEFESDDEDSNAKTVQPAKAAAIKKKEDSSESSETDSQSDSEDSEPEKPTVPAKRPLATNKKNEQSSEKSDDSSDESSDESDEEPPQKKTKNSAPSGAAKAATNVSKKKSSSDEDDESSEESSDDEDTEQVETKETSVVTTQKPAHNEPKTPAKSQSQATGSKTIFVGNLAYSIEREQVKEFFEEAGEVVDVRLATFDDGSFKGFGHVEFATVEAAQKALEFVGHDLMGRPLRIDMATERGAYTPSSGKDNGSFKKFAPRSGNTVFIKGFDTSGGEDQIRTALEEHFGSCGDITRISIPKDYDTGVSKGMAYMDFKDPDSLNKAYELNGTDLGGYSLYVDEAKPRPDNSGGFSGDRGGGRGRSGGFSGGRGGRSDRGRGGSRGRGFGGRGGRGDRGRGGRGTPFRQTAGTASTGKKTTFGDDD

SEQ ID NO: 3097 - protein, 517 aa, Rickettsiella grylli
MSQQNPSPLLLLILDGWGFNEKKDHNAIAMAHTPHWDHLLETCPHTLLDASGQAVGLPVGQMGNSEVGHLTLGAGRIIHQDLTRINNAIETRAFFKNSCLLAGFKKILSNHQSVHLIGLLSSGGVHSHENHWTALLELAAQQGIISCYLHPFLDGRDTPPQSAKIFLKRLEAKCTQLGIGKIASLMGRYYAMDRDKRWQRTKIAYDCLTLGKTNYQATNALQALQFAYDRGETDEFVSPTRITEINPSHLTINDGDLVIFMNFRADRARQLSHAFLDKSFNAFHRQLHPRLAGFISLTEYATTLPSQVAFPQQNLRNSLGDYLAQHHLSQLRIAETEKYAHVTFFFNGGNETPLINETRVLIPSKKVSTYDRVPDMSALEITHHLLKVIKEKKYDVIICNFANPDMLGHTGNLPATLHAIQCIDDCIGKITHCLKQYGGEALITADHGNAECMFDENTQQAHTAHTNKPVPFIYVGRPAKINPIKHPSLANIAPTLLYVLNLPKPQEMTGQSLLTLI

SEQ ID NO: 3098 - protein, 304 aa, Burkholderia mallei ATCC 23344
MDYQPILERIHTELAPWIGAGRVADYIPELAKVPAERFGMAVVTLDGRIHTVGDARERFSIQSISKLFACTLAFQLLGDALWERVGREPSGNAFNSLVQLESERGIPRNPFINAGALIVTDVLCRRFVGAETALVQFMRRLTGVAELDYDLRVASSELAHAERNRAMAHFMASFGNLHMPPETVIDAYCRQCAIEMNCIELATAALFLANAGVAPVSGERILDASSAKRLSALMLTCGTYDAAGDFVYRVGLPAKSGVGGGIVAVLPGEMAVCVWSPGLDANGNSVAGVQALEQLTTLTGRSIF

SEQ ID NO: 3099 - protein, 329 aa, Thermotoga sp. RQ2
MYLMNTYSRFPATFVYGKGSWIYDEKGNAYLDFTSGIAVNVLGHSHPRLVEAIKDQAEKLIHCSNLFWNRPQMELAELLSKNTFGGKVFFANTGTEANEAAIKIARKYGKKKSEKKYKILSAHNSFHGRTLGSLTATGQPKYQKPFEPLVPGFEYFEFNNIEDLRKKMSEDVCAVFLEPIQGESGIVPATKEFLEGARKLCDEYDALLVFDEVQCGMGRTGKLFAYQKYGVVPDVLTTAKGLGGGVPIGAVIVNERADVLEPGDHGTTFGGNPLACRAGVTVIKELTKEGFLEEVEEKGNYLMKKLQEMKEKSRWALLVGWGSIKGISF

SEQ ID NO: 3100 - protein, 203 aa, Nostoc sp. PCC 7120
MSITYGTQESLRVGQQAPDFTATAVVDQEFKTIKLSDYRGKYVVLFFYPLDFTFVCPTEITAFSDRYEEFKKLNTEILGVSVDSEFSHLAWIQTDRKSGGVGDLNYPLVSDIKKEVSDAYNVLDPAAGIALRGLFIIDKDGIIQHATINNLAFGRSVDETLRTLQAIQYVQSHPDEVCPAGWQPGEKTMTPDPVKSKVYFAAV

SEQ ID NO: 3101 - protein, 513 aa, Hordeum vulgare subsp. vulgare
MDGNNRGGGHSEVLKNYNLGKTLGLGTFGDVKVAEHKLTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITIHEIRVHPWFKNHLPCYLAVPPPYKEQQAKMIDEDILREVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 3102 - protein, 390 aa, Rickettsiella grylli
MNLHEYQGKALLSEYGLPVPRGKLASTVEEALAATEALGGSAWMVKAQVHAGGRGKAGGVKYVTSKEAVAIEVKRLLGQRLVTPQTDEKGQPVNHVLIAQPCDIKRELYLGVVLCRSTQRIIMMASTEGGVEIEKVAEETPEKIVKVICDPLLGVMPYQARDLAFQLKLTPNQVKEFTSILLGLGRLFVERDLSLIEINPLICDEKGHLICLDAKVVVDDNALFRQPECRAMRDPSQEDARENRAHDWELNYIALDGDIGCMVNGAGLAMATMDLIKLQGGNPANFLDVGGGATQERVAEAFKIILSDEKVKGILVNIFGGIVRCDMIAEGIIGAVKEVGIKIPVVVRLEGNNADVGAKKLSESGLNIIAAKSLTEAAEHIIAAVKSTAA

SEQ ID NO: 3103 - protein, 608 aa, Polaromonas sp. JS666
MEHAPAWLTNSFIYLAAAVVAVPLAKKFGLGSIIGYLAAGIAIGPWGMGLVTNVQDILHFAEFGVVLMLFLVGLELEPQRLWNLRRPIFGWGSAQVLGCAALLTGAAMLFGVGWQTALVAGLGLALSSTAIALQSMGERNLLPTSSGQAGFSILLFQDVAAIPILALLPLLGAVAGENEAAAQSHRAIEALKIIAVIGGIILGGRLLLRPLLRWIANSGTPEIFTAASLLLVVGIAALMQLVGLSMALGAFLAGVLLAESEYRRELETDIEPFKGLLLGLFFIAVGMSIDFGVLWKSPGLMAAILLGFLGLKLAVIYGLAWRMKLPYQERPVFTVLLAQGGEFAFVVFQAAAGAQVFSAETASLLIGAVALSMLISPLLLVAVDKLLLPRWANCSTPQLEEISEPQQASIIIAGFGRYGQIVGRMLLAQGIPATVLEHDADMVETVRAFGYRVFYGDATRLDLLRTAGAASARILVLAVDSMEQSLKIVDLAKEHFPNLEIVARAHDVTHWNALRDRGVMRVEREVFESSLRSARTVLELLGQPPHEARQAAMRFRQHNLELFERMYPHRKDRTKVIAVATQGRLQLEEQMAQERAQAAQPRPQDWHG

SEQ ID NO: 3104 - protein, 429 aa, Nostoc sp. PCC 7120
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 3105 - protein, 563 aa, Gluconobacter oxydans 621H
MTYTVGHYLAERLTQIGLKHHFAVAGDYNLVLLDQLIEQGGTKQIYDCNELNCSFAAEGYARANGAAAAVITFSVGAISAMNGLGGAYAENLPILVISGAPNSNDHGSGHVLHHTIGTTDYSYQMEMAKHVTCAAESITSAETAPAKIDHVIRTMLREKKPAYLEIACNISAAPCVRPGPVSSLHAHPRPDEASLKAALDESLSFLSKANKVAILVGTKLRAAEALKETVELADKLGCPVTVMAAAKSYFPETHPGFRGVYWGDVSSPGAQEIIEGADAVICLAPVWNDYSSGGWKSVVRGEKVLEVDPNRVTVNGKTFEGFRLKEFVKALTEKAPKKSAALTGEYKPVMLPKADPSKPLSNDEMTRQINELVDGNTTLFAETGDSWFNAVRMHLPEGAKVETEMQWGHIGWSVPSMFGNATASPERKHVLMVGDGSFQLTAQEVAQMVRYELPVIIFLVNNHGYVIEIAIHDGPYNYIQNWDYAALMQCFNQGVPGEESGKYGLGLHATTGAELADAIAKAKKNTRGPTLIECKLDRTDCTKTLVEWGKAVAAANSRKPQSV

SEQ ID NO: 3106 - protein, 254 aa, Triticum aestivum
  misc_feature (226)..(226): Xaa can be any naturally occurring amino acid
MNGAGASQQQQQQQQRLRQQQQQQQQALLMQQALQQQQYQSGVLAAAAAAAMTQMEPVSNGNLPPGFDPSTCRSVYVGNVHPNVTESLLIEVFQGSGPVERCKLIRKEKSSFGFVDYYDRRSAALAIMTLHGRHIYGQAIKVNWAYASTQREDTSGHFHIFVGDLSSEVNDATLYACFSTYPSCSDARVMWDNKTGRSRGYGFVSFRNQQEAETAITEMTGKWLGXSKQIRGNGATKNQRKRKNKNGTILSASS

SEQ ID NO: 3107 - protein, 527 aa, Arabidopsis thaliana
MRKKMMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGATSSVTMRKKMMISDLPHDLESEILSRVPAKSLAKWKTTCKRWYALFRDPSFVKKNFDKAGGREMIVLMNSRVYSNSVNLQGINNRFDPSMEVTGKLIKLNDIKRCRYFCYLSLRRFDIMHYDGKHWTCGLEPVYR

SEQ ID NO: 3108 - protein, 206 aa, Oryza sativa Indica Group
MAIFLGGGRTLFLLVAILDSDRRCYILDTHVTMMVMDIACDSRTDTSISPPSSNSLKLFLSTWYTRAPMTTINDVMFSTTRANTALALSQGLLQRFSIKGRVYPAILPVDGKEVSGKVFKGITDRELNVLDIFEDEEYVKRTVEISLTDTSEKLLAYAYIWGNQDDPDLYGEWDFEEWKRVHLEDYVKMTQEFMEELEQLEPKTET

SEQ ID NO: 3109 - protein, 361 aa, Sulfolobus tokodaii str. 7
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 3110 - protein, 130 aa, Zea mays
MAASAATTTAAATAAAVGAGEVISVHSLEQWTMQIEEANAAKKLVVIDFTASWCGPCRIMAPVFADLAKKFPAAVFLKVDVDELKPIAEQFSVEAMPTFLFMKEGDVKDRVVGAIKEELTTKVGLHAAAQ

SEQ ID NO: 3111 - protein, 594 aa, Marinobacter sp. ELB17
MKTTLLAGALGLLLPVIGLAGEYNLTVDRVQIDTGDFVKEGIGYNGASPGPVLRFKEGEEVSINVTNNLNEMTSIHWHGMILPFTQDGVPGISFAGIKPGETFTYEFPITQSGTYWFHSHSGFQEPDGAYGAIVIDPEGREPFRYDRDYVVQLTDKHPHSGDRIMRNLKIMPDYYNREQQTVGDFFSEASENGLMATIKDRMAWGDMRMMKADVEDLQGFTGLINGKGPDQNWTGIFEPGERIRLRFINSSAMTYFDIRIPGLEMTVVQADGNNVQPVTVDEFRIGVAETYDVIVRPKEKQAYTIFAESMGRSGYARGTLAPEAGMVAAVPELREAARLTMADMGGMEGMDHSSMAGMEGMKGMDHSKMAGMDQSDMKGMEGMDHSKMAGMDQSDMNGMEGMDHSAMGQGAMASAGGASDPFYAAGSGLVPTAANGGKFLSYSDLRAQKPLYDEREPTREIELKLTGNMERYTWSINGVKYEDADPIRLQYGERVRFKFVNTTMMTHPMHLHGMWSMLDVGAGQLNPVKHTISVQPGTTVYIETEVDEPGQWAFHCHLSYHAAAGMFRKVIVEGGPESTQAVSDDQPGDVGGDV

SEQ ID NO: 3112 - protein, 329 aa, Sulfolobus tokodaii str. 7
MSFEDYFNRIVENVNINIEKYLKGDIQELYEASFYLFKAGGKRLRPLILVSSADLLGGDLNRAYLAGASVEVLHTFTLIHDDIMDEDTTRRGMPTVHVKWGIPMAILAGDLLHAKAFEILNEAFRGMSSNKITRAFEIFTKAIIIISEGQALDMQFEDKVTVSEEEYLDMIKRKTAMLFSSSAALGGLIATDNEKEIQALADYGLNLGISFQIVDDILGLIADEKELGKPVYSDIREGKKTLLVIKTMKEATDEEKKILLKALGNKNASKDELITAAEIIRKYSLEYAYNKAEEYARKAIEALESIDWKNDEAGKALKYLAEFTVKRRK

SEQ ID NO: 3113 - protein, 175 aa, Gluconobacter oxydans 621H
MTETIQHSVISVLIEDESGALARVVGLFSGRGYNIESLTVALVDAEQKLSRITVLTSGTPMVIRQIKAQLKRLIPVHDVCDLTEEGPYVGRELALVKVVSSGDRRTEALRIADSFRARPVDTTAMSFVFELTGSPEKIDAFIELMRPLGLAEVSRTGIAAIGRGPSVFHLKKEPV

SEQ ID NO: 3114 - protein, 986 aa, Oryza sativa Indica Group
MRIRGDGGGDEEEAAMAVVSAPPQHLVFAYYITGHGFGHATRALEVVSHLIAAGHDVHVVTGAPEFVFTTEISSPNLHIRKVLLDCGAVQADALTVDRLASLEKYHQTAVMPRESILRTEVEWLNTIKADLVVSDVVPVACRAAADAGIRSVCVTNFSWDFIYAEYVVVAGHHHRSIVWQIAEDYSHCEFLLRLPGYCPMPAFRDVIDVPLVVRRLHKSRSEVRKELGIKDDVKVVIFNFGGQPAGWKLKKEWLPDGWLCLVCGASETQELPPNFIKLAKDAYTPDLMAASDCMLGKIGYGTVSEALAYKLPFVFVRRDYFNEEPFLRNMLEHYQCGVEMVRRDLLTGHWKPYLQRAMTLHPCYDGPINGGEVAAHILQDTAVGKKYISGKIKLSGARRLRDAIVLGYQLQRAPGRDVGIPDWYSVSEKEIGVRPAPTYHEVNGSAESSFEDFEILHGDIQGLTDTMAFLTSLSGLVGNDPRSPEKQSRERVAASVFFDWEEEIYVARAPGRLDVMGGIADYSGSLVLQRSNPMKQKLWKHTQARQLANGGAVPLLQIVSFGSELSNRAPTFDMDLSDFMDGDKPISYDKAKEYFSQDPSQKWAAYVAGTILVLMTELGVVFTDSMNILVSSSVPEGKGVSSSASVEVASMSAIAAAYGLNIPPRDLAILCQKVENRIVGAPCGVMDQMTSACGEANKLLAMICQPAEVKELVSIPTHIRFWGLDSGIRHSVGGTDYGSVRVGTYMGRKMIKCAASDLLSESLPSCPPIQSGNTNSDEYEEHGVDLLKSEASLEYLCNLPPHRYEAVYARDIPEIITGDAFLEKYGDHNDAVTTVDPKRSYCVKAPTRHPIYENFRVEAFKALLTAAKTVEQLSALGELMYQCHYSYNACGLGSDGTDRLVNMVQEVQHRKTSQDGGPSLFGAKITGGGSGGSVCVIGKNCLKSSEEIFEIQKRYKAATGYLPIVFEGSSPGAGKFGYLKIRRRST

SEQ ID NO: 3115 - protein, 315 aa, Coprinellus disseminatus
MSSNHHLPASIKEQLDRVDSTGEYSGALPKITSTSKRTYYVKAGTLRDAEQWAGEAESLKEMERASPGIAPKLYSFGNLSSGNPYFISEYKVMGHLNSSVAVVLAKRLATELHQFESAHGFGFQVPTYCGPTRFANGWFDGWSKCYAAMYGTLIQRLRETGRHERLCSKGDKIIQRCGFDPHSIIPILLGKMSIQPVLLHGDLWNGNVGVDQTTGEPVIFDPASFYGHSESDLAIARIFGGFPQSFYDTYFKNHPKSEPQAEYPVRAELYESFHYLNHTVIFGVSAPTNSGCKSRDKVVPGKLRSAGGKEDGHGH

SEQ ID NO: 3116 - protein, 505 aa, Zea mays
MGCFQSKVAGPLPPNDAAALPADKPADPEAANGGADGEGDGDDKEAVKRAVPVFREFALAELRAATKGFSADLIVSESGEKAPNAVYRGRLDGGRLIAVKRFSRLSWPDPQQFLAEAAGVGKVRHRRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFESRDRPNIKYLLSSVGPLQNQKEVASHVFMGITKATSVLPTICSPLRKACAGMDLSAVHDILLKTGYKDDEGAENELSFQEWTQQVQEMLNTKKFGDIAFRDKDFKTAIDYYSKLVAMMSTPSATVFVRRSFSYLMNGQAELALRDAMQAQVCMPEWPTAFYLQALALSKLGMETDAQDMLNDGATFEAKKQNGWRS

SEQ ID NO: 3117 - protein, 143 aa, Salmonella enterica subsp. arizonae serovar 62:z4,z23:--
MAIERTFSIIKPNAVAKNVIGSIFARFEAAGFRIVGTRMLHLTVEQARGFYAEHDGKPFFDGLVEFMTSGPIVVSVLESENAVQRHRDLLGATNPANALAGTLRADYADSFTENGTHGSDSLESAQREIAFFFGEGEVCPRTR

SEQ ID NO: 3118 - protein, 368 aa, Spinacia oleracea
KLKVAINGFGRIGRNFLRCWHGRKDSPLDVVVVNDSGGVKSATHLLKYDSILGTFKADVKIIDNETFSIDGKPIKVVSNRDPLKLPWAELGIDIVIEGTGVFVDGPGAGKHIQAGAKKVIITAPAKGSDIPTYVVGVNEKDYGHDVANIISNASCTTNCLAPFVKVLDEELGIVKGTMTTTHSYTGDQRLLDASHRDLRRARAAALNIVPTSTGAAKAVSLVLPQLKGKLNGIALRVPTPNVSVVDLVVNIEKVGVTAEDVNNAFRKAAAGPLKGVLDVCDIPLVSVDFRCSDFSSTIDSSLTMVMGGDMVKVVAWYDNEWGYSQRVVDLADLVANKWPGLEGSVASGDPLEDFCKDNPADEECKLYE

SEQ ID NO: 3119 - protein, 284 aa, Oceanobacillus iheyensis HTE831
MTSIGYLGPKGTFTKMAVDSVFNGEMKNGYRTIPECIDAVDKGEVDIGVVPIENAIEGTVQLTIDYLIHQVRLPVVGEIVVPIQQHLLVRKEVTNNLSDIQEVYSHSHAIAQCHQYLHRHLHAATTKHTSSTGKAAEIVSNSNEPIAAIGNRLAAEEYGLHIFQENIHDYPNNHTRFLVLSNHPEKVHIKHKKDSEKTTMLITLPNDQSGALHQILSAFSWRKLNLSKIESRPTKTGLGNYFFIIDVDQPYDDVLFPGVKSELEALGCQVTILGTYPVYHMLQN

SEQ ID NO: 3120 - protein, 163 aa, Glycine max
  misc_feature (55)..(55): Xaa can be any naturally occurring amino acid
MALGTVTRRLGNKLLPALSPSPRLLHSHATSFGFKQVNEEEKARMVGDVFTSVAXSYDLMNDLMSAGLHRLWKDRLVSKLNPFPGMKHLDVAGGTGDVAFRILENIHKVKLRGLRGAFQDTLEAETQIYVCDINPKMLNVGEQRASENGFGEHGSLVWPEGNA

SEQ ID NO: 3121 - protein, 484 aa, Capsicum annuum
MGGKSSREDSWRQTSSTRSSWNQYEYPPTHSSSPSYPQDSYSYSSQQQAVPSYAPPPPHQQAVPSYAPAPPQQNYASHASRPRLDRRYSRIADNYNSLDEVTEALARAGLESSNLIVGIDFTKSNEWTGKRSFGNRSLHHIGQNLNPYEQAISIIGKTLAAFDEDNLIPCFGFGDASTHDQDVFSFFPDERFCNGFEEVLFRYREIVPQLKLAGPTSFAPVIEMAMTIVEQSGGQYHVLLIIADGQVTRSVDTGRGQLSPQEQKTVDAIVQASKFPLSIILVGVGDGPWDMMKEFDDNIPARDFDNFQFVNFTEIMAKNVPQSRKETEFALSALMEIPSQYKATMELHLLGGQSGKSPSRVALPPPMYGATSVGASKPSRATSFQQPTSSYYGYGSPADAAPHFQQTSSSYYNSAHPVDTVPSAPSSPYIAPSSTYDNQVCPICLTNPKDMAFGCGHQTCCDCGRALENCPICRSSIQTRIKLY

SEQ ID NO: 3122 - protein, 365 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQGLEGSVASGDPLEDFCKDNPADEECKLYE

SEQ ID NO: 3123 - protein, 282 aa, Thermotoga sp. RQ2
MRIDTVNVLLEALPYIKEFYGKTFVIKFGGSAMKQENAKKAFIQDIILLKYTGIKPIIVHGGGPAISQMMKDLGIEPVFKNGHRVTDEKTMEIVEMVLVGKINKEIVMNLNLHGGRAVGICGKDSKLIVAEKETKHGDIGYVGKVKKVNPEILHALIENDYIPVIAPVGIGEDGHSYNINADTAAAEIAKSLMAEKLILLTDVDGVLKGDKLISTLTPDEAEELIRDGTVTGGMIPKVECAVSAVRGGVGAVHIINGGLEHAILLEIFSRKGIGTMIKELEG

SEQ ID NO: 3124 - protein, 491 aa, Vibrio vulnificus YJ016
MKMCKTKIVATLGPASQTREKLTQLIQAGVNVVRLNFSHGSAEEHIARAEMVREIAQDLNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVEAMVRIAQGVEHETSCAQGCWDKLHHLCNDAGKSFALSSMISATKVHKDLGVAIVTQHGETPLLMSRCQSQATIWAVSDKPELLRKLAILRGVTPVYLPTLDKRGDIAHQLVSLLGADAKQKQISSIMMTQLESVEGVGDMNVCRLLNLNETPITTAIAA

SEQ ID NO: 3125 - protein, 376 aa, Malus x domestica
MAALRSFLKKRSSVLCNGAMRRKLFSTEVSQPLTDSPSFAQRIRNLPKDLPGTQIKTQVSQLIGRTPIVYLNKVTEGCGAYIAVKQEMFQPTASIKDRPALSMINDAEEKGLITPGETILIEPTSGNMGISMAFMAAMRGYKMVLTMPSYTSLERRVCMRCFGADLILTDPTKGMGGTVKKAYDLLESTPNAYMLQQFSNPANTKVHFETTGPEIWEDTNGQVDIFVMGIGSGGTVSGVGQYLKSKNPNVQIYGVEPAESNVLNGGKPGPHSIMGNGVGFKPDILDLDMLERVIEVTSEDAVNMARQLALKEGLMVGISSGANTVAAMELAKKPENKGKLIVTVHPSFGERYLSSVLFQELRQEAENMQPVAVDYP

SEQ ID NO: 3126 - protein, 258 aa, Rickettsiella grylli
MSSIIIKTALEIEKMKAAGRLAAEVLEMIEPHVKAGVTTNQLNKICHDYIVNEQHAIPAPLNYRGFPKSICTSINHQVCHGIPSDRVLKTGDMLNIDVTVIKDGYHGDTSKMFFVGKPSILAQRLSRVTQECLYKAIQLVKPGIHLGDIGACIQHFAESEGFSVVREYCGHGIGRIFHEDLQVLHYGQAGTGVQLVPGMTFTIEPMINAGKRFVKLMPDHWTVVTKDHSLSAQWEHTLLVTSNGYDVFTKRKEEQTII

SEQ ID NO: 3127 - protein, 466 aa, Arabidopsis thaliana
MDIISGQPMFLLFCFILSCFLFFTAARSRRSPTQVLSKSPPGPPRLPIIGNIHLVGKNPHHSFTDLSKTYGPVMSLKLGYLNSVVITSRDAAREKVEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 3128 - protein, 450 aa, Marinobacter sp. ELB17
MTKDQDRTSRYDEGSLTLPGTVMLGTGVMIGAGIFALTGQMAQMAGALFPLAFLAAAIVISFSSYSYIKISNAYPSAGGIGMYLHKAYGDRLSTGFNALLMYFSMVIAQSFLARTFGSYTMQLFGGDEGGRMVPILGVSLILTAFVINLLGNRWIQGVVSFIGILKITGILVFGLVGVWLADSLAVDFPSSGETGVVGNFVGATALGILAFKGFTTITNSGAEVKDPKRNVGRAIVISIAACVVIYTLVGFAVASNLSLAEIIETRDYSLAAAARPALGDYGLWFTVAIAMMATAGGILASIFAVSRMLAMLTEMKLVPHSHFGMPGSIQKHTLVYTVVLGLVLTAFFDLSRIAALGIIFYLIMDISIHWGVLRYLYQDVKAKRWVPAVAIVLDLVVLGGFVWVKLNSDPFVIGVAVVTMIVIAVAEQIFLKSSARRKAMNSDEANAHHH

SEQ ID NO: 3129 - protein, 482 aa, Staphylococcus aureus subsp. aureus MW2
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAVTFVLVLLVFWGLGFEAKLYTLIWFIVGIILYLSYGLRHSKKNDVAEYHPPK

SEQ ID NO: 3130 - protein, 457 aa, Staphylococcus aureus subsp. aureus MW2
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 3131 - protein, 173 aa, Triticum aestivum
  misc_feature (44)..(44): Xaa can be any naturally occurring amino acid
  misc_feature (62)..(62): Xaa can be any naturally occurring amino acid
  misc_feature (74)..(74): Xaa can be any naturally occurring amino acid
MANPRVFFDMTVGGAPAGRIVMELYKDAVPRTVENFRALCTGEXKGVGKSGKPLHYKGSSFXRVIPDFMCQGGXDFTKGNGTGGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 3132 - protein, 165 aa, Mycobacterium smegmatis
GHMMLPRVGLGTDVHPIEAGRPCRLLCLEFDDADGCAGHSDGDVAAHALCDALLSAAGLGDLGTIFGTDRPQWRGASGADMIRHVRGLVENAGFVIGNATVQVIGNRPKVGPRREEAQQVLSELVGAPVSVSATTTDGLGLTGRGEGLAAIATALVAAEPVGDAK

SEQ ID NO: 3133 - protein, 374 aa, Zea mays
MADCMQEWPEPVVRVQALAESGLSVIPRCYVKPPCDRPAVSPAAATTVQETTEPSDMSIPVVDLGALLAADGGAAVTEAVAAACREWGFFQVVGHGVRPELLRAAREAWRGFFRRPLAERQRYANSPRTYEGYGSRLGVQKGAALDWGDYFFLHLAPEAAKSTPKFWPAVPGNCKEVSEEYGREVVRLCELLMRVMSVSLGLDEAHLQRAFGGAGCCGATLRANYYPRCPQPDLTLGLSAHSDPGVLTALLADEHVRGLQVRRSAGDWVDVRPVRDAFIVNVGDQVQIMSNSVYKSVEHRVVVNAEEERISLAIFYNPKGDVPISPAPELVTAAKLPPLYPTMTFDEYRLYVRSKGARGKAQIEALKGQASPEN

SEQ ID NO: 3134 - protein, 66 aa, Sulfolobus tokodaii str. 7
MIIPIRCFTCGSLIGDKWEPFITRVSNGEDPGKVLDDLGVKRYCCRRMLLSHVDIIKEVIHYTRPI

SEQ ID NO: 3135 - protein, 459 aa, Streptomyces coelicolor A3(2)
MTSRSATATARTSSEARAVARTQTLIKGEHGIGTVRRTTLPGGLRIVTETLPSVRSATFGIWAHVGSRDETPALNGATHYLEHLLFKGTRKRSALDISSAIDAVGGEMNAFTAKEYTCYYARVLDTDLPLAIDVVCDMLTGSLIQEEDVDVERGAILEEIAMTEDDPGDCVHDLFAHTMFGDNALGRPVLGTVDTVNALTADRIRRFYRKHYDPTHLVVAAAGNVDHNKVVRQVRAAFEKSGALKDPAAQPLAPRAGRRTVRAAGRVELIGRKTEQAHVILGMPGLARTDERRWAMGVLNTALGGGMSSRLFQEVREKRGLAYSVYSYTSGFADCGLFGVYAGCRPSQVHDVLKICRDELDHVAEHGLTDDEIGRAVGQLQGSTVLGLEDTGALMNRIGKSELCWGEQMSVDDMLARIASVTPDDVRAVARDVLGRRPSLSVIGPLKDKQASRLHDAVA

SEQ ID NO: 3136 - protein, 184 aa, Picea sitchensis
MAAATSLVAFASAAAPAHSLLNTRRPNRAMAMATAMARRVHQSQSQSQPEGALYCRRDVALLGVAGLISLAEAAPAKASLEEDYSKETKEVINQVKSTIDMEKSNPNTSAAVAALRETSNNWVAKYRREKQLAGKPSFSNMYSVLNAISGHYISFGPTSPIPAKRKARILEEMDVAEKALSKGR

SEQ ID NO: 3137 - protein, 481 aa, Bacteroides thetaiotaomicron VPI-5482
MENGVMMQYFEWHLPNDGKLWKQIKEDALHLHDIGVTAVWIPPAYKADEQQDEGYATYDLYDLGEFDQKGTIRTKYGTKDELKKMIDELHKYHIAVYLDVVLNHKAGGDFTEKFMVVEVDPKERTKALGEPFEIQGWTGYSFHGRKDKHSDFKWHWYHFSGTGFDDAQKRSGVFQIQGEGKAWSEGVDSENGNYDFLLCNDIDLDHPEVVSELNRWGKWVSNELNLDGMRLDAIKHMKDQFVAQFLDAVRSERGNDFYAVGEYWNGDLEALDAYIEAVGHKVNLFDVPLHYNMFQASQEGKDYDLRDILKDTLVEHHPDLAVTIVDNHDTQRGSSLESNVEDWFKPLAYGLILLMKEGYPCLFYGDYYGIKGEKSPHTRIIDILLDARRKYAYGDQIEYFDHPSTIGFIRTGDEEHNGSGLVFLMSNDEAGSKIMSLGEKHKGEVWHEITGSISEEITLDEEGNGEFSVESRNLAVWVKKD

SEQ ID NO: 3138 - protein, 356 aa, Oryza sativa Indica Group
MDHAAEAQRTDLMTITRHVLNEQGRHPESRGDFTILLSHIVLGCKFVASAVNKAGLAKLIGLAGDTNFLFASISRCHTYEVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 3139 - protein, 267 aa, Mycobacterium sp. MCS
MAGLRLRKEKVVAQRTTAELDAMAAAGALVAAALTAVREAAVPGVSTKELDAIAEAVIRDGGGIPSFLGYHGFPASICSSVNDRVVHGIPSATETLASGDLVSIDCGAILDGWHGDSAITFGVGPLIPVDEALSAATRESMEAGIAAMVPGNRLTDVSHAIEKGTRAAEARYQRGFGIVDGYGGHGIGRQMHMDPFLPNEGAPGRGPRLAPGSVLAIEPMLTLGTTKTKVLDDEWTVVTSDGSRAAHWEHTVAVTEDGPRILTLPAD

SEQ ID NO: 3140 - protein, 365 aa, Mycobacterium smegmatis str. MC2 155
MKVLVEADGGSRGNPGPAGYGAVVYDADHATVLAERKEAIGRATNNVAEYRGLIAGLEAAAETGATEVAVSMDSKLVIEQMCGRWRVKHPDLIELQRRAAALAAGFDHVDYTWIPRERNSHADRLANEAMDAAAGIAVPDKASESDDPPAPAKNSVGWSGVTGAPTRLFLLRHGQTELSVDRRYSGRGNPALTEEGRRQADAAARYLGERGGISAVVTSPLQRAYDTAAAAAKALGLDVTVDDDLIETDFGAWEGLTFAEAAQRDPDVHRRWLRDTSVEPPGGESFDAVAHRVRRARNRIIAEHGASTVLVVSHVTPIKTILRLALDAGEGILYRLHLDLASLSIAEFYADGGSAVRLVNQTAYL

SEQ ID NO: 3141 - protein, 516 aa, Oryza sativa Japonica Group
MAKPAPAPAAGAREDEDAPALRRRLRRLVAAATAGAASESVLDEAAAALAALRDAEVGVGRKGVGGGEEAAAAAVPALFLCPISSGIMRDPVVIESGQCEVWILYIILASQFHAIGVFSVTTCLYEYRGEFLLFKYADMMRFSRNMEQNSKSTNMTYDRRSIQEWFSAGNQICPQTQQVLSHTIVIPNHLVRTMISQWCTENGLTLPEIENQEQDHVTNSEEKTFDEIFVKITSSANSGGRKQAIKDLRLLTKRNSEFRAVLGQRPDSIAQMILARSTPGLQNDPQVLEDMVTIILNFSIHDSNKKIIGDDSEAIQFLIWALKSGDMGSRSNSAAAIFTLSALDSNKEKIGKLGAMDPLIDLLEHGSIIAKKDAASAIFNLCLLHENRSIAARSGIVDVAMRAIDDQSLVEESLAILALLSRNQEMVEIITEFNGTASMLRSIRESECKRSKENAMVVLFAICTYNRTKLKEVEADESINGSLTFLAQTGTQRARRKASGILEKMKRTMHNRHCSC

SEQ ID NO: 3142 - protein, 222 aa, Coccidioides immitis RS
MTEQDNNAESYDATKRQQTSSSSQVLNDIVSGSNFDHEEVDRLWKRFMKLDRDKSGTIERDEFLSLPQVSSNPLSTRMIAIFDEDGGGDVDFQEFVSGLSAFSSKGNKEEKLRFAFKVYDIDRDGFISNGELFIVLKMMVGSNLKDMQLQQIVDKTIMEADLDGDGRISFEEFTRMVENTDVSMSMTLGEWPIDFFPYPFKWNVAQPANRSILSTFGGKFSA

SEQ ID NO: 3143 - protein, 375 aa, Malus x domestica
MAALRSFLKKRSSVLCNGGAVRHRLFSAQVSQPIPDSPSFAQRIGNLPKDLPATQIKTQVSQLIGRTPIVYLNKVTEGCGAFIAVKQEMFQPTASIKDRPALSMINDAEEKGLITPGETTLIEPTSGNMGISMAFMAAMKGYKMVLTMPSYTSLERRVCMRCFGADLILTDPTKGMGGTVKKAYDLLESTPNAFMLQQFSNPANTKVHFETTGPEIWEDTNGQVDIFVMGIGSGGTVSGVGQYLKSKNPNVQIYGVEPAESNVLNGGKPGPHSITGNGVGFKPDILDMDMMERVIEVRSEDAVNMARQLALKEGLMVGISSGANTVAAMELAKKPENKGKLIVTVHASFGERYLSSVLFQDLRQEAENMQPVAVD

SEQ ID NO: 3144 - protein, 489 aa, Zea mays
MLALARALRSLGQAGARREGPLLAWLSSLRSAAFSSSSAPPEYDMPSVTWGVIQGRKERLVSRVLALDFLRSAGVSDPAGELEAVELPSSLEVLQERLDFLLRLGLSTDDLSNYPLLLACSLRKNVIPVLSYLEKLGVTRARLAAFVRAYPACLHASVAVDLAPMVKALRGLDVDRQDLPRVLERYPDVLGLKPDGTISTSVAYLVGIVGVAPRDIGPMVTHFPFFLGMRVGTTIKPFCDYITSLGLPMRILARILEKRPYILGYDLEETVKPNVEALLSFGIQKEALPLVIAQYPSILGLPLKAKLAAQQYFFTLKLQIDPDGIARAIEKLPQLVSLNQNVILKPVEFLRGRGISNEDVARMVVRCPQILLLRIELMKNSLYFFKSEMKRPMSELLEYPEYFTYSLESRIKPRYMRVTSRGIKCSLDWFLNCSDMRFEDRMQGDFIEGDAPGPSFTMGGKLQMPGSQLVSDDDEDTDDEVLYRRTVMI

SEQ ID NO: 3145 - protein, 1743 aa, Clostridium difficile 630
MKQNKLLQRGAYFNDKNILIDDFDKRYNDYDFVEFFTGISNSTFGLKSDGNLYACGDNTGFQLGLGKDSSERRMFSKVKIDNVKYVSCGSKHSVAVTKDGFAYGAGTSNVGQLGVIESTVYYEFTKLPIDDVKTVACGYDFTFVLKNDGTLYSAGLNSSGQLGLGDTNNRVTFTKVNIDSVKDVVTYNQSVFIIKMDGTAHACGLNSNGQLGINSTLNKSVFNKIEGMDNVKQIACGSSHTILIKNDGTMYTTGSNGYGQLGTGNNNNSIVFTLSSINNVKYASCGNNHTMILKYDNTLFSTGQNNYGQLANANKDVASRNTFVKVNVENIKDIKCGSQFNFLINGSKEIFVSGCNLAGQLGSFFHTTFLYEFSKVQSSNLDNYSGLLVNDDYLYVTKDNSEFLNVKLSDNFQDYKKIELTDNNMFIVMNDGTLYACGLNNYGQLGLGDTVNRSVMTKVDIDNVLDIKGNGNSTFVLKNNGTLYSCGYNSSGILGLKDNTNRNIFTKIEIENIKEFCVESNYIVALNHSKELYGWGNQSYIVYGDNRNYPYKDTRVSNVEKIATWSDTLYILDSTGATKTIGYSYNGSGGYPAPSSSSTYREGGYINKNTSYRTLEFYNTSKTKLVNLFAFYNGCVFVDENGLAYCIGENNINFRGGSTTNENNSLRFINNSGVYYTNTDGTDYTCYQWTYKLIRCSIFDSPQNIIGNSKNILYLSKNNSTFKCTGNCITYGINSQNWYSYFSDSSNGAIALGNEFILKNYSGECLLKGYGKATNGEFGNSTNISSISNYDTGLKDIKDIIVKNNTVVVVDKNNNIYVTGANQFNKLGIGEYNNQPIRKFTNITEQSNSFIFMDDIKEITTSRNTMFIVKNDGTAYATGNNSSGQLGLGDTINRNKFTQINLDNIKKISTSIDGNTTFAIRNDGTLYSTGLNTKGQLGLGDIVNRNTFTKVNIQNVRDVVLGTTHSHAIKDDNTLYSCGENTHGQLGLGSESNHPDVLTFTVNNITNVRDVYCSDTTTFIVKDTNIAYCCGYNNNSQLGMGNTTDQYSFIKCMENVKEVIPNEINTYIITIYNTAYSTGLNTDYCLGLNSNSNQSSFSEIPISNVVKVAPNRNNAVLLLTSEGDVYTAGKCSNGSGTGSETPEKIKKIASKAKDIGMNYRCGHYVSDNGDLYGTGFNDCGQLGVGNVTKRDTFIKTNTRVKKILPLEYANIAIKDTNDIYICGLNNYGQLGVGNRYDSRNNDNRIFNYKHMNFVMGDLTSIKNRHNFILLNNKIVIPTTKDIDYGLVLGNLYKGDLYTELPYEDIKEVSISKTHIIILLNDGTMYGCGTNYHGELLQDLSINQVDEFVQINVSDVKHVSCGDNFTYFIKSDDSLWSIGKNSEYQLGIGHNNPVTELQRITTISSCKEVHCGKNYTLVVTTSNELFVQGYNDKGALGLGSDSENTIIKFFTKALTDIREIKSYGSDHILVLKNDNSVWVTGKNRDVYKIEQPVEFLKEFTIVPISEDVNTVKDVLATDNTLYIISEVGTTNAAIEITEKSISSIKIKIQDPNKDISRIEMLINGESVKSVSDLITEKISFEVPPDKIKIGENKILFRAYCKGDDLYASLFIFKESTGNSIIKDSYVMIGNRMYKVVNTTSNEQDITITLDRGLEEDLNLGDPIYQLINKTKVQVKINKSDLFKDMKLVEIKKSDSSYQEIYELEEANIKSAQPKIIVEKGDKWTAIKRPSMIFRYDAENNEPQA

SEQ ID NO: 3146 - protein, 204 aa, Zea mays
  misc_feature (149)..(149): Xaa can be any naturally occurring amino acid
  misc_feature (191)..(191): Xaa can be any naturally occurring amino acid
  misc_feature (193)..(194): Xaa can be any naturally occurring amino acid
ASAFLPFFLPRFLLLRHMLDRMRPEDVGLSPDLSFFRARDATRGGGTPTITHTTIYKCPNFSMVILFLPRNAVIPLHNHPGMTVFSKLLLGSMHVKSYDWLNTADPDPSSATSTTSSSSSDGPCLRLAELVVDDVFTAPCDTSVLYPTXGGNMHRFTAMAPCAILDVLGPPYSIEEDRDCTYYAELPYAHXSXXWLSHELPASQ

SEQ ID NO: 3147 - protein, 404 aa, Vibrio vulnificus YJ016
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDEHHRVHSFVEKPQNPPHLPNDPERSLVSMGIYIFSMEVLQQALIEDADNDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSMISNGVINSGGSVQHSIVSSNVRINDSATIVDSIIFDDVEIGEGCQLVNCIIDKHVKVPPYTQIGLNRLEDAQRFKISENGIVVVPESYQF

SEQ ID NO: 3148 - protein, 179 aa, Triticum aestivum
  misc_feature (169)..(169): Xaa can be any naturally occurring amino acid
FHRTSLYKKAGRYRSGIPGISSTHASVTLCANSCGFPGNPATKNLCQNCFLASSSSPSPSAASPPSPSSSPAAFPLFDKLRPAAVASPLLQAAPVYMAVDRPAAGPADPKASKSSVNRCHNCRKRVGLTGFRCRCGEMFCGAHRYSDRHDCSYDYKSAARDAIARENPXVVRAAKIVRF

SEQ ID NO: 3149 - protein, 225 aa, Capsicum annuum
MKLHATVASPTDTCKTIEVAVVERHHHRSPPQAIKLSPIPTADDNNPYNLTSPDDENSGEEFFIPPLNFSMVDNGIFRSGFPDVANFSFLQTLGLRSIIYLCPELYPESNMEFLKANDIRLFQFGIKNCKEPFVNIPEEKIREALGVLIDVRNHPVLIHCKRGKHRTGCLVGCLRKLQKWCLTSVFDEYQRFAAAKARVSDQRFMELFDASIFKQQSLPFSCSKR

SEQ ID NO: 3150 - protein, 318 aa, Glycine max
  misc_feature (43)..(43): Xaa can be any naturally occurring amino acid
MAITLNNGFKMPIIGLGVWRMEGNEIRDLILNSRSVDKTYFDXIRFGCVVDCAADYKNEAEVGDALKEAFDSGLVKREDLFITTKLWNSDQGHVLEACKDSLKKLQLTYLDLYLVHFPVAVRHTGVGNTSSPLGDDGVLDIDTTISLETTWHAMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 3151 - protein, 608 aa, Thermotoga sp. RQ2
MLLDEIKRMSYDELKRLAEDIRKKITEVVLKNGGHLASNLGTIELTLALYRVFDPREDAIIWDTGHQAYTHKILTGRDELFHTIRTFGGLSGFVTRRESPLDWFGTGHAGTSIAAGLGFEKAFELLGEKRHVVVVIGDGALTSGMALEALNQLKNINSKMKIILNDNGMSISPNVGGLAYHLSKLRTSPIYLKGKKVLKKVLEKTEIGFEVEEEMKYLRDSLKGMIQGTNFFESLGLKYFGPFDGHNIELLEKVFKRIRDYDYSSVVHVVTKKGKGFTAAEKDPTKYHSASPSGKPKMLSYSDLLGHTLSGIAREDKKIVAITAAMADGTGLSIFQREHPDRFFDLGITEQTCVTFGAALGLHGMKPVVAIYSTFLQRAYDQIIHDVALQNAPVLFAIDRSGVVGEDGPTHHGLFDMNYLLSVPNMKIISPSSPEEFVSSLYTVLKHLDGPVAIRYPKESFYGEVEFFLENMKEIDLGWKILKRGREAAIIATGTILNEVLKIPLDVTVVNALTVKPLDTTVLKEIAREHDLIITVEEAMKIGGFGSFVAQRLQEMGWQGKIVNLGVEDIFVPHGSRKELLSMLGLDSEGLTKTVLTYIKARSREGKV

SEQ ID NO: 3152 - protein, 480 aa, Oryza sativa Japonica Group
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNERMARAFGILDGIIDRRLANRTHGDRHGDFLDALLDLVSEGKMARDHVTIMLFEVFGAGSDTMSVSLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 3153 - protein, 439 aa, Ashbya gossypii ATCC 10895
MDLLEGLDDPPSPQDAHVSAAEGAVGALQQRLHALLQCDPRSRPSALPLLPELHEALAAGQLDLGTLGQLLPVLRDEAADVYRQLEARYRPVFPELAELVPSQRTYVRVLRALETGAPLDELLTREQAMLVAMTRPQAPRADPARWPRELAPHADRHEQLHTAVDAIDAHIVRQAHRLAPTVTALVGPVVAAALLSHAGSVRELAQVPACNLAAIGAPRHAAHARRTDASGVRLRGHVWDTPLVQEQPPALQRQALRMLCARLALAARVDASAPDPALAARWRADILARIAARAVPPAPEAAAPVPVPRRRQAAPARRPPLPRPPQQVPPLCCAPAPEPRGLRRPGAHRCRRLRRGDRPRAERRARRPAAPLRPSAPGSRPGSPGPACPASTYSAPAYGSAAPPSRPARALLLLLAPATLLTMPHVEKAQYMEANIQQK

SEQ ID NO: 3154 - protein, 392 aa, Vibrio sp. Ex25
MTDQPISLEEIRLRLNELDDQLLSLLSERRKLSIEVAKSKVQTSKPVRDAVREQQLLVKLISNGRDKYELDAQYITKLFHTIIEDSVLLQQSYLQNLVNPQQSRKPLARVAFLGAKGSYSHLASREYFSRKNTELIELNCEHFKEVTQTVESGHADYGVLPIENTSSGSINEVYDLLQHTTLYIVGELTQPIEHCLVAKKDIRLENIKTLYSHPQPHQQCSEFLSRMKGVKLESCASTADAMQKVQEMDRDDVAAIGNASSGKLYGLQAIQGNIANQTENHTRFIVVARKPVEVSTQIPAKTTLIMSTSQEAGSLVETLLVLQRYGINMTKLESRPIMGNPWEEMFYVDLESHLASTEMQQALEELTKITKHLKVLGCYPSENVKPTQVKLS

SEQ ID NO: 3155 - protein, 417 aa, Chlamydomonas reinhardtii
MTALVLSKEEDVKFVEVPCPSIVHAGDAIIKVTACSVCGSDLHPYHGRERGIAPNTIVGHEFVGVVVAKGPEVKDLDLGDRVASPFTSCCGQCFYCERGATCRCDHTQAHLFGWVSEGEEQLPPEQRRGLQGSQAQYVRVPLASGTLLKLPDDVSDEAGLLLGDILSTAFFCAERGEVGDGATVAVLGCGPVGLLAVMAAKHLGASQIFAVDAVPERLAVAAELGAQPLLLGSTRPAHASGEADEEREAKRQKAEAGESAAAETPSMSSGGADEVVAAVKAATEGRGVDTVLEAVGSNSALRLGYDLVRPMGTISSVGVNTSAEFPFSPVDAYNRNITFRSGRCPARAYMTKLMGLVREPPAAAAAGAAPTAAAGKSALPWRRIFTHRMPLSQGPQAYDMFARRADGVIKIVLDPWA

SEQ ID NO: 3156 - protein, 315 aa, Pyrococcus furiosus DSM 3638
MVVSLAGRDLLCLQDYTAEEIWTILETAKMFKIWQKIGKPHRLLEGKTLAMIFQKPSTRTRVSFEVAMAHLGGHALYLNAQDLQLRRGETIADTARVLSRYVDAIMARVYDHKDVEDLAKYATVPVINGLSDFSHPCQALADYMTIWEKKGTIKGVKVVYVGDGNNVAHSLMIAGTKLGADVVVATPEGYEPDEKVIKWAEQNAAERSGSFELLHDPVKAVKDADVIYTDVWASMGQEAEAEERRKIFRPFQVNKDLVKHAKPDYMFMHCLPAHRGEEVTDDVIDSPNSVVWDQAENRLHAQKAVLALVMGGIKF

SEQ ID NO: 3157 - protein, 496 aa, Staphylococcus aureus subsp. aureus MW2
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 3158 - protein, 577 aa, Ashbya gossypii ATCC 10895
MFSGRGNNVRDVDALAQDIGQLSFEGEMENRRHIVIDPPHTPSRYLQRTPNGKSPAGRQGGYLTVENADYSGMDVDERPRDDIDLSRSPKKLPMDFHKRASSTKTKRLVSVCQMFFLDYYCDMFDYVISRRERTRQVMNYLEQQRAQGLHSAQEISEEWQNYLYRETDILRKRRLKPKNKDFEIITQVGQGGYGQVYLARKKDTKEICALKILNKNLLAKLNGTDHVLTERDILTTTRSEWLVKLLYAFQDPHSLYLAMEFVPGGDYRTLLINTRFLQAPHARFYISEMFCAVDALHKLGYTHRDLKPENFLIDSKGHIKLTDFGLASGTVSMERIESMRIRLEEVKNLEFPEFKETSMDYRRKMYHRVREKELNYASSTVGSPDYMALEVLEAKNYDFTVDYWSLGCILFESLVGYTPFSGSSSNETYENLRRWKQVLRRPRCENGRPAFSDRTWELITRLIADPINRLRSFEHVKKMKYFAEIDFANLRSMSPPFIPQLDSETDAGYFDDFTNEADMAKYADVFKRQDKLNAMVEESSNSSKLVGFTFRHRKGKTGSSGVLHNGSEHADPFATFY

SEQ ID NO: 3159 - protein, 206 aa, Picea sitchensis
MPAQTEEEQLAAQLEEQKLQSDEPIIEDVKDEDDEDDDDEDSDDEEGDAQGDQGADGSGKSKQSRSEKKSRKAMLKLGMKPIPGVTRVTIKKNKNILFVISNPDVFKSPASDTYIVFGEAKIEDLSSQLQTQAAEQFKAPDLSHVMLKPESSAAAQEEDEEVDDTGVEPKDIELVMTQAGVSRVKAVKALKAASGDIVTAIMDLTT

SEQ ID NO: 3160 - protein, 280 aa, Physcomitrella patens subsp. patens
MEKIGICEEPKFRSKDYIDPPAVPFVDASELRKWSFYRAIITEFISTLLFLYIAIGTVVGASRNADCAGVGILGIAWAFGGMIFVLVYCTAGISGGHINPAVTFGLLLARKISLTRSLAYMVAQCLGAICGAGLVKEFQHSFYMDHGGGANAVAPGYSTGTGLAAEIIGTFVLMFTVFSATDPKRKARDSHVPVLAPLPIGFAVFVVHCATIPITGTGINPARSFGAAVIFNRSKSWDDHWIFWVGPFLGAALAAAYHQYILRANPIKSMRSFGNGSNHT

SEQ ID NO: 3161 - protein, 387 aa, Gluconobacter oxydans 621H
MKTPNQYLASLPTTIFTIMSQLAVKHGAINLGQGFPDTEGPQDIIQVAADALRDGRNQYAPLTGLPELREAVAASNRRFYGLEVDPATEVVVTSGATEALAACLMAVVEPGDEVVVIEPLYDTYLPALKLLGAVPRCVRLAPPHWSVPEAELRAAFGPKTKAIMLNSPMNPSGKVFVREELELIADLVREHDVYAICDEVYEHLTFHVKHIPLMTLPGMRERCMRIGSAGKSFSLTGWKVGYVTAPAALASVVAKAHQVLVFATAPNLQRAVAYGLNKDDGYYEGLSAQMETQRDLLRDGLHRLGFETLPADGSYFIVADISRHAAGRGDVEFARWLVEHAGVATIPVSAFYDPQGDAPPQNLIRFAFCKKPEILREALKRLEKALS

SEQ ID NO: 3162 - protein, 247 aa, Candidatus Phytoplasma vitis
MLSIKSLDEIVIMKEAGKILSFIRKELLKFLKVGISTFDLDMIAFDLIKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVLKDYVLEPGMTFCIEPMFTLGTKEIKILKDGWTAVTSDSSLSAHFEHTVLVTDKGYEILT

SEQ ID NO: 3163 - protein, 525 aa, Salmonella enterica subsp. arizonae serovar 62:z4,z23:--
MTDNIHKHRILILDFGSQYTQLVARRVRELGVYCELWAWDVTEAQIREFNPSGIILSGGPESTTEENSPRAPQYVFEAGVPVFGVCYGMQTMAMQLGGHVEGSNEREFGYAQVEVLTDSALIRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYGFLGRVSNRIINEVNGISRVVYDISGKPPATIEWE

SEQ ID NO: 3164 - protein, 405 aa, Ralstonia metallidurans CH34
MTADSGKRRFARIDRLPPYVFNITAELKMAARRRGEDIIDMSMGNPDGATPPHIVAKLVDAAQRPDTHGYSASKGIPRLRRAISHWYRERYDVDIDPDKEAIVTIGSKEGLAHLMLATLDRGDTVLVPDPSYPIHIYGAVIAGADIRSVPLTPGIDFFAELERAIRGSYPKPKMIVLGFPSNPTAACVELDFFERVIALARKHDIFVVHDLAYADIVFDGWKAPSIMQVPGAKDIAVEFFTLSKSYNMAGWRIGFMVGNPDLVAALTRIKSYHDYGTFTPLQVAAIAALEGDQQCVKEIAAQYQSRRDVLARGLIESGWPVDIPKASMYIWARIPEPYRALGSLEFAKQLLAKAKVSVSPGIGFGDYGDEYVRFALIENESRIRQAVRGIKAMFRADGLVTAPGG

SEQ ID NO: 3165 - protein, 263 aa, Streptomyces coelicolor A3(2)
MTGVPASAAGGSSSARRTGPRGASGAAQEPAGRTTSGGAVERDAGERRGATEGGAGARGGKIAAAAVNQASVWNVANLLTMLRLLLVPAFVALMLGNGGYDPAWRSFAWAAFAIAMITDLFDGHLARTYNLVTDFGKIADPIADKAIMGAALICLSALGDLPWWVTAVILGRELGITVLRFVVIRYGVIPASRGGKLKTLIQGIAVGMYVLALTGPLATLRFWVMAAAVVLTVATGLDYVKQAIVLRRRGIAERRAALKETEV

SEQ ID NO: 3166 - protein, 526 aa, Citrullus lanatus var. lanatus
MASSMAAVGVLRLPTTSASSSSSSNGGSNRARRHSLRSLSFGASHISGDKIDFRASALGSRRVSGGRAVPSIVSPKAVSDSKNTQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKTMKVDTTILGLDDARGKEMPFIASMGIYVISKDVMLSLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGEDVKIVNGDNVQEAARETDGYFIKSGIVTVIKDALIPSGTVI

SEQ ID NO: 3167 - protein, 213 aa, Agrobacterium tumefaciens
MAQSYDVMKVAVVEREHLAGIAPTGAAFPPRRCCATADVLHTAQHAKDYGLTLEGSIKPDVKAIVDRSRGIAHRMNNGVGFLFKKNKVRGIAHRMNNGVGFLFKKNKVDIIWGEAKITKPGEIVVSKTQKKPVEPMGPVPKNTLGEGTYTAKHIIVATGARPRSLPGIEPDGKLIWTYFEAMKPEELPKSLLVMGSGAIGIEFASFYRTMGVD

SEQ ID NO: 3168 - protein, 526 aa, Citrullus lanatus var. lanatus
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 3169 - protein, 506 aa, Mycobacterium sp. MCS
MTNQIQHFINGKRTAGESTRTADVMNPSTGAVQAQVLLGSRADVDAAVAGAAEAQKEWAAWNPQRRARVMMRFIELVNQHMDELAELLSIEHGKTVPDAKGDIQRGIEVIEFAIGIPHLIKGEYTEGAGTGIDVYSMRQPLGVVAGITPFNFPAMIPLWKAGPALACGNAFILKPSERDPSVPVRLAELFIEAGLPAGVFQVVHGDKEAVDAILEHPVIQAVGFVGSSDIAQYIYAGATANGKRAQCFGGAKNHMIVMPDADLDQAVDALIGAGYGSAGERCMAISVAVPVGKETADRLRNRLVERVNNLRVGHSLDPKADYGPLVTEAALNRVRDYINQGVEAGAEAVVDGRERSSDEMQFGDDSLEGGYFIGPTLFDHVTPDMSIYTDEIFGPVLCIVRADNYEEALRLPTEHEYGNGVAIFTRDGDTARDFVAKVQVGMVGVNVPIPVPVSYHTFGGWKRSGFGDLNQHGPHSILFYTKTKTVTQRWPSGIKDGAEFVIPTMK

SEQ ID NO: 3170 - protein, 252 aa, Triticum aestivum
NHRGFRILSSQRENPTGASASSLGAPGPGSSRGAGAGTRDGGGGEGGSGGRWMAEAALEGSEPVDLTKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYTAFENIYPVLTEFRKVQQ

SEQ ID NO: 3171 - protein, 448 aa, Arabidopsis thaliana
  misc_feature (419)..(419): Xaa can be any naturally occurring amino acid
MAFAKAPRLSRDDILGNRVSTRSFKIFSDNQKTDPASTIGTSQKKTRIPLRRKKIRESQERAKAVLKTGRNTLKANNISVKKSTKENVSKRTTELGNNNLYKTASKASNQAVPQLSSAGTYTWKTRTSVGSIQSDGNKQSKNNVRFIQTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKXRCTLHMTPVWTSLLNNHTHYNVSQMKDCS

SEQ ID NO: 3172 - protein, 519 aa, Haloarcula marismortui ATCC 43049
MDAGLIILDGWGLNPDDDVRDAVAAADTPNFDRYRDAGAASTLTTHGRRVGLPEGQMGNSEVGHLNIGAGRVVKQDSARVSDSIARSRGEAPPDDDAQDPPFFENETILSAFEHAEAHGGRVHFMGLVSDGGVHSYQDHLHALIELAGERGTDAVSHAFTDGRDTSPTGGEDYLADLEAHVEEHGTGHVATVCGRYYAMDRDQNWERTRRAYDAIVHREGDHHADEAVTAATESYARDTTDEFIEPTTVGDHAGLEAGDAVVFFNFRSDRARQLTRMLGDIRPEDWGSDTEPPDTRLVTMTQYDETFDLPVAFPPNQPADVLGEVLSEAGKTQIRLAETEKYPHVTYFLNGGREVAFDGESREIVDSPDVATYDLQPEMSAPELADTAIEFIETEDPSAMVLNFANPDMVGHTGDFDAAVTAVEAVDEQLGRLVETIGAAGGHALICADHGNADDMGTEDDPHTAHTTNPVPFIYLSPDGTAGGRTARDGGTLADLAPTMLTLMGIDRPDAMTGTPLVE

SEQ ID NO: 3173 - protein, 220 aa, Capsicum annuum
MGDVKLLGLWYSPFVHRVEWALKIKGVEYEFIEENLQNKSPLLLESNPIHKKIPVFFHNGKPICESMVIVEYIDEAFEGPSILPKDPYDRAIARFWAKFLDDKLQAIGKTFFFKGEEQEKAKGEAYETLKVLDNEVKDKKFFVADKFGFADIAANFVGLWLGVFEEATGIVLVTREKFPNFCAWRDEYINCTQNKEYLPPRDELLAHFQARFQAAAAASK

SEQ ID NO: 3174 - protein, 138 aa, Triticum aestivum
HYRTSLYKKAGWYRSGIPGISSTHASELIPHEIATIEKRGKKDKDKKPSIAVIQGPKPGKPTDLSRMRQVLVKLKHAPPPHMMQPPPAPAAKEGAKEGAKDGAPAPANGAKQPAESKEAPANGPAAETEKEQPAAASE

SEQ ID NO: 3175 - protein, 323 aa, Brassica napus
MDVVKIDYNYKGDNALKELERITSKAAEVQDNILCGILEQNKDTQYLSKYMKGSKDVLEFKRSVPIITYKDVCPYIQRIANGEDSSLITGHPITEILCSSGTSGGEPKLMPTISEDLDRRTFVYNLINPIANKYLEGLDKGKTMYLNFVKAETSTPCGLPIRTVLTSYYKSKHFQCRPYDPFNDLTSPIQTILCEDSNQSMYCQLLAALIHRHKVMRLGAVFASAFLRAISYLERKWSQLCQDIRTGHLSPMITDPGCQTAMTSLLASPNPDLADEVEEICGRPSWKGILCQLWPQAKFIEAVVTGSMAQYIPALEFFRPRQD

SEQ ID NO: 3176 - protein, 764 aa, Oryza sativa Japonica Group
MWRHGERCVILAVAAVALVAAATATAAAAVGGERRTYIVHMSRSAKPNDFVEHGEWYAASLQSVSDAATVLYTYDTIVHGYSARLTRAEAEALESQPGVLLVNPEVRYELHTTRTPEFLGLDRTDALFPQSNTGSDVIVGVLDTGVWPERPSYDDAGLGPVPAGWKGKCEEGNDFNASACNKKLIGARFFLTGYEAAKGPVDTSKESRSPRDNDGHGTHTSSTAAGSAVRGADLLGYAAGTAKGMAPHARVATYKVCWVGGCFSSDILKAMEVAVNDGVDVLSLSLGGGTADYYRDSIAVGAYSAMERGIFVSCSAGNAGPGSATLSNGAPWITTVGAGTLDRDFPAHVVLGNGKNYSGVSLYSGKQLPTTPVPFIYAGNASNSSMGALCMSGSLIPEKVAGKIVLCDRGTNARVQKGFVVKDAGGAGMVLANTAANGEELVADAHVLPGAGVGQKAGDTMRAYALSDPNPTASIVFAGTQVGIQPSPVVAAFSSRGPNTVTPGILKPDLIAPGVNILAAWSGSVGPSGLAGDSRRVGFNIISGTSMSCPHVSGLAALLRAAHQDWSPAAIRSALMTTSYNGYPNGNGILDVATGLPATPLDVGAGHVDPSKAVDPGLVYDIAAADYVDFLCAISYGPMQIAALTKHTTDACSGNRTYAVTALNYPSFSVTFPATGGTEKHTRTVTNVGQPGTYKVTASAAAGSTPVTVSVEPSTLTFTKSGEKQSYTVSFAAAAMPSGTNGFGRLVWSSDHHVVSSPIAVTWT

SEQ ID NO: 3177 - protein, 275 aa, Arabidopsis thaliana
  misc_feature (39)..(39): Xaa can be any naturally occurring amino acid
  misc_feature (245)..(245): Xaa can be any naturally occurring amino acid
RCAFITPGLGDYISGSILFEETLYQSTKDGKTFVDCLRXCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHASFSYARALQNSVLRTWQGKPEKIEASQKALLVGGXANSLAQLGKYSAEGENVDAKKGMFVKGYTY

SEQ ID NO: 3178 - protein, 330 aa, Nostoc sp. PCC 7120
MLSSATFKLQPTATGLTENHRLRLFSGSSNVQLSQEVARYLGMDLGPMIRKRFADGELYVQIQESIRGCDVYLIQPCCQPVNDHLMELLIMVDACRRASARQVTAVIPYYGYARADRKTAGRESITAKLVANLITQAGANRVLAMDLHAAQIQGYFDIPFDHVYGSPVLLDYLTSKQLHDIVVVSPDVGGVARARAFAKKLNDAPLAIIDKRRQAHNVAEVLNVIGDVKGKTAVLVDDMIDTGGTIAAGAKLLREEGARQVYACATHAVFSPPAVERLSSGLFEEVIVTNTIPIPESDRFPQLVVLSVANLLGETIWRIHEDTSISSMFR

SEQ ID NO: 3179 - protein, 267 aa, Anabaena variabilis ATCC 29413
MEDFVTPPAFGEKVRERWTLAGRKALITGATKGIGLAIAQEFLALGAEVIIVARNAEAIEQQINAWDSAGKVHGVTADVSTSEGRQIIHEYVSKTVGELDILVNNVGTNIRKKATDYTEEEFAGIFQINLTSIFELSRLFYPLLKTSKNSSIVNIASVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 3180 - protein, 470 aa, Bacillus clausii KSM-K16
MSTGRIIQITGPVVDVKFPSGQLPEINNALTVNQQGAADGAVDVKVTLEVALHLGNDTVRTVAMGSTDGLMRGTEVLDTGGPISVPVGEATLGRVFNVLGEEIDLQEPVAEGTRRDPIHREAPSFEELTTTTEILETGIKVVDLLAPYTKGGKIGLFGGAGVGKTVLIQELINNVALEHGGISVFAGVGERTREGNDLYHEMKDAGVITKTAMVFGQMNEPPGARMRVALTGLTMAEYFRDEQGADVLLFIDNIFRFTQAGSEVSALLGRMPSAVGYQPTLATEMGQLQERITSTKKGSVTSIQAIYVPADDYTDPAPATTFAHLDATTNLERKLTEQGIYPAVDPLASTSRALSPEIVGEEHYNVARGVQQTLQKYRELQDIIAILGMEELSEEDKLIVARARRIQFFLSQNFHVAEQFTGQPGSYVPVKETIQGFKDILAGKYDDLPEDAFRLVGRIEEVVEKAKQMA

SEQ ID NO: 3181 - protein, 382 aa, Picea sitchensis
MASSTAGQVIKCKAAVAWEAGEPLKIEEVEVAPPQAMEVRIKVHYTALCRTDLYFWEAKGQTPLFPRILGHEAAGVIESVGEGVTDLKEGDSVLPVFTGECGECRHCKSEESNMCDLLRINTDRGVMINDGKSRFSINGKPIYHFLGTSTFSEFTVAHVGCVAKINPEAPLDKVCILSCGVSTGMGATLNVAKPKKGSTVAIFGLGGVGLAAAEGARIAGASRIIGIDLNSDRVEKAKLFGVTEFINPKDHEKPIQEVIAERTDGGVDSSIECTGNVKAMIQAFESCHDGWGVAVLVGVPHSDAVFATSPLNFLSERTLKGTFFGNYKPRSDLPGLVELYLDKKLELEKFITHEVSFENINKAFDYMIKGESLRCVINVIGN

SEQ ID NO: 3182 - protein, 673 aa, Oryza sativa Japonica Group
MQKACSVQLLRPSRSRRRESWPQSGGSVVTGRPCYLRGSRGLSRLNGMVLCFQPPQSASVVHLEGEDKYSCIDHSTSYLHVQSVRDFPIEKLNAEVVLVRLDSELICNPLGSCSLSLERTVSTIKYLQKAGAKVLLVTSWTPVLQSVYPVLKSTETFADYMSSLLQVKVVPVNGVPGLTSFKPEGWMQNDIILFENLLNFKGENANCNDFSQKLASGAAIFVNDSFSLSHKMLASTVGITRFCHASLAGFHFEEELMQLRKITDTTRRPFIAIIGGSNFLGKAPALNLLASLCDGLFFVGKLSLQIMNGFGIPVPSCFVEKNSTKEVLQLIQTAHNRNIPIYYPTDTWCLNNKNNNHEKLEILDSAELLPGWTPADIGPSTLEKISSLMPLYKKVLWIGPTCFDLTEEFSGGAAQLGRILDKASHDSCDVILVGSAACKAVKGISGSSSKYTTFKNASVVLEFLKGKILPGVAALDKSYPYQIPWNAIFSDSSQPLVVDIGSGNGLFLFQMARDWEGSNFLGLEMNKKLVVRCLRDVASVDKRNLYFVSTNATSTFRSIVSSYPGQLALVTIQCPNPDFNREQNRWRMVRRMLVEAIADLLQPNGKVYLQSDVESVLLRMKEQFMTHGKGQLVVDDDGGGDHQMDNPFGAASDWERHVLARGAPMYRTMLRKV

SEQ ID NO: 3183 - protein, 182 aa, Picea sitchensis
MAACKDGDLRVRGISSAIRVVPNFPKPGIMFQDITTLLLDPKAFRDAIDIFVDRYKDKEISVVAGIEARGFLFGPPIALAIGAKFVPMRKPRKLPGEVIAEEYVLEYGKDRLEMHVGAVQPGERALIVDDLIATGGTLCAAIKLLERAGAEVVECACVIELPELKGRGKLDGKALYILVESR

SEQ ID NO: 3184 - protein, 481 aa, Citrullus lanatus var. lanatus
NSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 3185 - protein, 382 aa, Triticum aestivum
  misc_feature (280)..(280): Xaa can be any naturally occurring amino acid
MVKAMAGCPAKMGFRMPAEWEPHEQCWMGWPERPDNWREHAEPARKTFERTAMAISKFEPVTICASAKQYPRVHELMEHQPNIRVVEMSMNDSWFRDTGPTFITREGGSDIGLAEQTIAGIDWEFNAWGGLILGGGCFDDWSLDRSIAKKIVEIERIPRFAHTMVLEGGSIHVDGEGTCITTEECLLNPNRNPHMTKLEIENELKDFLGVTKIIWIPLGLHGDEDTNGHVDNLCCFIKPGVILLSWTDDENDPQYEISVKALSALTQAVDAKGRQIEVVXKIHVPGPLYITKEEGEGVLATGHAVPRVPGKRLAASYVNFYPANGGVIAPAFGDKKRDEEAREVLQKVFPDHEVVMVEGAREIVLGGGNIHCITQQQPVRPS

SEQ ID NO: 3186 - protein, 91 aa, Oryza sativa
MAANFWTSSHWRVYTRKSMTEYDPRLVAPTCLYLASKVEESTVQARLLVFYIKKMCASDEKYRFEIKDILEMEMKLLEALDYYLVVYHPYR

SEQ ID NO: 3187 - protein, 411 aa, Legionella pneumophila str. Lens
MDNEVIKQRALDYHEFPVPGKLSVHLTKSTNSQDDLSLAYTPGVAAPVLAIAEAPENAYRFTSKGNLVAVMTNGTAVLGLGNLGPLASKPVMEGKAVLFKRFADLDVFDIEIDAEDPQSFIATAKRIAPTFGGINLEDIKAPECFEIEQALIEQLNIPVFHDDQHGTAIVVAAGLLNALELQNKKLSDIKIVCMGAGAAGIASMRLLVALGAPKSNMLLLDTKGVIHSGREDLNPYKFAFARNTSSRTLEDALVDADVFIGVARPDLLNAHLLSLMAPNPVIFALSNPDPEIKPELAHSVRKDLVMATGRSDYPNQVNNVLCFPYIFRGALDVRATCINQAMQIAAVEAIRQLVHEPVPQVVKDNYPGVVNWDFGPDYIIPKPIDPRLKERVPAAVAKAAIASGASQFNNL

SEQ ID NO: 3188 - protein, 195 aa, Mycobacterium avium subsp. paratuberculosis
MPLLTIGDQFPAYELDRVIAGDLSKVDAKQPGDYFTTVTSEDHAGKWRVVFFWPKDFTFVCPTEIATFGKLNDEFEDRDAQVLGVSIDSEFVHFNWRAQHEDLKNLPFPMLSDIKRELSLATGVLNADGVADRATFIVDPNNEIQFVSVTAGSVGRNVEEVLRVLDALQSDELCACNWRKGDPTLNATELLKASA

SEQ ID NO: 3189 - protein, 115 aa, Zea mays
FTSFGTKLSPAKMSTVTRSYLDQRLAAAQRCSKEAAMAGAKAAAVATVAAAVPTLASVRMLPWARAHLNPTGQALIISTVAGMAYFIVADKTILSMARKHSYETAPEHLKNTSFH

SEQ ID NO: 3190 - protein, 420 aa, Haloarcula marismortui ATCC 43049
MGYDYDKVEVPDEGQQIQVTEDDELDVPENPIIPIIHGDGIGTDVGPAAQKVLEAAANATGRDISWMRIYAGQSARDKYDENLPDDTVEAIKEFNVAIKGPLTTPVGAGFRSLNVALRKTLDLYANVRPTYHIEGVPSPVKDPEEMDMVTFRENTEDVYAGIEWEAGTDEVEEVKEFVEDEMNFDETIHDGPVGIGVKPITEFGTKRLVREAIDYALEEDRDSVTLVHKGNIMKFTEGAFRDWGYEVAEEEYGEHVITEDELWDEYDGEAPEDSLVVNDRIADNMLQQLLTRTDEYDVIATMNLNGDYMSDAAGAQIGGLGIAPGANFGSARCLAEPVHGSAPKYAGEDKVNPTAMILSGRLMLEYMGWKDAGQLVRDAVEETISSGNVTYDLERQIEGGTKLATSEFAEKVVENIEKLA

SEQ ID NO: 3191 - protein, 219 aa, Neorickettsia sennetsu str. Miyayama
MMRASVTTITAFVLFFCGVCCSHASVVFLQSQEGVLSYPEHVSFNKIQQMKEKNANPVVGLEIGAGAEMLGEIEIELAADVVPRTAENFLQLCTGKNGFGYKGSIFHRIIPSFMIQGGDFTQGNGTGGHSIYNNDVFPDENFVIKHTGPGKVSMANRGPNTNGSQFFITTVETPWLDGKHVVFGQVIRGMSVVKKIESYGSSNGRPSRIIKILDCWQVS

SEQ ID NO: 3192 - protein, 513 aa, Physcomitrella patens subsp. patens
MEPYMPGQHTSNCGKIKVGYSVEEGQETMHLDSRLPVLQHADLRDKVVLLRVDHNVLKKGIILDQYRIDVTLSTMYNIIERGGRLIIMTHIGRPCNKKRKTLTVKKEESVDPVVAYLQRKLRIKFAVPQFPVTEKEGIHDIDTSINWLIHDLRNRKIGGIYLPNTRWFSGEEDKGANMERFVVQLAGLADVFVNDAFGSWQPHASTYYITKYLPSYAGLCMQVGSSLWLNANYDPPALATFDHHIQIVELVLIQYSPYYCNLQAELTHVREILEPKHPFVSIVAGSKYDTKIRPLTEFYKKVDVLILGGVVYNTFLCAKYNVRMKGIEESDIELANVLVEQDKVENKILELPSLVETDTLSGRYEGQYRTINTKDFSGGQQYGYVVDVDPASFETPEVRKVLESAMTIFVNAVMGMMPAFWHGTSKMDEAIDRNTTAQKFFGGGDTLQEFKSLWPGLYQAALDSPKYYLFTGGGTVLKVLEEGDPFALPTVRALIENGEQLRLQNERSSQMRM

SEQ ID NO: 3193 - protein, 179 aa, Acinetobacter sp. ADP1
MKKNIRPYLEHQPKIDSTCYIDDMSVVIGDVQLAEHASVWPFAVIRGDVNQIRIGRNSNVQDHCMLHVSHKNDAKPDGSPLTIGEDVTIGHHVTLHGCTIGNRVLVGINTVILDDAIIEDDVMIGAGSLVPPRKRLESGYLYVGSPVQQVRALTEKEMSFLPYSARHYVKVKNHYLAEK

SEQ ID NO: 3194 - protein, 298 aa, Haloarcula marismortui ATCC 43049
MTDVDFDSEQYEKCREAGEILAQVRDEAAERVEVGVSHLEVAQWAEDKIRELGGKPAFPVNISIDEEAAHATPERDDDATFGEEMVNLDIGVHVDGWLADTAVTVDLSGQDELAKAPEEALDAALDVAGPGVDVGQIGAAVEEVIEGYGYNPVVNLTGHGLGHWEQHTSPNIPNREVAQGATLDVGDVVAIEPFATDGRGKVQEGADEEIFALEREGSVRNRQARQVLEQITDEYRTLPFAARWLDSPRAEMALRRLKQQDIVHGYPVLKEQDGAYVSQKEHTVIITEDGCEVTTRSR

SEQ ID NO: 3195 - protein, 286 aa, Nostoc sp. PCC 7120
MTNHALFVGLVTLDLIYLAESAPQNNQKLVATDYTVAAGGPATNAAVTFSYLGNQATVLGVVGSHPMTQLIRSDLTKYQVAIADIDPTINTPPPVSSIIVTQATGERAVISINAVKTQASEDSIPPDILHNIDIVLIDGHQMTVGYVITQKARANNIPVVIDGGSWKPGFERILPLVDYAICSANFYPPNCSSSEEAFAYLHNLGIPHIAITHGEQPIEYLSCGEHGTVVVPKITAVDTLGAGDIFHGAFCHYILQASFTKALEGAAKIAADACKLFGTRRWMDVK

SEQ ID NO: 3196 - protein, 315 aa, Escherichia coli CFT073
MRADVTLEVLHKAATKLRFSLISELIRSNILFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 3197 - protein, 592 aa, Xanthomonas oryzae pv. oryzae KACC10331
MLNLRIGWRRGSGAFRHSFRCPVPGGEREPARLTWMPVSEDLGTVRCEVARVEMAGVSRYRQAELHTVRIVSVGSAVRLERWLRSWGGAGLRRGPCPGRCRDVSITAWHKARPLARMGAISYPDQFAHSSGAVPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAVLCVLLLLSLNLVKVKLFGEMEFWFALIKIIAIAALIMTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPNGFAKLSRASVPARGLLFSCLCLLLGAMLVYLIPNLVTAFTLVTTLSAVLFMFVWSLILCAYIAYRRKCPEQHAVSAFKMPGGVLMCYVCLSFFAFVIVLLMLQDDTRQALLASPVWFLLLAIGYAVKRRQNRQR

SEQ ID NO: 3198 - protein, 336 aa, Staphylococcus aureus subsp. aureus MW2
MTEIQKPYDLKGRSLLKESDFTKAEFEGLIDFAITLKEYKKNGIKHHYLSGKNIALLFEKNSTRTRAAFTVASIDLGAHPEFLGKNDIQLGKKESVEDTAKVLGRMFDGIEFRGFSQQAVEDLAKFSGVPVWNGLTDDWHPTQMLADFMTIKENFGYLEGINLTYVGDGRNNIAHSLMVAGAMLGVNVRICTPKSLNPKEAYVDIAKEKASQYGGSVMITDNIAEAVENTDAIYTDVWVSMGEESEFEQRINLLKDYQVNQQMFDLTGKDSTIFLHCLPAFHDTNTLYGQEIYEKYGLAEMEVTDQIFRSEHSKVFDQAENRMHTIKAVMAATLGS

SEQ ID NO: 3199 - protein, 598 aa, Ralstonia metallidurans CH34
MAAIEVKVPQLSESVSEATLMQWKKQAGEAVKRDEILVELETDKVTLEVPSPADGVLAKIVQPDGATVHTDDVIAVVDTEGKAVAAASPVAAAAPASAPAPAPAPAPVAAVASGGAGAPASAKADFDVIVIGSGPGGYIAAIRAAQLGKTVACIEEWKDDAGKPRLGGTCLNVGCIPSKALLASSEYFEQAKHGLAEHGVQVKGVTLDLAQMIQRKAAIVDKFTGGVEFLFRKNKVTWIKGHGKFKGRAADGVITVEASNGGETTSHTARNVIIATGSKARHLSGVPVDNKIVSDNEGALSFDSVPKKLAVIGAGVIGLELGSVWRRLGSEVTLLEALPTFLGALDEAVAREAAKQFGKQGLTIHLGVDIGNIEATAKGVSIAYKDKDGAEQKLVADRLIVSIGRVPNTDNLGLDAVGLAADARGFIPVDDQCRTPVAGIYAIGDVVRGPMLAHKAEDEGVMAAEVIDGQKPHIDYNCIPWVIYTEPEIAWVGKSEAQLKAEGREFRSGQFPMMANGRALGIGHPDGFIKMIADAKTDEILGVHIISANASDLIAEAVVAMEFKAASEDIGMICHPHPSLSEVMREAALAVRKRALNM

SEQ ID NO: 3200 - protein, 404 aa, Acinetobacter sp. ADP1
MNHITLAPVQSDQPTHLMATYGRQAISFVRGRGSYLYTEDGTEYLDALTGIAVCGLGHAHSVIAEAIAEQAATLVHTSNIFEIPWQTAAAQKLAEVSGMQEIFFSNSGAESNEGAIKIARKYGSQQGIQHPKIIVAEKSFHGRTLATLSATGNAKVQEGFFPLVEGFIRVPFGDIEAIQEAALHHPDIVAILVEPIQGEGGINTAPQGFSYLEEIRALCNQHNWLMMLDEIQTGNGRTGKFFAYQHTNITPDVLTTAKGLGNGFPVGAVMTQGKAVGLLGPGSHGSTYGGTVLGSRVVYTVIDTIQKENVVENADKMGRYIVEQLRQAFNELDIQVRGFGMMIGIELPKPCAELVNITRDEYKLIVNVTAGNVVRLLPPLNMSKDQADDLINRLVPAIQNFLAA

SEQ ID NO: 3201 - protein, 759 aa, Bacillus clausii KSM-K16
MKRVQACILLVILGFSGLIPHVAAAETYPVTPRATETVSDEQQSGRRVVIVSAKGNVDNAVEQVKDAVPSAKIRHVFKVVYGGFSLDLLEEDIDVLKKLDGIARVDDIAIYQPSLESSIPFVGAGKSDKRHLGPGGEALTGKGVKVGVIDTGVDYEHPDLRANVKGGYDVIDEDEDPMETKADQGEPTFHGTHVAGVIAANGRIKGVAPEAEIYAYRALGPGGQGTTEQVLEAIEKAVADGVDVLNLSLGNTVNGPDWPTSLALDRAVDKGVVAVTSSGNSGPNMWTVGSPGTSAKAISVGASLPPVEIPYMTLTNEKERRLELTPLVGAKPWKLKRDIPVVEAGHGLVSDYKDVDAKGKLVLVKRGRSTFAEKMETARKAGATGILIYNNLKGSFAGGVMQSVDLIGASLSKEDGEWLLEQLDHSKKELSVRTGYEQKQDLLASFSSRGPVTETWEVKPDLVAPGVAIQSTVPKGYLGLNGTSMASPHVAGAAALLIQQHPDWNPEQVKAALMNTTKCLVDEQGREYMPHEQGAGRLQVDKALETKTLVYPSSLTFGTWEKKAPRTKRELTVTIENMESKARVYHIVPPLGELDGIEWETPFSVTVGPNEKKQVTLAADIDPALLQEGLHAGTVEITGGSDTIRLPYVLFMEEPNYPRVMAFQFVHGDAKNSYYYEYYLPGGAEESGIALFDPDTFEFVDVLVSHEHSERGMVSGELSDLNVAPGRYRALVFAKSEGVKDTIEAFIDVGEPPLFPKEG

SEQ ID NO: 3202 - protein, 155 aa, Triticum aestivum
IPNGGRVVVLNTANLPLVKEVGLGADLVRIDAHSMCSPGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEIFFAPN

SEQ ID NO: 3203 - protein, 554 aa, Zea mays
MPSIAPPSSSVAALTRQPVQFFKGCSVSKETKGPVRSFFTANSKSTKVKSAGLKVASSFKNDGGYPAGGVSWKDDTLLPKSTTIRGQDHPVADPVLPMDSMITPEILSANVERVIDMFADDDTDTELDLDSPTEGFASIAEAIEDIQQGKLVIVVDDESRENEGDLIMAASLVTPEAMAFIVRHGTGIVCVSMKEDDLERLSLPLMVTTKENEEKLCTAFTVTVDAKEGTTTGVSAKDRAKTVMTLASPDSKPEDLNRPGHIFPLKYREGGVLKRAGHTEASVDLAMLAGLPPVAVLCEIVDDADGSMARLPKLRVFAEKENLKIISIADLIRYRRKRDRLIERASVARLPLKWGNVHAYCYKSVIDGIEHIAMVKGDIGDGQDILVRVHSECLTGDIFGSARCDCGDQLAMAMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLITPITSENRRYLETKRTKMGHVYGLANAQANLANGSQSTEENH

SEQ ID NO: 3204 - protein, 375 aa, uncultured haloarchaeon
MMQAPLWIERHAPALTELPQASARDRLTQITDEPMNLIIQGPPGVGKTAAVRAFTQEVHTDPDADLIEINVADFFNRSKKQIREDPRFERFLQGQTAFSKQYRRGNKGNKYKRDWSKRDMISHVMQELASYQPASGTYKTVLLDNAETIREDFQQALRRVMERYHKNTQFIIATRQPTTLIPPIRSRCFPVPIRAPTADEIESVVTDIAAVEGVETDEMAVTLIASKADGDLRYAILAAQHAAIEGDGAITTDAAQEAIADVGYEDTFQEILDTAAAQDISDARDQITTLLDDEGFNGQELLRELLSVANTYPETYGTANVIRLHRLAGAVDRDLAEGGEDRLHLTHLLTAWANGQSTLDETAEISEAQTSGNRV

SEQ ID NO: 3205 - protein, 153 aa, Triticum aestivum
  misc_feature (30)..(30): Xaa can be any naturally occurring amino acid
  misc_feature (119)..(119): Xaa can be any naturally occurring amino acid
ETATTSKEGSRRANYPILKPNMVTPGSDAXKKVAPEVIAEYTVRTLQRTVPAAVPAIVFLSGGQSEEEATLNLNAMNKLQTKKPWNLSFSFGRALQQSTLKAWSGKTENEEKARTAFLXRCKANPRPPLGTYKGDATLGEGASESLHVKDYKY

SEQ ID NO: 3206 - protein, 338 aa, Photorhabdus luminescens subsp. laumondii TTO1
MNPFHQRHFLRLLDFSSAEIHALLKLAAELKSTKKSGTEKALLTGKNIVLIFEKDSTRTRCSFEVAAYDQGANITYLGPSGNQIGHKESIKDTARILGRMYDGIQYRGYAQTIVESLAKYAGVPVWNGLTDEFHPTQLLADLLTIQEHQPEKPLSEIKFAYLGDARNNMGNTMLEAAALTGMDVRLIAPEKYWPNAALVTECQKLAEKTGGKITLTENITEGVKNTDFLYTDVWVSMGEPKDVWQQRVHLLKPYQVNMDVVSMTGNPQVKFLHCLPAFHDEETALGKQLAAEFNMYGGLEVTNEVFESEHSIVFDQGENRLHTIKAVMVATLANDLKI

SEQ ID NO: 3207 - protein, 304 aa, Arabidopsis thaliana
MVFGYAYPAYECYKAVEKNKPEMQQLRFWCQYWILVAALTIFERVGDALASWVPLYCEAKLAFFIYLWFPKTRGTTYVYDSFFQPYVAKHENEIDRSLIELRTKAGDLAVIYCRKAVSYGQTRIVEILHFVALQSTPKPKPKEKKQAAAPEEEEQKQPDLKATSQAASSNPQVRLQSKKPQLVTKEPISPKPLSSPRKQQQLQTETKEAKASVSQTKLTTLTPPGPPPPPPPPPPSPTTAAKRNADPAQPSPTEAEEASQTVAALPEPASEIQRASSSKETIMEETLRITRGSLRKARSAGAPR

SEQ ID NO: 3208 - protein, 485 aa, Hydrolea sp. Chase 3245
GSGVSTLEKKNPGRVVQIIGPVLDVAFPPGKMPNIYNALVVQGRDSLGQPINVTCEVQQLLGNNRVRTVAMSATDGLTRGMEVIDTGAAISVPVGGSTLGRIFNVLGEPVDDLGPVDASTTSPIHRSAPAFIQLETKLSIFETGIKVVDLLAPYRRGGKIGLFGGAGVGKTVLIMELINNIAKAHGGVSVFGGVGERTREGNDLYKEMKESKVINEENIEESKVALVYGQMNEPPGARMRVGLTALTMAEYFRDVNNQDVLLFIDNILRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYQTAQKVKQTLQRYKELQDIIAILGLDELSEEDRLTVARARKIERFLSQPFFVAEVFTNSPGKYVGLAETIRGFQSILSGEFDGLPEQAFYLVGNIDEAKEKAIKLEKE

SEQ ID NO: 3209 - protein, 171 aa, Mycoplasma hyopneumoniae 232
MQINLEKYIRTVEDFPKKGISFKDISPLLADGKALNYTIVEMASLAKDVDIIVGPDARGFLFGTPTAAFLSKPFIMIRKAGKLPGEVEEFAYELEYGSAILEVQVDMIKPGQKVAIIDDVLATGGTVKAITKMIERAGAIVDKIIFLIELEQLQGRKKLENYDVISLIKIS

SEQ ID NO: 3210 - protein, 242 aa, Mycoplasma hyopneumoniae 232
MKKIIIGNWKMNKTVSETRDFIQKFDIFYQENVGKIKEDLDFAIAPSFISLSLISKSLTKKLEIAAQNLSQFDSGAFTGEISGKMLQDLGTKYVIIGHSERREIFKEKDEELKNKILQAQKYDLIPVFCVGESLLEFEAGLTKKVIISQINAIKSVLNFQKAIIAYEPIWAIGTGKTATAAIAEKVCGLIKENFGKNTMVIYGGSVNSKNINELVSQKSIDGALVGGASLDPEEFGKILVNS

SEQ ID NO: 3211 - protein, 138 aa, Dipterocarpus palembanicus
EKNIPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEMVSNHDELMSNFFAQPDALAFGKTPEELHK

SEQ ID NO: 3212 - protein, 138 aa, Dipterocarpus palembanicus
EKNIPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGKTPEELHK

SEQ ID NO: 3213 - protein, 138 aa, Shorea roxburghii
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVGNHDELMSNFFAQPDALAFGKTPEELHR

SEQ ID NO: 3214 - protein, 217 aa, Legionella pneumophila str. Lens
MTFQILPSLLSADMTRLGEEVDAVMKAGSDFIHFDVMDNHYVPNLTFGPAFCDALIKKFPNLPIDVHLMTTPVDTLIEAFAKAGAKRISIHPDATIHLDRSLQLINNLGCEAGLVLNPATSIDTLTWCAHNLKFVLVMTVNPGFGGQKLIPEVIPKLSKIRQQHPNLDLCVDGGVTPQNIASLAHAGANQFVAGSAIFNSSNYSETIKHMREQLASI

SEQ ID NO: 3215 - protein, 138 aa, Shorea roxburghii
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGKTPEELHR

SEQ ID NO: 3216 - protein, 176 aa, Zea mays
  misc_feature (167)..(167): Xaa can be any naturally occurring amino acid
MVAAGRNRAERWNLAGATALVTGGSKGIGHAIVEELAGFGARVHTCSRNAAELEECRRRWDEKGLQVTVSACDVSARADRERLVATVGATFGGRLDILVNNAGQSLFKRTAECTGEDYSRIMATNLESCFHLSQFVHPFLRLVSGRGGGSVVHVFSDAGFVGLPALXVYFMSQGAL

SEQ ID NO: 3217 - protein, 505 aa, Physcomitrella patens subsp. patens
MGKKSKTAEVAAPVVAKVEKKSGKRALEEAIAAPVSKKSKPEKKVVPPPKKVESSSEESDSDEEEAPKPAVKAAPKAVAKAAPAKKAPVESSSEEESSDEEDVKPVVKAAAKAVKAPAKKEESSSEEDDSSDEEMVPVQVAPVKNGKVAAKAPVEESSDEEDSDDDSDEEVKPAAKSVTPAKKPAKKEESSSEEESDEDSEMEDVKPQKVVAKPPAKKVESSSEESDEDEDSEDEKPAAKEESSEEEESEEEKAPTTPSAGGSKTIFVKNLAWGVVQDTLYEFFADAGTVADVRIAKDEEGNSRGFGHVEFETAEAAQKALSKSGQTVEGREIWCDLARERGAATPGGGKDWSQTYAFYFSIRSNLTEFFGECGNVVNVRIPTDRETGQIKGFAYVEFGSKDEMTKAFELDGSDFNGRSLVVNEASSGGGGGGFGGGFGGGRSGGRGGDRGGRGGRGGRGGDRGGFGGRSGGRGDRGGRSGGRGGRGGRSSAPMVGTGKKMTFDD

SEQ ID NO: 3218 - protein, 335 aa, Oryza sativa Japonica Group
MPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 3219 - protein, 274 aa, Mesorhizobium sp. BNC1
MQTVTAHGATIPALGFGVFRMSDAEVERIIPAALEAGFRHFDTAQIYQNEAALGRALERAGARREDLFLTTKVWVDNYSADKFAASVDESLEKLKVDQVDLLLLHWPAHEVPVAAQIERLNAVKDAGKTRFIGVSNQNIAQMRESIARSAAPIVTNQVELHPYLPQHSLVAAARDSAVAVTAYYGMADGAVPKDPVLQQIGARYGKSAAQVGLRWLVQQGYVALSKTANPARVAENIAIFDFALDETDMAAIAKLARPDGRLVSPPGLAPDWDA

SEQ ID NO: 3220 - protein, 295 aa, Ashbya gossypii ATCC 10895
MSDLTNYKRLEKVGEGTYGVVYKAVDLRHGQRIVALKKIRLESEDEGVPSTAIREISLLKELKDDNIVRLYDIVHSDAHKLYLVFEFLELDLKRYMESVPKDQPLGDKIIKKFMMQLCKGIAYCHAHRIIHRDLKPQNLLINRNGNLKLGDFGLARAFGVPLRAYTHEIVTLWYRAPEVLLGGKQYSTGVDVWSIGCIFAEMCNRKPLFSGDSEIDQIFKIFRLLGTPNESVWPDIVYLPDFKPTFPKWQRRDLAQVVPSLNEHGLDLLDKLVTYDPIHRISAKRAVTHPYFKDE

SEQ ID NO: 3221 - protein, 463 aa, Saccharomyces cerevisiae YJM789
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQVEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 3222 - protein, 346 aa, Polaromonas sp. JS666
MKAAVLRAPKVLQLSDIATPEAAPGELVLRVRAAMVCGTDLRILTGRKTKGVRFPSVIGHEFAGEVVQVGDGVTQFKTGDRVCMDPVIPCRACAYCKTGHENVCLHRQAMGYEFDGAFAEYIRIPAIALTAGNVFMMPAQMSFESAALAEPLACCINGQRNAGVQVGDTVVVLGAGPIGLMHAALARLSGARQVIVSEPNAARRQAAVDRGVEHMCDPSTESVMEFVKARTDGLGADVVILAIGVPQLANESLNLVRKGGHVNLFAGFSAGETSNIDVNLIHYNEIVVTGASALRRRDYELALNMLSAGQIDANSLITHRYEVADSLAAFDEAGSGRALKVAIHNV

SEQ ID NO: 3223 - protein, 382 aa, Vibrio sp. Ex25
MSKRDFYEVLGVSRDASERDIKKAYKRLAMKFHPDRNQGDESAADKFKEVKEAYEVLTDPQKKAAYDQYGHAAFEQGGGGFGGGGFGGGGADFGDIFGDVFGDIFGGGRRGGGGHRAQRGADLRYNMELTLEEAVRGVTKEIEVPTLVHCDTCDGSGAKKGSSAETCGTCHGHGQVQMRQGFFAVQQTCPTCHGKGKIIKDPCNECHGQGRKQKTKTLNVKIPAGVDTGDRIRLSGEGEAGEMGAPAGDLYVQVHVKEHHIFERDGNNLYCEVPVSFAMAALGGEVEVPTLDGRVSLKVPSETQTGRMFRMRGKGVKGVRGGGIGDLIVKLVVETPVNLSSRQKELLKEFEESCGGEAATKHKPKSEGFFNGVKKFFDDLTS

SEQ ID NO: 3224 - protein, 259 aa, Gluconobacter oxydans 621H
MGGALLDGWLASPTPPRLVILDRHRTGSDDAITVVRTAAEIPAGFKPDIIVLAVKPAAAEIMIDAIGKALGPRMSNAAILSVMAGRTCAALSDAARLAGADIPVLRAMPNTPSAVGAGISGLYAAPSATPEQKSICHDLLFAVGDVVPVEKEADLSVVTAISGSGPAYVFLLAELLEKAGQQHGLSPTIARRLARGTIYGAGRMLDDLPDSAEDLRKAVTSPNGTTAAALAVLMKSDAWPETVPKAIDAATKRADELAG

SEQ ID NO: 3225 - protein, 427 aa, Neorickettsia sennetsu str. Miyayama
MKKVLVPRMGESIAEASVVKIIKNIGESVREDELLFELETDKAAVEVSAPVSGILSKINVEIGQAVKVDDVLGLIDENVVAPGGGNPISSGVGDRNIVPPSVAIAGGVALGASAEKNISSIKSSELIYAKQDAPSARILMEEKFLSPCDIVGTGKDNRIRKVDVLSRLFYGDPEQEKDSESEQRAVAGSSSVSPGFPERVVPMSKLRQRIASRLKESQNTAAILTTFNEVDMGNVIQIRKRYKDSFEKVHGLKLGFMSFFVQAVICGLEAFPEINAEIRGKDIVYKDYYNIGVAVGTKNGLVVPVIKNAQNLSFAEVERQILEYGKKARDGKIEPDDMQGGTFTISNGGIYGSLMSTPIINPPQSGILGMHAIKERPIVIDGAIVVRPMMYLALSYDHRIVDGREAVSFLVRVKECLENPERLLLKV

SEQ ID NO: 3226 - protein, 506 aa, Perilla frutescens var. crispa
MALYAALFLLSAAVVRSVLDRKRGRPPYPPGPFPLPIIGHLHLLGPRLHQTFHDLSQRYGPLMQLRLGSIRCVIAASPELAKECLKTHELVFSSRKHSTAIDIVTYDSSFAFSPYGPYWKFIKKLCTYELLGARNLAHFQPIRTLEVKSFLQILMRKGESGESFNVTEELVKLTSNVISHMMLSIRCSETESEAEAARTVIREVTQIFGEFDVSDIIWLCKNFDFQGIRKRSEDIQRRYDALLEKIITDREKQRRTHGGGGGGGEAKDFLDMFLDIMESGKAEVKFTREHLKALILDFFTAGTDTTAIVCEWAIAEVINNPNVLKKAQEEIANIVGFDRILQESDAPNLPYLQALIKETFRLHPPIPMLARKSISDCVIDGYMIPANTLLFVNLWSMGRNPKIWDYPTAFQPERFLEKEKAAIDVKGQHFELLPFGTGRRGCPGMLLAIQEVVIIIGTMIQCFDWKLPDGSGHVDMAERPGLTAPRETDLFCRVVPRVDPLVVSTQ

SEQ ID NO: 3227 - protein, 761 aa, Triticum aestivum
MAILGELGTEILIPVCGVVGIVFAIAQWFIVSKVKVTPGAAAAGGSKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFRYI

SEQ ID NO: 3228 - protein, 523 aa, Perilla frutescens var. crispa
MISAAVSLIICTSILGVLVYFLFLRRGGGSNGRPLPPGPRPWPIVGNLPQLGPKPHQSMAALARVHGPLMHLKMGFVHVVVAASATVAEKFLKVHDTNFLSRPPNSGAEHIAYNYNDLVFAPHGPRWRLLRKICALHLFSSKALDDFRHVREEEVGILIRNLASVGEMPASIGQMMYVCATNAISRVMLGRHVLGDEHRGAAGGGDTTAEEFKAMVVELMALAGVFNVGDFIPPLKGLDLQGVVAKMKKLHQRFDAFFSGILHDHKINGSNAAEGHVDLLTTLISLKDVDNNGEGGKLTDTEIKALLLNLFTAGTDTTSSTVEWAITELIRNPNILARVRKELDLIVGKDKLVKESDLGQLTYLQAVIKENFRLHPSTPLSLPRVAQESCEINGYYIPKDSTLLVNVWAIGRDPNVWPDPLEFRPERFLMGGEKPNVDVRGNDFELIPFGSGRRICAGMNLGIRMVQLLIATMVHAFDFELANGQLAKDLNMEEAYGITLQRADPLVVHPRPRLARHVYQAQV

SEQ ID NO: 3229 - protein, 484 aa, Acinetobacter sp. ADP1
MFQQIYQEWFSNIRADVLAGLVVGLALIPEAIAFSIIAGVDPQVGLYASFSMAVVIAFMGGRPAMISAATGAMALVMVSLVKEHGLNYLFAATILTGIIQIIAGQLKLAKLMRFVSKSVVIGFVNALAILIFMAQLPELIHVSGQVYLFVALGLAIIYLFPYIPRIGKLIPSPMVCIITITFLALIFSANVRTVGDMGHLPNTLPHFFVPDIPWNLETLWIILPYSSALAAVGLLESMMTATIVDELTNTSSNKHRECKGQGIANIVTGFMGGMAGCAMIGQSMINVKSGARARLSTFVAGVFLLILVVFISDWLKVIPMAALVAVMIMVSISTFDWGSIKNFRRNPKSSNIVMLTTVVVVVATHNLAIGVLVGVLLSALFLAQKLENDVRVETTLHQNTRIYDVRGQLFFSSSERFAKAFDFQENVAHVIIDLTHSHIWDVTTVASLDHIVDKFQKNGIQVTVKGLNEASSIMIEQYGTHSKI

SEQ ID NO: 3230 - protein, 1466 aa, Emericella nidulans
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQQGLSTPSGGIPLQKSDRPRAQTAALQLQPTVGSVLTAPLRSRVCCDTGEYEPRRILHGFDGVMKTGELLLVLGRPGTGCSTFLKAVCGETNGLHIDADSVLHYNGVSQQRMMKEFKGEVVYNQEVDKHFPHLTVRQTLEFGAAARTPAHRFQNMSRDEFASYAASVVMAIFGLSHTHNTKVGNDFVRGVSGGERKRVSIAEMALAMTPFAAWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTGVRDQHPTGNDEQASAELRARKENSQSRNSRAASPYILSIPMQIKLNTKRAYQRIWNDMSSTMSTVVGQIVIALITGVVFYDSPNTTAGFQSKGGTLFYAVLLNALTAMSEITSLYSQRPIVEKQASYAFYHPATEAIAGVVSDVPVKFLLAVAFNVIMYFLANLRREPAQFFIYFLMSFTVMFVMSAVFRTMAAVTKNAAQAMGLAGVLMLALVVYTGYVLPVPSMHPWFEWIHYLNPIYYAFEAMIANEFHGRDFDCIAFVPSMQIWTGDSFSCSSLGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNPILPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFCRACCGTPGEGLNVEQRKLLTIGVELPPSPKLLLFLDEPTSGLDSQSSWAICTFLRKLADSGQAVLCTIHQPSAILFQEFDQLLFLAKGGKTVYFGPIGPNSRTLLDYFESNGARKCDEAENPAEYMIEVVNAEVNDHGTDWFDVWKGSKECQAVKEEIERIHEKKRGTAGAIEETDDGSTKSEFADAILVPAVCRHVRVFQQYWRMPEYIISKGALAIVAGLFIGFSFYDAKTSLAGLQTLVFSLFMVCALFAPLVNQIMPLFITQRSLYEVRERPSKAIPGKLPDCNILVEIPYQVLMGILTFVCYYYPLSVPAKDQTERALVLLFCIQFYVYASTFAHMCIAAMPNAETASPIVILLFSMCLTFCGVMQPPDALPGFWIFMYRVSPFTYWVAGMATTQVHGREVVCGENELSIFDPPTNQTCGQYMERYISVAGGQVLNPSATAGCEYCSLTVADEYLAASQIYWSDRWRNFGLIWVYIGFNIFVATAVYYLFRVKKWNGRRKK

SEQ ID NO: 3231 - protein, 379 aa, Physcomitrella patens subsp. patens
MAVTAVDGEFVRRLQKEEEVQRSRKDSRRPRYSKFSQQELSSCKPLLTPRCTVVLFVLVGATCILIGMYALYASWSVVELVNRYDTFCVMKHATSANPLTTNEEKSAYMKNYNKQKNCTITMEIDKLMTPPIYVYYQLGNYFQNHRRYVKSKSERQLRGLPPSSSELNDCKPQDTANGQVIIPCGLIAWSLFNDSFDFSIDDFSSDNGTIFINKTAISWKSDREERFNNTVFPTNFPNNNRTTLANASQIGGASLDENLPLNRHEDLMVWMRTAALPTFRKIYGRIETDLVPGTRLTVNINNFYNTYGFGGSKKLVLSTVSWVGGRNDFLGLSYVVVGCVCIFIGLTFMYLHWKHPRPLGDRSHLSWVRKNAANSRVTS

SEQ ID NO: 3232 - protein, 324 aa, Polaromonas sp. JS666
MQTHHPDFMVFTGNANPSMASEIAQHLGISLGAAHVGRFSDGEVTVEIQQNVRARDVFVVQSTCAPTNDNLMELLIMVDALKRASAERIAAVIPYFGYARQDRRPRSARVPITAKVVANMLQAVGVSRVLTMDLHADQIQGFFDIPVDNIYASPVLLGDLRQKNYTDLMVVSPDVGGVVRARALAKQLGCDMAIIDKRRPKANVSEVMHVIGDIEGRNCVIMDDMIDTAGTLVKAAEVLKERGAQKVYAYCTHPIFSGPAISRIAQGDALDEVVITNTIPLSQNAQTCKKIRQLSVAPLIAETIQRIAKGESVMSLFSDQDNLF

SEQ ID NO: 3233 - protein, 123 aa, Paxillus involutus
HSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSFGMLDVV

SEQ ID NO: 3234 - protein, 123 aa, Paxillus involutus
  misc_feature (80)..(80): Xaa can be any naturally occurring amino acid
HSFYQLVHQGTKLIPADFLAPATSHNPIADSKHHRILLSNFFAQPEALAFGKTEEEVRKELGSGASEALVKSKVFEGNRXSNSIMFPLLTPRTLGALIALYEHKIFTQGVIWGINSFGMLDVV

SEQ ID NO: 3235 - protein, 336 aa, Xanthomonas oryzae pv. oryzae KACC10331
MLAAVRTGMGPIKTPGQEDQAPCHARARPSGRVGGGQAYRVCRESASVRRRSVLAGFMRSNRVVSGLVRLVVPHPAMPAAQLSGRFPQRPVVFGFPGRAAVATMALLHFSELPMQPTAIAPSILSADFARLGEEVNNVLKAGADWVHFDVMDNHYVPNLTIGSMVCQALRKHGITAPIDVHLMVEPVDRIVPDFADAGATTISFHPEASRHVHRTIQLIKSHGCQAGLVLNPATPVDILDWVLPELDLVLVMSVNPGFGGQAFIPSALDKLRAIRTKIDALGKPIRLEIDGGVKADNIGAIAAAGADTFVAGSAIFNAPDYAQVIAQMRAAVEAVR

SEQ ID NO: 3236 - protein, 443 aa, Gluconobacter oxydans 621H
MSIAARIERLPFTRFHWKLLFLGGLGYTFDGLDSAIVAFALPMLKNQWHLSGPELGLLGSATYLGYGLGALLSGWWGDRSGRRRVMMSALAIYAIGSLLSAGSSSFAGFFLCRLLSGIGAGAEATIIAPYLSEFVAARYRGAFTAALTGFYSFGYVTAAIMGFMLVPAMADGWRWALALTGFPVLMLLWWRRALPESPRWLDERGQTAEACRIVGDIEESAGLAVGLTTTTDRGAPSIRPVRDLFAPNLRRSTFMSWAMWLAITFSFYAFFTWIPTLMIERGMTVTRSFGYAISIYFAQLPGYASAAFLTDRLGRRGTVALFMVAGAISAIGMATSQTPTEVLIFGILLSFFMNGTFGGIYAYTPELFPTSLRARGMGLASAIARLGAIASPVLIGWLYPLAGFPGVFGLTTLILLSGATVTLVFGPRTEKRPLDDEQAFAQT

SEQ ID NO: 3237 - protein, 262 aa, Phaeosphaeria nodorum
MPAPTALQRRPEEFAENVSEDVSMEASAVPLPEDDADLIDMSIEPGTAIEAAPDALADDMPMTDESGRPKFAPAKSIPLAFRHEQRKVPIPPHRMTPLKTAWPKIYPPLVEHLKLQVRMNIKTKSVELRTSKSTTDTGALQKGEDFVKAFTLGFDVDDAIALLRLDDLYIETFEIKDVKTLQGEHMGRAIGRIAGKDGKTKFAIENASRTRVVLADSKIHILGGFKNIHVAREAIVSLILGQNPSKVYGNLRTVAGRMKERF

SEQ ID NO: 3238 - protein, 399 aa, Mycobacterium sp. MCS
MTEFRMPALGSDMDEGTLDQWLVKPGDTVTRGQVVAVVETTKAAVEVECWQEGTVDRLLVPEGQTVRVGTPLATLLAPGETPAPTAPAVPRTMRESPVAVERPEGAGRPAPAAGPAIATRPHRRWVSPAARRVAATLDIDADTLTGTGPQGAVTIRDVEQAAASRKQPADGRTVRDRSVAMRASIAAAMSRSKREIPHYYLADEVLMDPALAWLAERNAARSITERVLPAVLQIKAVAAAADRFPEFNGFWRDDAFVGADGVHVGVAISLRGGGLVAPAIHDVPDRSLDDLMGALTDLVARARAGSLRSSEMSDPSITITNLGDQGVDTVFGVIYPPQVALVGFGKPVQRVCAVDGGIRIATALTATLAADHRASDGHRGALFLAAINEILQQPQKLEK

SEQ ID NO: 3239 - protein, 390 aa, Pseudomonas putida
  misc_feature (333)..(333): Xaa can be any naturally occurring amino acid
QATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFXFVVFKLALEHQVLTQAVHDLLVLAITLSMAVVPLVMMALARQLHDDSPVQASPETGQ

SEQ ID NO: 3240 - protein, 130 aa, Arabidopsis thaliana
  misc_feature (119)..(119): Xaa can be any naturally occurring amino acid
SCVSDQCRFVFYTGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWXQSSVHPWVYET

SEQ ID NO: 3241 - protein, 138 aa, Shorea bracteolata
EKNIPVLLGLLSIWNVSFLGYPARAILPYSQALEKFAPHIQQVSMESNGKGVSIDGVPLPFEAGEIDFGEPGTNGQHSFYQLIHQGRVISCDFIGSAKSQQPIHLKGEVVSNHDELMSNFFAQPDALAFGKTPEELHK

SEQ ID NO: 3242 - protein, 246 aa, Neorickettsia sennetsu str. Miyayama
MPKTIIIASGKGGVGKSTVALNLAVLLARRFKTGLIDADIYGPSLSFMLGTKTKITMTERETLVPVEKFGLKYVSVGAMAEPGAPILWRGPMLSKILRTFLTNTEWGELDYLVIDTPPGTGDVHITLCSDFNVDGAVLVTTAQRVSIQDVSRACEMFRKLKILVLGVIENMSCSNLYKDEQYIIGNAENTREFSKAFSIPVLGRVPFLRQISYSCDNSIPAVLDAEITTIYKPILDELLLRLNEKV

SEQ ID NO: 3243 - protein, 375 aa, Ashbya gossypii ATCC 10895
MYGARAGNENSGAGAAGSRAGRRGSGGSGGPRVALGDVTAQVNNRGPRAGGKDARAGKPQGDAAVQGGENVEETVRAVGPVWDAAAEAAVAAAAAEYGGAPDPADEDTWDAVMVAEYAPEIFAYLRGLEVRFAPAADYMRGQPELRWEYRATLVDWLVQVHCRFQLLPETLYLTVNIIDRFLSRKTVTLNRFQLVGAAALFIASKYEEINCPTLRELLYMLDNAYTADEVLKAERYMIDTLEFEFGWPGPMSFLRRVSKADNYEYDIRTLAKYLLETTIMDPRLVAAPPSWLAAGAYYLSRIIIGYNTWTRQHVFYSGYTAEQLVSLATVILENCRHAETRHQAIFEKYSKSRHRRSAQVVARWIAMAEENLQPA

SEQ ID NO: 3244 - protein, 178 aa, Physcomitrella patens subsp. patens
MGFVAWWYAWTHALLYMSPYVYSAIGIAISIGVSVLGASWGIYITGSSLIGAAIKAPRITSKNLISVIFCEAVAIYGVIVAIILQTKLEATKQPFHPDSMRAGYSLFASGIIVGFANLLCGLCVGIIGSSCALSDAQNSTLFVKILVIEIFGSALGLFGVIVGIIMSSQATWPTAVLA

SEQ ID NO: 3245 - protein, 426 aa, Zea mays
MAARAADENRRPGVGRPAPCVRDMGSRRALTDIKNLVGVAPNPCAVAKKPVLQKSRKDEKKTALPSSRPMTRKFVASLASKEQPKCQPTGADPEPGVDQRKEPIVDGTVDIDVELGEPVDDSDGDIDMGDETENKDIMNQDESLMDIDSADSGNPLAATEYVEELYKFYRENEAKSCVNPDYMSSQQDINAKMRAILIDWLIEVHYKFELMDETLFLTVNVIDRFLEKEVVPRKKLQLVGITALLLACKYEEVSVPVVEDLVLISDRAYTKGQILEMEKLILNTLQFNMSVPTPYVFMKRFLKAADADKQFELVSFFMLELCLVEYQMLNYRPSHLAAAAVYTAQCAINRCQQWTKVCESHSRYTGDQLLECSRMIVDFHQKAGTGKLTGVHRKYSTYKFGCAAKIVPAQFMLESGGTAPPPSGAI

SEQ ID NO: 3246 - protein, 497 aa, Triticum aestivum
  misc_feature (182)..(182): Xaa can be any naturally occurring amino acid
  misc_feature (206)..(206): Xaa can be any naturally occurring amino acid
  misc_feature (208)..(208): Xaa can be any naturally occurring amino acid
  misc_feature (212)..(212): Xaa can be any naturally occurring amino acid
  misc_feature (227)..(227): Xaa can be any naturally occurring amino acid
  misc_feature (236)..(236): Xaa can be any naturally occurring amino acid
LASSKDSSFLFFCFLCLPPSLLWRKSSTAMAEEAGRRRRAAVVVLGDIGRSPRMQYHSLSLANQAGMEVDIVANGGSDPHLSLRENPSIHIHEMKSVQLSGISKISGALALLLKAAIQFILLIWFLCFKIPRPDVFVVQNPPSVPTLAAVKLVSWLRGAKFIVDWHNFGYTLLGLSHGRSHXIVKVYFWFEKHFGRLADGAFCVTXKXMLHXLAQNWGIKATVLYDXSPEFFHPAXLTEKHELFCRLGRSICSAMGSADCFSVEKEVEDENTTALTSKIDGGVLLKPNRPALVVSSTSWTPDEDFSILLEAALMYDRRVAATLGEEDSMDEGQLWIDIKNGKQFDYPRLLFIITGKGPDRNKYEEQIKRLKLRRVAFRTMWLASEDYPLLLGSADLGVSLHTSSSGLDLPMKVVDMFGCGLPVCAASFSCIEELVKVNRNGLLFSTSSELADELMMLFKGFPEECDTLKSLKHGALSTGSSSKWSAEWETNALPLVN

SEQ ID NO: 3247 - protein, 852 aa, Saccharomyces cerevisiae YJM789
MSSVNQIYDLFPNKHNIQFTDSHSQEHDTSSSIAKNDTDGSISIPGSIDTGILKSIIEEQGWNDAELYRSSIQNQRFFLTDKYTKKKHLTMEDMLSPEEEQIYQEPIQDFQTYNKRVQREYELRERMEEFFRQNTKNDLHILNEDSLNQQYSPLGPADYVLPLDRYSRMKHITSNFFRKKLGIPGKLKRRSHYNPNAEGHTKGNSSILSSTTDVIDNASYRNIAIDENVDITHKEHAIDEINEQGASGGESVVEGGSLLHDIEKVFNRSRATRKYHIQRKLKVRHIQMLSIGACFSVGLFLTSGKAFSIAGPFGTLLGFGLTGSIILATMLSFTELSTLIPVSSGFSGLASRFVEDAFGFALGWTYWISCMLALPAQVSSSTFYLSYYNNVNISKGVTAGFITLFSAFSIVVNLLDVSIMGEIVYVAGISKVIIAILMVFTMIILNAGHGNDIHEGVGFRYWDSSKSVRNLTYGLYRPTFDLADAGEGSKKGISGPKGRFLATASVMLISTFAFSGVEMTFLASGEAINPRKTIPSATKRTFSIVLISYVFLIFSVGINIYSGDPRLLSYFPGISEKRYEAIIKGTGMDWRLRTNCRGGIDYRQISVGTGYSSPWVVALQNFGLCTFASAFNAILIFFTATAGISSLFSCSRTLYAMSVQRKAPPVFEICSKRGVPYVSVIFSSLFSVIAYIAVDQTAIENFDVLANVSSASTSIIWMGLNLSFLRFYYALKQRKDIISRNDSSYPYKSPFQPYLAIYGLVGCSLFVIFMGYPNFIHHFWSTKAFFSAYGGLMFFFISYTAYKVLGTSKIQRLDQLDMDSGRREMDRTDWTEHSQYLGTYRERAKKLVTWLI

SEQ ID NO: 3248 - protein, 306 aa, Vibrio sp. Ex25
  misc_feature (213)..(213): Xaa can be any naturally occurring amino acid
MKPTVEILTDILAEVRPLIGQGKVADYIPALAKVPSNKLGIAVYTNEGEVIKAGDADEPFSIQSISKALSLTLAMCLYKQEEIWSRVGKEPSGQAFNSLIQLEMEQGIPRNPFINAGAIVVADLLQTRLSAPRQRLLEFVRQLSGDTHIVYDKVVAASEMMHGDRNAAIAYLMRSFGNFENEVIPVLQNYFHACALKMSCVDLAKTFSYLANXGTSVQTGKPVVSPVQTKQLNALLATCGLYDGAGEFAYRVGMPGKSGVGGGIIAVVPGEMTIAVWSPELDPSGNSLAGTKALELLSERIGRSIF

SEQ ID NO: 3249 - protein, 309 aa, Triticum aestivum
  misc_feature (65)..(65): Xaa can be any naturally occurring amino acid
FANRFCIFSLPALHQKFDLPAPFVLHTDCPHYWRFHLPGETEEEFATRLAKNLEDLILKEGPETXIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 3250 - protein, 115 aa, Mesorhizobium sp. BNC1
MHYEGSCHCGEVRFNVDVDLSRPITCNCSYCQRRGSILAFTPEENFELEQGEDKLTEYRFNTRQIAHSFCSVCGMQSFARAAAPDGTKMVAVNVRCLEGVDIESLKPTQVDGRSR

SEQ ID NO: 3251 - protein, 426 aa, Acinetobacter sp. ADP1
MALIVQKYGGTSMGTPERILNVARRVKRWHDHGHKVVVVVSAMSGETNRLLALAKAITDTPDPRELDQMVSTGEQVTISMLAMALNSIGVEAKSYTGRQVGIKTDSAYNKARIEAIDTDVMTKDLDAGRVLVVAGFQGVDEEGNTTTLGRGGSDTTGVALAAALKADECQIYTDVDGVYTTDPRVAPKAKKVDRISFEEMLEMASLGSKVLQIRSVEFAGKYQVPLRVLSSFDNDNDGAFDEEFKQNVGTLITTEAEDTMEQPIISGIAFNRDEAKLTILGVPDEPGIAAKILVPISAANIEVDMIVQNVEEDGTTDFTFTVNRGDLAKAKKILEETASNIGAREVSTRDDIVKVSIVGVGMRSHAGVASKMFMALAEESINILMISTSEIKVSVLIEENYLELAVRTLHTAFGLDREHGESSARA

SEQ ID NO: 3252 - protein, 552 aa, Salmonella enterica subsp. arizonae serovar 62:z4,z23:--
MQMILTPVASNQFKASAHKCDLCQGRENGPACVENCPADALQLITEASLTRLAKTRRLRTARQEIRPWHTVDTERSGATRSKVERMQATPPRGEPDKLAIEARKTTFEEIYLPFRTVQAEREAARCLTCGEHSICEWTCPLHNHIPQWIELVKAGDIDAAVALSHQTNCLPEITGRVCPQDRLCEGACTLRDEYGAVTIGNIERYISDRALSKGWRPDLSDVQKIDKRVAIIGAGPAGLACADVLARNGVSATVYDRHPEIGGLLTFGIPAFKLDKSLLARRREIFSAMGIRFELNCEVGKDISLATLLETYDAVFVGVGTYRSMKAGLPNEDAPGVYDALPFLIANTKQVMGLSESPDAPFIDTADLNVVVLGGGDTAMDCVRTALRHGAAKVTCAYRRDEANMPGSKKEVKNAREEGANFEFNVQPVELVLDTQGRVSGIRFLRTQLGEPDGQGRRRPVPVPGSEFVMPADAVIMAFGFHPHGMPWLESHGVKVDDWGRIAASVESAFRYQTSNPKIFAGGDAVRGADLVATAMAEGRHAAQGMLDWFGK

SEQ ID NO: 3253 - protein, 123 aa, Paxillus involutus
  misc_feature (108)..(108): Xaa can be any naturally occurring amino acid
HSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTXGVIWGINSFGMLDVV

SEQ ID NO: 3254 - protein, 178 aa, Zea mays
  misc_feature (36)..(36): Xaa can be any naturally occurring amino acid
  misc_feature (47)..(47): Xaa can be any naturally occurring amino acid
MASPSSSSFPSRKALSKIACRRLQKELTEWQVNPPXGFEHRVTDNLXRGAASPSPHFLSPFSPSSPCAGAPGTLYTGETYKLQVDFSEHYPMEAPQVIFLHPAPMHPHIYSNGHICLDILYDSWSPAMTVSSICISILSMLSSSPAKQRPADNDRYVRNCRNGRSPKETTWWFHDDTV

SEQ ID NO: 3255 - protein, 286 aa, Arabidopsis thaliana
MEGFSPPINTAQVDAKTKLDEKVDYSNLPCPVLYEELNREATMALKPELFEGFRLDYNKSLNQKFFLSHSLCIDASNSILMGPTEVPNPTPSSEIIKIPTANYDFGAGFIDPKLTDEEDKSQGHLVIDYKGSDYRTQLQLGNNSVYAANYIQHVTPHLSLGGEAFWLGQQLMSGVGYAARYETDKTVASGQIASTGVAVMNYVHKVSEKLSFATDFIYNYLSRDVTASVGYDLITRQSRLRGKVDSNGVVAAYLEEQLPIGLRFLLSAEVDHVKKDYKFGFGVNAF

SEQ ID NO: 3256 - protein, 123 aa, Paxillus involutus
  misc_feature (101)..(101): Xaa can be any naturally occurring amino acid
HSFYQLVHQGTKLIPADFLAPATSHNPIADSKHHRILLSNFFAQPEALAFGKTEEEVRKELGSGASEALVKSKVFEGNRPSNSIMFPLLTPRTLGALIALXEHKIFTQGVIWGINSFGMLDVV

SEQ ID NO: 3257 - protein, 340 aa, Picea sitchensis
MGSTGKIKIGINGFGRIGRLVARVALTRDDIELVAVNDPFISTDYMTYMFKYDSVHGQWKHNEVKVKDSKTLLFGEKPVAVFGCRNPEEIPWGEVGAEYVVESTGVFTDKEKAAAHLKAGAKKVVISAPSKDAPMFVVGVNEHQYKSDLNIVSNASCTTNCLAPLAKVINDKFGIVEGLMTTVHATTATQKTVDGPSNKDWRGGRGAGFNIIPSSTGAAKAVGKVLPVLNGKLTGMAFRVPTADVSVVDLTVRLEKSATYDEIKAAIKEESEGKLKGILGYTEDAVVSTDFIGDSRSSIFDAQAGIALSDNFVKLVSWYDNEWGYSTRVVDLIAHMASTH

SEQ ID NO: 3258 - protein, 251 aa, Escherichia coli O157:H7 EDL933
MVDKSQETTHFGFQTVAKEQKADMVAHVFHSVASKYDVMNDLMSFGIHRLWKRFTIDCSGVRRGQTVLDLAGGTGDLTAKFSRLVGETGKVVLADINESMLKMGREKLRNIGVIGNVEYVQANAEALPFPDNTFDCITISFGLRNVTDKDKALRSMYRVLKPGGRLLVLEFSKPIIEPLSKAYDAYSFHVLPRIGSLVANDADSYRYLAESIRMHPDQDTLKAMMQDAGFESVDYYNLTAGVVALHRGYKF

SEQ ID NO: 3259 - protein, 281 aa, Triticum aestivum
MAEHLASIFGTEKDRVNCPFYFKIGACRHGDRCSRIHNRPTISPTIVLMNMYQRPDMITPGVDAQGQPIDPRKMQEHFEDFYEDIFEELSKFGEIETLNVCDNLSDHMIGNVYVQFREEDQAAAAHTALQGRFYSGRLIIVDFSPVTDFREATCRQYEENTCTRGGHCNFMHVKQIGKDLRKKLFGRYRRSQRGRSRSPSPHHRRERHDRDDYRGRDDFRRGGGGGGGGRRGGSSRHERHDDGGRRRYGGSPPRRARSPVRENSEERRAKIEQWNREREAK

SEQ ID NO: 3260 - protein, 759 aa, Salmonella enterica subsp. arizonae serovar 62:z4,z23:--
MDEQLKQSALDFHEFPVPGKIQVSPTKPLATQRDLALAYSPGVAAPCLEIEKDPLAAYKYTARGNLVAVISNGTAVLGLGNIGALAGKPVMEGKGVLFKKFAGIDVFDIEVDELDPDKFINVVAALEPTFGGVNLEDIKAPECFYIEQKLRERMNIPVFHDDQHGTAIISTAAILNGLRVVEKNISDVRMVVSGAGAAAIACMNLLVALGMQKHNIVVCDSKGVIYKGREPNMAETKAAYAVDDSGKRTLDDVIDGADIFLGCSGPKVLTQEMVKKMARAPMILALANPEPEILPPLAKEVRPDAIICTGRSDYPNQVNNVLCFPFIFRGALDVGATAINEEMKLAAVHAIAELAHAEQSEVVASAYGDQDLSFGPEYIIPKPFDPRLIVKIAPAVAKAAMDSGVATRPIADFDAYIDKLTEFVYKTNLFMKPIFSQARKDPQRVVLPEGEEARVLHATQELITLGLAKPILIGRPSVIEMRIQKLGLQIKAGVDFEIVNNESDPRFKEYWSEYYQIMKRRGVTQEQAQRAMIGNHTAIGAIMVQRGEADAMICGTIGDYHEHFGVVKAVFDYRDGVHTAGAMNALLLPSGNTFIADTYVNEDPTPEQLAEITVMAAETVRRFGIEPKVALLSHSNFGSSNSLSASKMRETLERVRERAPDLMIDGEMHGDAALVESIRNDRMPDSSLKGAANILVMPNMEAARISYNLLRVSSSEGVTVGPVLMGVSKPVHVLTPIASVRRIVNMVALAVVEAQTTPL

SEQ ID NO: 3261 - protein, 123 aa, Paxillus involutus
  misc_feature (16)..(16): Xaa can be any naturally occurring amino acid
  misc_feature (18)..(18): Xaa can be any naturally occurring amino acid
  misc_feature (28)..(28): Xaa can be any naturally occurring amino acid
HSFYQLVHQGTKLIPXDXLAPATSHNPXADSKHHRILLSNFFAQPEALAFGKTEEEVRKELGSGASEALVKSKVFEGNRPSNSIMFPLMTPRTLGALIALYEHKIFTQGVIWGINSFGMLDVV

SEQ ID NO: 3262 - protein, 427 aa, Solibacter usitatus Ellin6076
MNLRAKLGLGSHGAERYGWTQLLGDCSGGVIAALIALPYGLAMASLMGLPPVLGVFTSILTAPVIALFGRNPVLIGGTASATVPFLALAARQHGVAGAAQLSILASAFMLLFAVTGLGRHMAKVPHAVVTGFSCGIGGMMLISQLDIMFGLATPMGRSAGSAVAQLASVVNRLGEARMVPLVLGLAVILVATVAARISPHAPAPLIGVVLAFAIARFFGFREKEVGVLPAMLPPVVGFAWKWKDTLAMLPSAAALAFVSSVNILITSRVVEHFRGKHKRMKASDADAELGAYGLANCVAGAFGAPMSVGIPARSLAVVRCGGTTALANLLHAAVLLVILWLGSGIVSHIPIPALAGVTAWMGLCLLDWSAWHRLPRMARVDAAAFLLTAASVLAVNAVLAVALGCSLYGVHALWARRVRPANVPEAV

SEQ ID NO: 3263 - protein, 471 aa, Brucella suis 1330
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETILEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 3264 - protein, 424 aa, Brucella melitensis 16M
MNPNTSPVWHPFTQHRLEPRPDRIVRTEGAYLFREDGSAVLDMISSWWVITHGHRHPAIMDAIRQASADLDQIIFADFSHQPAEELAKGLIALAPDGLSHVFYSDSGSTAVEVAIKMALGYFYNRGEPRSRIAVLQHSYHGDTIGTMSAGERGVFNAAYGALLFNVETLPFPSPGHEQPMLDRLEDVCRGGDLAALLVEPLVLGAGGMKMYPAHILATMREITERHGVLLAVDEVMTGWGRTGTLFACEQAGITPDILCTSKGLTGGSLPLAATLCTAAIFDAHYSDDRSKTFFHSSSYTANPIACAAALANLQVWLSEPVTERISALTRMQTERLHRFKDDSRFAGLRQTGTITALELDVPAGGYLSDAGPKLRTFFKQNGVLLRPLGNVIYVMPPYCVTAEELDRTYDVITQGVDMIAGQTR

SEQ ID NO: 3265 - protein, 367 aa, Mycoplasma hyopneumoniae 232
MNLKAGLIGLPNVGKSSLFSALTKMNVEIANYPFATIEPNIATVEIHDPRILQLTKIVKPEKTVFATYSFVDIAGLIKGASTGEGLGNKFLANVRNVDCLVHIVRCFQDPKIIHVNNEINPIFDIQTINLELIFADLGTIQTIISRLAKKANNTNDKQVKFEFELAKKVEIHLKHGKSLRDLELDSAEILQIKSWQLLTIKPVLYVANLDQKSIQNPDANPYFWKLKNYLVKEKAILLPLCIALEQEISQLDEEEKHLFLKEFLLEKSSLDLLILHSFYLLDLATFFTVGKKEVRSWTFRKNTPAIECSGIIHSDFKKKFIRVEIISFDDFVQAGSEKVVKENGKMRLEGKDYVIKDGEICHFRIGN

SEQ ID NO: 3266 - protein, 367 aa, Desulfitobacterium hafniense Y51
MAFLVLQDGTAFEGEGFGAWPADQEQDIQAGEVVFNTSMSGYQEMITDLSYTGQILVLTHPQIGNYGWHDEENEADKILLRGLVVRELSQGEGSAHGDRSLEEFCRLHSIWGLKGIDTRALTRHIRNQGTLPGVFAQTLEQGKKYWQEYADVSAAAEKEPHWVYQATVKESYEIPGSGPYVAVLDCGAKRNILRALQQRGLRIRVFPAWSSAEEILASSPKGVFISNGPGDPSGLPELIETVRTLLPKLPIMGICLGHQILALAAGGKTYKLPFGHRGGNHPVQDLRTGQTTMTAQNHGYAVAEDSMAGTGFEIILRNLNDGTVEGMEHTQYPVYSVQYHPEGAPGPEENGMLFEGFFAAVGAGAAG

SEQ ID NO: 3267 - protein, 275 aa, Erwinia carotovora subsp. atroseptica SCRI1043
MTQPKVKLADGNIMPQLGLGVWRASSEDTVIAVNEALSIGYRAIDTAAIYKNEEAVGQALSSANLPREEVFITTKLWNGDHTDPQKALEESLRKLRLDYIDLYLIHWPLPQQNTFVDAWRGLIKLQEQGLAKSIGVSNFHIHHLQRLKEETGVLPVIDQVELHPLLQQKQLHAWNATHHIQTESWSPLAQGGEGVFDHPIIRKLAMKYGKTPAQIVIRWHLDSGLVVIPKSVTPARIKENFEVFDFRLDKDELSEITKLDCGKRLGSDPDEPRND

SEQ ID NO: 3268 - protein, 138 aa, Shorea henryana
EKNIPVLLGLLSIWNVSFLGYPARAILPYSQALEKFAPHIQQVSMESNGKGVSIDGVPLAFETGEIDFGEPGTNGQHSFYQLIHQGRVIPCDFIGSAKSQQPIHLKGEVVSNHDELMSNFFAQPDALAFGKTPEELHK

SEQ ID NO: 3269 - protein, 371 aa, Oryza sativa Japonica Group
MAAAGAGAGAPDRAALTVGPGMDMPIMHDSDRYELVRDIGSGNFGVARLMRDRRTMELVAVKYIERGEKIDDNVQREIINHRSLKHPNIIRFKEVILTPTHLAIVMEYASGGELFERICKNVRFSEDEARYFFQQLISGVSYCHSMQVCHRDLKLENTLLDGSPAPRLKICDFGYSKSSVLHSQPKSTVGTPAYIAPEVLLKKEYDGKTADVWSCGVTLYVMVVGAYPFEDPEEPKNFRKTIQRILNVQYSIPENVDISPECRHLISRIFVGDPSLRITIPEIRSHGWFLKNLPADLMDDDSMSSQYEEPDQPMQTMDQIMQILTEATIPPACSRINHILTDGLDLDDDMDDLDSDSDIDVDSSGEIVYAM

SEQ ID NO: 3270 - protein, 582 aa, Rhizobium leguminosarum bv. viciae 3841
MKRQEILDGLRQSPKVDVCVIGGGINGISVFRELSLQGLNVLLVEKHDYCSGASSALSRMVHGGLRYLENGEFKLVQESLVERDRLLRNAPHYVAPLPTTVPVFDIFSGLGNGIVRFLGLSRRPSRRGAIAIKAGLSIYDFLTRKRALMPRHQFRGRRTTLAKWPALNPDIKSSATYFDAWVSHPERLGIELLQDGLSAEFGAMALNYAELRRTEDGQYRVEDQIGGASVAVKPALIINATGGWIDIANQTLFSPEARPAPLMGGTKGSHLIVDNADLRDALADHMIYYENEDGRICILFPYLGKVLVGSTDIRVDDPETVRCEADERDYILQSLAFVLPDIAVRPEQIVFQFSGVRPLPASTDSFTGRIPRDHFCTVVEPKDGGPPVLCMIGGKWTTFRSFGELAADMALERLDRQRRVATTDRPIGGGQAFPANAPVWLAQAAASKGLSIRRMAELFARYGTDAEAVAGFIAAGPDAVLPHAGYSVRELQFLIRGEAVEHLDDLLLRRTTLAVSGELTLDMMDAVLDLLAQEKHWTLAHHARERDRFLTLLTERHGVDEDMLSARNEPRSIECDTTAKSG

SEQ ID NO: 3271 - protein, 103 aa, Brassica napus
  misc_feature (87)..(87): Xaa can be any naturally occurring amino acid
AAEEERIKKCRGRVFALKDEPEVYRVWLPNCDSPGLAMARAFGDFCLKNFGLISVPDVSFRRLTQKDEFIVLASDGIWDVLSNEEVXGIVASAAPSRSSAART

SEQ ID NO: 3272 - protein, 289 aa, Malus x domestica
MEGKEEDVRLGANKYSERQPIGTSAQSQDDGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRAVFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKKHAWDDHWIFWVGPFIGAALAALYHVVVIRAIPFKSK

SEQ ID NO: 3273 - protein, 278 aa, Vibrio sp. Ex25
MMEIRQMEHKKIAFIGAGNMVRAIVSGLVANGYPAQNITATAPSEARRLPLEQDFGIRTTSDNIQAATEADVVVLSVKPQMMADVCKPLQAIDFTNKLVISIAAGINCSRLDDMLDTKLNLVRVMPNTPSQLGLGMSGLFAPAHVTEQDKAFAAELMEAVGKVCWVEQESGINNVIAAAGSAPAYFFLFMEAMQAEAIAQGFDKDTARLLVQQAALGAASMVVSNPETELSTLRENVTSKGGTTAEALRTFNEHQLSDIVAKAMQAAVARAEEMEKLF

SEQ ID NO: 3274 - protein, 289 aa, Malus x domestica
MEGKEEDVKLGANKFSERQPIGTSAQTQDEGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRALFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKRHAWDDHWIFWVGPFIGAALAALYHVVVIRAIPFKSK

SEQ ID NO: 3275 - protein, 233 aa, Vibrio sp. Ex25
MSSIQQNIEHITSQIRYDEQKFGRTPESVQLLAVSKTKPVEAILEAHQAGQTAFGENYVQEGVSKVQHFAEHYPDNRIEWHFIGPIQSNKSRLVAEHFDWVHTIDRTKIAQRLNDQRPSELKPLQVLIQVNTSGEASKSGVTEAEVFELAELISRLPNLTLRGLMSIPANVSDYESQLHEFQKLATLKQTLEAQFPEIDTLSMGMSGDMTAAIEAGSTMVRIGTAIFGARDYS

SEQ ID NO: 3276 - protein, 113 aa, Brassica napus
MQNSRTAPVSEAKRRRKIHNPKQQQPLTPLPPRIGKKASSGTKPDRVYAVSHQTEMFSSDSSEYRALRRSYLLLEEDSFALERELKEVEDEVKALEDEKVELLDKLVVMEGLV

SEQ ID NO: 3277 - protein, 449 aa, Zea mays
  misc_feature (61)..(61): Xaa can be any naturally occurring amino acid
  misc_feature (70)..(70): Xaa can be any naturally occurring amino acid
  misc_feature (408)..(408): Xaa can be any naturally occurring amino acid
  misc_feature (417)..(417): Xaa can be any naturally occurring amino acid
MPTRNHNAAAAAAPQHHHHNRGGAPALGKSKAVPGRADAMNRRAPLGDIGNLVSVRPAEGXLSCRSRSIXPITRSFGAQLVKNVQANAAIKNAAILPARHAPRQERKAPAKQPPPEDVIVLSSDSEQSRTQLESSASSVRSRKKVINTLSSVLSARSKAACGITDKRRQVAVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAAALGNKVEKEMENMVFFFAELALMQYGLVTRLPSLVAASVVYAARLTLKRAPLWTDTLKHHTGFRESETELIECTXCWSAHTRPXADSKLRSVYKKYSSEQFGGVALRPPAAAVEIK

SEQ ID NO: 3278 - protein, 340 aa, Acinetobacter sp. ADP1
MQRIAINGFGRIGRNVLRAWFESPKSFNFDIVAINDIADVKTLVHLFKYDTTHGPFHGEVQVELENEQVILHIKANNRVLKVQVYREEAPENLPWRALEIDVVLECTGLFRSHSDAIRHLGAGANRVIIGAAPFDKVDAAIVYGVNHADVKPTDRIISSVSCTTQALVPLVKIIDDAFGIETALMTEIHAVTADQSVLDHAHRDLRRARASGQNIIPTTSSALGALKRVLPKMENRIEGYSIRVPTINVAAIDLTFVAQSAMTIHRLNEVLVQAARLDYSEIMSVTDEPLVSSDFNHSPYSLIVDLTQTLVVGHQAKVFAWYDNEWGYANRLLDLCESFE

SEQ ID NO: 3279 - protein, 150 aa, Brassica napus
MYSSLETTAPATLEPRGTSENDMIRSGGDKLVLKGLKFYGYHGAIPEENTLGQTFLVDIDAWVSLKKAGLSDNLDDTISYVDIFSIAKETVEGPPLNLLEAVAERIASRTLEKFPQVTAVQVKLCKPNVALIKNTIDYLGVEIFRQQKHF

SEQ ID NO: 3280 - protein, 120 aa, Bacillus clausii KSM-K16
MSHKVLIVDDQFGIRVLLTEVLQKDGYEMFQAASGKEALAIQEEEEIDIVLLDMKIPGMDGIEILKKLKEKQPGIKVIMMTAYGELNLVNEAMDHGAVSYMAKPFDIQEVRATIRDNLQA

SEQ ID NO: 3281 - protein, 157 aa, Haloarcula marismortui ATCC 43049
MVSTGDTAPDISATIANGEVEDFELSDHLGDGPVVLAFFPGAFTPPCSNEMVALQEHLGDFHDAGATVLGLSADSAFSLNSFRDEHGLEFDLLSDMGRSAIQDYGLEIDIEDLGLLGVANRAVFVVDDDGEVAYSWVADDPTNEPDYDELLDAAESA

SEQ ID NO: 3282 - protein, 423 aa, Zea mays
MAVEKTLPGASAGRTVLVTGGAGYIGSHAVLQLLLAGFRAVVIDNLNNSSELAVRRVAALAGDHSRNLSFHKIDLRDKGALEMVFASTRFEAVIHFAGLKAVGESVQKPLLYYDNNVIGTINLLEVMSVHGCKKLVFSSSAAVYGSPKNSPCTENFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGDAEILFSETTKAERELNWKAKYGIEEMCRDQWNWASKNPYGYGSPDSIKQNGHQTNGSADSSKQNGHRTNGSTDSPKRNGHHAYGSADSPKRNGHCVFGSSDLKPNGNGHLR

SEQ ID NO: 3283 - protein, 314 aa, Physcomitrella patens subsp. patens
AYIALQAWKKAIVDDPKGILDTWVGLDVCEYEGVFCSPPEDPNLSYLEVVSGIDLNEAYLKGPLAPELGLLREIGIFHVNSNRFYGTVPDSFRYMKTLFELDLSNNKLSGKFPEVVLDIPRLEYLDIRFNNFYGKLPRELFSKPLDALFVNNNNFDGEIPENLGESKVSAIVLANNNFEGGIPESIGQLENVEEIVALNNNFKGGLPHGIGNLTGVTLFDCSENKITGALPKSIEGMASLEVFDMSDNMLGGMVTAELCELDNITSIVLDNNFFTGIAPSCAALGDILSLDGNCVPGSQGQKDAATCAAFYNGG

SEQ ID NO: 3284 - protein, 338 aa, Salmonella enterica subsp. arizonae serovar 62:z4,z23:--
MIIERARELALRAPARVVFPDALDERVLKAAHYLQQHGLARPILVASPFVLRQFALSHRMALDGIQVIAPPGNLPMRESFAQRWLARAGEKTPSDAVEKLNDPLMFAAAMVSAGDADVCIAGNLSSTANVLRAGLRVIGLQPGCQTLSSIFLMLPQYAGQALGFADCSVVPQPTAAQLADIAIASADTWRAITGEEPRVAMLSFSSNGSARHPNVANVQQATEIVRERAPQLLVDGELQFDAAFVPEVAAQKAPDSPLQGRANVMIFPSLEAGNIGYKIAQRLGGYRAVGPLIQGLAAPLHDLSRGCSVQEIIELALVAAVPRQADVSSESRLQTLVE

SEQ ID NO: 3285 - protein, 729 aa, Escherichia coli O157:H7 EDL933
  misc_feature (599)..(599): Xaa can be any naturally occurring amino acid
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLIEGAMAILRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVIMKDINDKSLALGMTEAAKLLNKQLERGKIDGLKLAGVISTIHPTLDYAGFERVDVVVEAIVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWHYKEDSKGXPKKEEDAAVDDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 3286 - protein, 510 aa, Moritella sp. PE36
MSKAKKTIALIIMDGWGHRLDQQDNAIAHAKTPILDKLWQDYPSMLISSSGLDVGLPDGQMGNSEVGHVNIGAGRIVYQNLTKIDKAIGDGEFYQNPALVKAVDAAVANDKAVHILGLASPGGVHSHDDQILAMIELAARQGATKIYLHAFLDGRDTPPRSALATLEKFDAKFAEVGAGKTATLIGRYFAMDRDNRWDRVEEAYKLFTQAESQYTADTAVAGLDAAYARDENDEFVKATVIGEAAPISDGDAVIFMNFRADRAREITRAFVDTDFTGFERAVTPKLADFVMLTEYAASIDTSIAFPSVKLVNTLGSILEQQNKTQLRISETEKYAHVTFFFNGGVEDPFTGEDRELIPSPQVATYDLQPEMNSEMLTDKFVAAIESEKYDVIICNYPNGDMVGHTGVFDAAVKACEAVDQSIGRVVEALEKVGGECLITADHGNAEMMINPETGGVHTAHTNLPVPLIYFGRDAEPAETGRLCDLAPTMLTLLGQEIPAEMTGKNLMNLK

SEQ ID NO: 3287 - protein, 208 aa, Triticum aestivum
MKPAVEGDERAAEIARIKAAAAAAKKAADEVVDVDDEVDEEEAVDGDDDDDDDDEVDDDGEEDEDEGVEGEEKGSAAQQVVDISDEDDDGGDEEEGGDDDDDDDDDDDDEEEEDEVDEEEEPEEELGTEYLVQPLGRAEDEEHSSDFEPEENGDGAEDEEIEDDDAEDGEDSVKPQSSSKRKRSGGEDEDDDDGDDDGDDDEKPPSKR

SEQ ID NO: 3288 - protein, 477 aa, Mycobacterium smegmatis str. MC2 155
MANRRAKIVCTLGPATATSSVLTELVDAGMDVARLNFSHSTHAEHSALYGMVREIAAQRGRVVGVLADLQGPKIRLGCFADGPVVWATGEHVTITTEDCPGDHDRVSTTYAGLSQDVRAGDRLLVDDGRVDLRVVAVDGPDIRCEVVDGGPVSDHKGISLPNIPVSVPPLSDKDIEDLKFALELGADMIAMSFVRAPEEVELAHKIMDEVGRRVPVIAKLEKPEAVSDLPAIVEAFDGLMVARGDLGVEMPLEQIPLVQRRAIALCRQAAKPVIVATQMLDSMVSDRRPTRAEVSDVANAVFDRADAVMLSAETSVGADPAHAVATMARIVVAAESGSGRGETPESALVEAVNGTDAVFGDAIAVAACEVGRRLGAAALCCFTRTGDTALRLARQRSPLPLLAFAHDDEVRGRLTFSWGVESAVLAPTELAESMPGEVSRALLSMGACHPGDVVVVVSGSRSGVAGYTDSVRVLRVE

SEQ ID NO: 3289 - protein, 356 aa, Physcomitrella patens subsp. patens
MAPYSGKYAEELQATAKYVATPGKGILAADESTGTIGKRLSSIKVENVEANRQALRELLFTTPGVGEYLSGVILFEETLYQKTSDGKPFVDVMKENGIIPGIKVDKGTIELWGTNGETTTQGFDDLHKRCAAYYNAGARFAKWRAVLKIGALEPTELAIQQNAQGLARYAIICQENGLVPIVEPEILVDGLHSIEKCAEVTEKVLAACYKALNDQNVLLEGTLLKPNMVTPGSDAEKVSPEVVAQYTVRTLQRTVPPAVPGIVFLSGGQSEEEATRNLNAMNALKTTKPWTLSFSFGRALQATVLKTWGGKKENVKAAQDALHVRAKANSEATLGTYGGSSTGEGTESLHVKNYVY

SEQ ID NO: 3290 - protein, 75 aa, Arabidopsis thaliana
  misc_feature (29)..(29): Xaa can be any naturally occurring amino acid
  misc_feature (62)..(62): Xaa can be any naturally occurring amino acid
MASSMLSSIGVVTSPAQATMVVPFTGLKXSVSFPAARKGNRGLTSIKGNGGRVSCLKVGPPXWKAQILQTRARLP

SEQ ID NO: 3291 - protein, 335 aa, Moritella sp. PE36
MATDTALITVLGAGSYGTSLAMSLARNGNKTVLWGHNPQHVAELAKARSNEAYLPGIAFPDALVLEADLEQAVAASRDILIVVPSHVFGDVLKQIKPFLRENSRISWATKGLEADTGRLLQDVATDILGSGYPLAVLSGPTFAKELAAGLPTAISISSTDPKFADDISHLLHCGRSLRTYTNNDFIGVQLGGAVKNVIAIGAGLSDGLGFGANARTALITRGLAELCRLGEALGAEKNTFMGMSCLGDLVLTCTDNQSRNRRFGLALGAGKGVDEAQVEIGQVVEGYRNTKEVYLLSARLGVEMPITEQIYLVLYENKPPKEAALALLARDKKGE

SEQ ID NO: 3292 - protein, 520 aa, Brucella suis 1330
MSTTAYPDTILIIDFGSQVTQLIARRVREANVYCEIVPFQSADEAFKRLQPKGVILSGSPHSTTDIGSPRAPQAIFDAGIPVLGICYGEQTMCAQLGGNVESGHDREFGRAFLDVQEDSPLFAGIWAKGTRHQVWMSHGDRVTSLPDGFTIIGTSPNAPYAVIADEKRKYYGVQFHPEVVHTPDGAKLLQNFVHRIVGVKPGWTMGAYREQAVEAIRKQVGSGKVICALSGGVDSSVAALLAHEAVGDQLTCILVDHGLMRKDEAQQVVEMFREHYNLPLILVDASDRFIGALEGESDPEKKRKTIGRLFIEVFEEEARKLGGADFLVQGTLYPDVIESVSFTGGPSVTIKSHHNVGGLPERMKMQLVEPLRELFKDEVRLLGKELGLPDSFIGRHPFPGPGLAIRCPGGVTRGKLEILREADAIYLDEIRKAGLYDAIWQAFAVLLPVQTVGVMGDGRTYEFVCALRAVTSVDGMTADFYHYDMNFLGNAATRIINEVRGINRVVYDVTSKPPGTIEWE

SEQ ID NO: 3293 - protein, 323 aa, Oryza sativa
MAEAAITRYWCHECEQAIEEAMVDEIKCPSCGGGFIEEMTDEEIERLTNRQPEPGFSQWNPIEHPGETMDSDDEDNDLGREFEGFIRRHRRASTLRRVLDSIHDDLADDQERDSSILINAFNQALALQGSVLDPDEGQGDQGGSTNDDGLLEEYVLGAGLSLLLQHLAESDPSRNGTPPAKKEAVEALPTVKIEEVVSCSVCLDDLEVGSQAKQMPCEHKFHSSCILPWLELHSSCPVCRFELPSEETKDLNEPSNIGRVEDSHEEVRADGPGNVSESSNRPWAIVPWLNELFSTREAQNAGGVSTDQQSPHTSGTNPNAGHS

SEQ ID NO: 3294 - protein, 258 aa, Zea mays
  misc_feature (187)..(188): Xaa can be any naturally occurring amino acid
  misc_feature (224)..(224): Xaa can be any naturally occurring amino acid
  misc_feature (241)..(241): Xaa can be any naturally occurring amino acid
  misc_feature (245)..(245): Xaa can be any naturally occurring amino acid
MSTAATKQQPEITKWASKDGEFRRQVSSFRDFVSRDKNARFAAEPDRYHLYISWACPWAHRTAIVRQLKGLDKIIGLSVVDYLLLDKGWKFSTSEETPGAIPDNVNHANYIREIYFKANPDYEGRFTVPVLWDKKHATIVSNESSEIIRMFNEEFNEFIDEDKKKLNYYPENLRSDIDALNEWVYDXXNNGVYKSGFATKQAAYENNVYPLFKSLDRLEKILAXNEYLVGGTFTEADIRLXDTIXRFDPVYVGHFNGN

SEQ ID NO: 3295 - protein, 170 aa, Haloarcula marismortui ATCC 43049
MDSREYAFEGATPDIHGYAHVSREATLVGDVTIGPNANVWPGVVLRGDVAPVEVGRESAIGDGAIVHASTVGEKVMVGHGAVLNDAHVRDGALVGFNSTVSDATIGEGSIVAMGTVVPPGYEVPAESFVRGSPATVTPLSETTIDPNEVFEAFSSGDYANLAARHEDLFE

SEQ ID NO: 3296 - protein, 138 aa, Hopea dryobalanoides
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGKTPEELHK

SEQ ID NO: 3297 - protein, 269 aa, Bacillus licheniformis ATCC 14580
MSSSHMTFHHLDILKQNIESFFRNEDVAGIVISHGTDTLEETSYFLHLVISDERPVVLTGSQRGPTLEGTDAFVNLRQAFLLAAHPDARGLGVTVLFNERVFAARYVKKQHASNVDGFFSPGFGYLGTADQDEIAIHQRLIKRETYQLIQPLPNVELIKCSLGSDGKFIDYAVKCGSAGIIIEAPGRGHTAPAILESAKKAAEKGIPVVLTTSAHEGEVKGVYGFKGSASTYADAGIILGGSYDSKKARIKLAVLLAAGQKIDEASFKY

SEQ ID NO: 3298 - protein, 152 aa, Physcomitrella patens subsp. patens
MDDERLKQLVKLTGKNRLVLDLSCRKKDGQYMVVTDRWQRFSDLVVNEATLVMLSAFADEFLVHGVDVEGKRLGIDDELVKILGKYSPIPCTYAGGVNTLADLERIKAAGNGVVDVTVGSALDVFGGDLPYKEVVAWHNRQLASCDASREGS

SEQ ID NO: 3299 - protein, 646 aa, Oryza sativa
  misc_feature (261)..(261): Xaa can be any naturally occurring amino acid
  misc_feature (281)..(281): Xaa can be any naturally occurring amino acid
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSQEILKSNGKYRPVACMSTNSSFVYVLTGMNSDSIGSLEPSCGYLAMTPLGAGDRPLVLENASYADVVKLMRGGFAIRFPYTSRFYVYSSKIKQCIAQSFXVQLIVGVIPLAMWTLKWIAXFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGRIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLAVNSHQFSSELSEILEEDE

SEQ ID NO: 3300 - protein, 520 aa, Anabaena variabilis ATCC 29413
MSDPNIGRLLGKRYQLQELIGTGAMGRVYRAKDVLLGGVPVAVKFLALSMQNEKMRLQERFEREAKTCALLGQKSIHIVRVMDYGVDENKIPFYVMEYLQGHSLNQIIRQQNISLPRFVSMARQICLGLQCAHNGIPVDGTVYPIIHRDIKPSNILVIQDPSFGELVKVLDFGIAKLLQSNSDQTKFYLGTLAYSSPEQMEGKELNNRSDIYSLGVMMFEMLTGKMPLVAPTHSFGSWYKTHHHQPPRTFSEVAPDLAIPQEIESLVMNCLAKAAKDRPSSISVILQVLESVEQQRTKRLLKQENYDSRQSTATLTINVVSEQKIKPDVLLSAPQDNTIYNTSWPQNKPIADIVFPQPINVSGEVLPALWVMLPEKEIFKRIICSRYNQFLFIAAPHPMLLWITVIHNRKYGAKWLPYYLDLKTGIGQEIASLLVKTGGYRLLFFARESPNRCSHVLSASVASAQRQRLQQWIMTAKTFVSCVDPQMSKNLLKGEYEKLKPQILAKLAAIDTDSPIDLSG

SEQ ID NO: 3301 - protein, 387 aa, Arabidopsis thaliana
MTVSEAYSPPLFSIAPMMGWTDNHYRTLARLITKHAWLYTEMLAAETIVYQEDNLDSFLAFSPDQHPIVLQIGGRNLENLAKATRLANAYAYDEINFNCGCPSPKVSGRGCFGALLMLDPKFVGEAMSVIAANTNAAVTVKCRIGVDDHDSYNELCDFIHIVSSLSPTKHFIIHSRKALLSGLSPSDNRRIPPLKYEFFFALLRDFPDLKFTINGGINSVVEADAALRSGAHGVMLGRAVYYNPWHILGHVDTVVYGSPSSGITRRQVLEKYKLYGESVLGKYGKGRPNLRDIVRPLINLFHSESGNGQWKRRTDAALLHCTTLQSFLDEVLPAIPDYVLDSSAVKEATGREDLFADVQRLLPPPYEKESFKALERIPTRPVILDEE

SEQ ID NO: 3302 - protein, 138 aa, Vibrio vulnificus CMCP6
MTKESKVVLKSDQQWREQLSEQEYHVCREQGTEPPFSGKLLHNKDSGEYACTCCHAPLFSSVNKYDSGCGWPSFDAPINETAVLYLDDFSHGMKRVEIRCARCDSHLGHVFPDGPKTTGERFCVNSVSLIFNKIETNE

SEQ ID NO: 3303 - protein, 868 aa, Chlamydomonas reinhardtii
MRKYELKPVAAAKSVAIIGAGLSGLVAAKSALEAGMLPTLFDRRGSIGGMWSTERSGMYDSLHTNVSRYSCVFSDFPWPEGAPDFPTPGELGAYLSAYRSTFLPPDKCPAQVGVEVLRVEPAGSPGGDGGGTGAKTGWRVQWRPLSPDADGSPSPSTCGHDTHDKQEQPPIQSAEFDAVIIASGYAAVPAVPDIPGLEAFAGKVVHSLHYKNPHEFAGLRVAVIGAGHSALDIASDLALASAACAPPSAAAEAEAAPAAAVGPAGVVHVFPRPMWVTPRYLPDSSAAAAAAASGTAAAAVAPPPAFLPLDMQFYRRSRRAGPEEVAVPNAAQRQKGNGFWASMCGDQGALISPLHAIAADTTEPPVIGICDSYVPLAATGAMHLRCARLLRITGPSTLELSDGGPPLSDIDALVLATGIKPDLSYLPHDVLEKLSYTPDDNYLPVAAHRGVTHPDVPGLACVGMYRGTYFGAVELQARLAAATLSGRAPPEPEEVVRAGVAAELAIREQTPRPVLPHGDYVGHTGGMAAALGVLPDAAWRAAHDQVVPGDFGLVPPSWEQQEQQAGTQAAMVKDAAAAAEAAMVAAVKEAPAGGEQGGGEPAGHVVVAGRPAAAYAAAAAAVAESHASLARFAGGRMVARAVFYALAGNWRLRRTLVSRMESSPSGVVTGAASFLPKRPDADAAANGSGSSNGSSGGSSSGGGSSRVRLGSMPFQYLYREQGQFAIQGSGSSSGSSSGSGGISSGGAVMRVSKEYVYRYDSPSDRLDVFFADAHGVPGGFFHSLRFLAPAEGAPGPQHFQREEEPAADDAADDSGCWRAVGEHLCVRDMYYSSYRFWFQGVHLKKFQIQFVVQGPNKDYTSTATYTRQ

SEQ ID NO: 3304 - protein, 345 aa, Vibrio sp. Ex25
MLKVAINGFGRIGRNVLRAVYESGKHQQIKVVAVNELAQPEAMAHLLQYDTSHGRFGKKISHDQEHLHVHHDSGEYDSIRILHLSELELLPWRDLEVDIVLDCTGVFGSQADGQAHIEAGAKKVLFSHPGANDIDNTIIYGVNHETLKDEHRVVSNGSCTTNCIVPIIKVLDEAFGIESGTITTIHSSMNDQQVIDAYHNDLRRTRAASQSIIPVDTKLHKGIERIFPKFSNKFEAISVRVPTVNVTAMDLSVTINTNVKVNDVNQTIVNASQCTLRNIVDYTESPLVSIDFNHDPHSAIVDGSQTRVSNGQLVKMLVWCDNEWGFANRMLDTALAMQASSQVEQ

SEQ ID NO: 3305 - protein, 662 aa, Bacillus cereus G9241
MIEKYKHGKVKKLFEVKTVILLQVNALSKLYGAETILANIKLEVQTKDRIALVGRNGAGKSTLLKIIAGELSHDGGEIIKPKDVSIGYLAQNTGLETSLTIWDEMLTVFTHLQQMETKLRRLEQEMGKEENFSNEATYERLLADYDQLQLDYKDQGGYQYEADIRSILSGLGFLVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVVELSTEGAQEYLGDYDYYVEKKNEMIERAEFEQQEQQENQAPVQKTVAQEKLNYLEEKERKKLERQRTRKIEELEQNIVQFEEEIATLEDQLCLPEIYADYEKASEITTKKQTLQDQLDACMAEWEELHL

SEQ ID NO: 3306 - protein, 331 aa, Vibrio vulnificus CMCP6
MTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 3307 - protein, 386 aa, Vibrio sp. Ex25
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMHAPIACAGPLLANELEALGKAMDNPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPDSTAELAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 3308 - protein, 181 aa, Ashbya gossypii ATCC 10895
MGVSFSKLFSNLFGHKEMRILMVGLDGAGKTTVLYKLKLGEVVTTIPTIGFNVETVEYKNISFTVWDVGGQDKIRPLWRHYFRNTEGIIFVVDSNDRSRIAEAREVLQRMLNEDEIRNAVLLVFANKQDLPEAMSAAEITEKLGLHSIRQRPWYIQATCATSGEGLYEGLEWLSTNLKNQA

SEQ ID NO: 3309 - protein, 394 aa, Arabidopsis thaliana
MSSLSRFLLRGNFSFSTPTNRRFFSAVTAAAATPSPPKPSLITLVNDERDPKFITEKFKKACQAEWFRKNIAVYERTVRRLAAAKKFEWVEEILEEQNKYPNMSKEGFVARIINLYGRVGMFENAQKVFDEMPERNCKRTVLSFNALLNACVNSKKFDLVEGIFEELPGKLSIEPDVASYNTLIKGLCGKGSFTEAVALIDEIENKGLKPDHITFNILLHESYTKGKFEEGEQIWARMVEKNVKRDIRSYNARLLGLAMENKSEEMVSLFDKLKGNELKPDVFTFTAMIKGFVSEGKLDEAITWYKEIEKNGCRPLKFVFNSLLPAICKAGDLESAYELCKEIFAKRLLVDEAVLQEVVDALVKGSKQDEAEEIVELAKTNDYLQCKLRLFPKE

SEQ ID NO: 3310 - protein, 312 aa, Magnaporthe grisea 70-15
MSGGWNTIESDAGVFTYLLEELGVKGVQFEELLTLEPESLASLHPVYGVIFLFKYPTDQPYRAEKPLDGDFDHDAADDGSLFFASQTIQNACGTQALLSVLLNRTADVEVGPALSDFREFTMPLPAEFRGEALSNSDLIRSVHNSFARSSPFADETSRPADADSEDAFHFIAYTAAGGRLWELDGLQPAPISHGPCDSTDGEDFANKIRFNLLAMCRDLRLRAAELGDVEAAERERRKRREWRFENGLRRHNFVGFAGEVLRGVVAAKVNEGGGEAYDKWVEQAKQKMMKRIGDRSERKRSAAGGGDVEMAG

SEQ ID NO: 3311 - protein, 320 aa, Arabidopsis thaliana
MGNPGSDTERNKRNVVSSVFDPALSRFVGFSQKLQTRLKSQLKNLTDDKHGIGSSWRQDKGNSSISMQIDLEKQLDCWRENPSWTDQIPVVKVGIPKGSLCNLKAEVNVGLPPDAVYNIVIDPDNRRVFKNIKEVMSRKVLVDDGLRQVVEVEQAALWRFLWWSGTISVHVLVDQDRADHSMKFKQVKSGFMKRFEGSWQVKPLFVDEHMCDRLKPKTLEEYNRCTGGKGRIGSKVTLDQLIQPAIVPPPPISWYLRGITAKTTEMLIHDLLAETARIRAAGVMEDGHSPDEQRIGTPGDIKERWSAHRRTSRRRRNDLC

SEQ ID NO: 3312 - protein, 117 aa, Zea mays
  misc_feature (31)..(31): Xaa can be any naturally occurring amino acid
MAKICCIGAGYVRGPTMAVIALKCPDIDVEXADICKPRIEAWNSDTLPIYDPGLDDGGKQCRGRNLLFSTDDEKHVPEADIMCVSMNTLTKTPGLGAGKDADLTYWESAGRMIADGC

SEQ ID NO: 3313 - protein, 526 aa, Venturia nashicola
MGLLSALLAPLAGSDRGWLFYTLASFGFTVAIVVANVLKQVLLKNPNEPPVVFHWFPFFGNTVVYGIDPIKFFAECKEKHGDIFTFILLGRKTTVYIGTKGYEFILNGKQSHVNAEEIYSPLTTPVFGSDVVYDCPNSKLMEQKKFVKYGLTTEALKSYVTLIQREVEDYAKRYSQFKGEKGSFDVCATMGEITIFTASRSLQGKEVRDKFDASFADLFHDLDMGFSPINFMLPWAPLPHNRRRDAANKKMTETYLEIIRSRKVEGAKKDSEDMIWNLMQCVYKNGTPIPDNEIAHMMIALLMAGQHSSSSTSSWMLFRLATRPDIQEELYQEQIRVCGADLPPLKYDDLARMPLHNQQIIKETLRMHSPIHSILRAVKQPMPIEGTPYTIPTSHVLLAAPIASGGSPMYFPAPEKWEPHRWDEGSGGTNISGGDNGDEEKEDYGYGLITKGASSPYLPFGAGRHRCIGEQFAYMQLNTVLATQVREFKFSFREGESFPKTDFSSLFSGPQRPAWLNWERREKSSS

SEQ ID NO: 3314 - protein, 515 aa, Bacillus cereus G9241
MIILKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 3315 - protein, 741 aa, Oryza sativa Japonica Group
MATRMAAAVAAMVAAVAISLAAGGAAQSSPSTPSCASKLVPCAQYMNGTDTPPAACCDPLKEAVKNELKCLCDLYASPEIFKAFNINISDALRLSTREFPYELSSSLSIRWQKRWSSHYVSWSSRIDELVPSVVVCSVIDSAELCRNTHPDKEFMDEADKASMRIYEHLQYLNTNTTLYNAILKAESEGVMLTEEARRAATTLRVDFEKGGIHLPKDKLEHVNHLNLEIAQLGRNCMSARLQLTISKRSHYLVTFACWFSENVMNKPGFVDIYPASRIPRNMQRHFKSIHRIKPWGDEEQRNQMDTTKQKGLRIVTDSGTLSTALRWVSDEEIRKQVYLVGNSEPRENITVLGKLINARDELAKTMGCKSYGDFAIRPNMAASVDVVMSFLKDLSGVVRHKAGEEFKRIQDFKRNVCNEKSAKLEPWDEDYFIGMMKSAVHNLDVSVVAAYFPLSQCLKGLNVLVESLFGATFHQIPMGDGESWHPDVMKLSLHHPDEIVALVCNFSSSSKIMARLNHWDVETLFHEFGHALHSLLSRTEYQHFSGTRVALDVAEMPSNLFEFYAWDYRVLRKFAVDETTGDPIPEKLVKALNASRNMFPATELQRQIFYSIMDLTLFGEQGSKPMDTISTVADLRRKHTSWKCVEGTHWHTRFTHLINYGAGYYSYLYARCFATTIWQEVCQGDPLSRSTGSALRDKFLKHGGAKDPSALLKDFVGDSIIINSGGGIIPDISSLCKEVGL

SEQ ID NO: 3316 - protein, 123 aa, Paxillus involutus
HSFYQLVHQGTKLIPSDFLAPATSHNPIADSKHHRILLSNFFAQPEALAFGKTEEEVRKELGSGASEALVKSKVFEGNRPSNSIMFPLMTPRTLGALIALYEHKIFTQGVIWGINSFGMLDVV

SEQ ID NO: 3317 - protein, 372 aa, Moritella sp. PE36
MSITSFYPPQRTLMGPGPSDVYPNVLQALSRPTIGHLDPVFVNMMDEVKELLQYAFQTKNPCTMAVSAPGSAGMETCFVNLIEPGDKVIVCINGVFGGRMAENVTRSGGVLVKVEDEWGKPVDPAKLEAALKAHPDAKIVAFVHAETSTGVLSDAKTLCALARQYGCLSIVDAVTSLGGVPLYVDDWGIDAIYSGTQKCLSCVPGISPVSFSPAAVERIQNRTVPVQSWFLDQTLVMSYWSGEGKRSYHHTAPVNTLYALHESLVQLQTEGLENAWARHAQQHLALRAGLEKMGIEFIVDEACRLPQLNTVVIPDGVDDAAVRNHLLQTYNLEIGAGLGAFAGKAWRIGLMGYAARAENVALCLRALEETLN

SEQ ID NO: 3318 - protein, 311 aa, Erwinia carotovora subsp. atroseptica SCRI1043
MANKIWVMGDAVVDLIPEDTERYLKCPGGAPANVAVGIARLGGNSAFVGRVGDDVFGHFLKTVLEEENVDTHYMAYDRHHRTSTVVVSLDDAGERTFTFMVRPSADLFLQPEDLPVFNRREWLHLCSIALSQEPSRSTAFEAMRQIKAALGRVCFDPNIRDDLWQSEQELRDCLTQALMLADVVKLSCEELTFLCPTSDVEEGIQQFMLRYPTRLLLVTLGSEGVWLHDRHQLQHFAAPSVTPVDTTGAGDAFVAGLLHGLAEYDDLSQPLSWDPIIEQAQRCGALATTAKGAMTALPYAQQLYTLPLAKV

SEQ ID NO: 3319 - protein, 525 aa, Zea mays
MAATTHAASMSFLLSHPQSRSATPSRHLPLRPAARRVQCATDAAALSPAVTTKHRRAADENIREEAARHPAPKQGLSAWYEPFPPAPNGDPNERYSLDEIVYRSSSGGLLDVRHDMEALSRFSGAYWRDLFDSRIGRTTWPYGSGVWSKKEFVLPEIEPDHIVSLFEGNSNLFWAERLGRDHLGGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYGYYKSGWTEFQPQVARPTFASAIQIGDPVSVDRAVVALKATDGIVEEATEEELMNAMSLADRTGMFACPHTGVALAALFKLREQRVIGTNDRTVVVSTAHGLKFSQSKIDYHDSKIEDMACKYSNPPVSVKADFGAVMDVLKKRLKGKL

SEQ ID NO: 3320 - protein, 976 aa, Pisum sativum
MKSITCYLLVFFCVLFTPCFSITDLDALLKLKESMKGEKSKHPDSLGDWKFSASGSAHCSFSGVTCDQDNRVITLNVTQVPLFGRISKEIGVLDKLERLIITMDNLTGELPFEISNLTSLKILNISHNTFSGNFPGNITLRMTKLEVLDAYDNSFTGHLPEEIVSLKELTILCLAGNYFTGTIPESYSEFQKLEILSINANSLSGKIPKSLSKLKTLKELRLGYNNAYDGGVPPEFGSLKSLRYLEVSNCNLTGEIPPSFGNLENLDSLFLQMNNLTGIIPPELSSMKSLMSLDLSNNALSGEIPESFSNLKSLTLLNFFQNKFRGSIPAFIGDLPNLETLQVWENNFSFVLPQNLGSNGKFIFFDVTKNHLTGLIPPDLCKSKKLQTFIVTDNFFHGPIPKGIGACKSLLKIRVANNYLDGPVPQGIFQMPSVTIIELGNNRFNGQLPSEVSGVNLGILTISNNLFTGRIPASMKNLISLQTLWLDANQFVGEIPKEVFDLPVLTKFNISGNNLTGVIPTTVSQCRSLTAVDFSRNMITGEVPRGMKNLKVLSIFNLSHNNISGLIPDEIRFMTSLTTLDLSYNNFTGIVPTGGQFLVFNDRSFFGNPNLCFPHQSSCSSYTFPSSKSHAKVKAIITAIALATAVLLVIATMHMMRKRKLHMAKAWKLTAFQRLDFKAEEVVECLKEENIIGKGGAGIVYRGSMPNGTDVAIKRLVGQGSGRNDYGFKAEIETLGRIRHRNIMRLLGYVSNKDTNLLLYEYMPNGSLGEWLHGAKGCHLSWEMRYKIAVEAGKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLTGYPMASVIYMFNIAMMCVKEMGPARPTMREVVHMLTNPPQSTTHNNLINL

SEQ ID NO: 3321 - protein, 761 aa, Beta vulgaris
MISDLATEIFIPVCAVIGYISCYQWFLVSKVKVSTDRHVNNGGSAKNGFNDYLIEEEEGVNDQNVVAKCAEIQNAISEGATSFLFTEYQYVGVFMCAFAVLIFVFLGSVEGFSTESQPCTYSPLKKCKPALATALFSTVSFLLGAITSVVSGFLGMKIATDANARTTLEARKGVGKAFIIAFRSGAVMGFLLAANGLLVLYIAINLLKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMCYPLLISSMGIIVCLVTTLFATDFFEIKAVKEIEPALKKQLIISTVLMTVGIAIITWIALPSSFTIFNFGTQKVVHNWQLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSEPHKAAVIGDTIGDPLKDTSGPSLNILIKLMAVESLVFAPFFATHGGLLFKLF

SEQ ID NO: 3322 - protein, 340 aa, Mycobacterium smegmatis str. MC2 155
MTIRVGVNGFGRIGRNFYRALATQKAEGKNTDIEIVAVNDLTDNATLAHLLKFDSILGRLPQDVSLEGDDTIVIGDTKIKALEVKEGPAALPWGDLGVDVVVESTGIFTNAAKAKGHLDAGAKKVIISAPATDEDITIVLGVNDDKYDGSQNIISNASCTTNCLGPLAKVLNDEFGIVKGLMTTIHAYTQDQNLQDGPHKDLRRARAAALNIVPTSTGAAKAIGLVLPELKGKLDGYALRVPIPTGSVTDLTAELAKSASVEDINAAMKAAAEGPLKGILKYYDAPIVSSDIVTDPHSSLYDAGLTKVIDNQAKVVSWYDNEWGYSNRLADLVALVGKSL

SEQ ID NO: 3323 - protein, 765 aa, Beta vulgaris
MGAALLPDLITEIIIPVCAVIGIAFSLLQWYIVLRVKLSPDSTRNNNNKNGFSDSLIEEEEGLNDQSVVAKCAEIQNAISEGATSFLFTEYQYVGIFMVAFAVLIFLFLGSVEGFSTSSQECTYDKTRRCKPALATAIFSTVAFLLGAITSLGSGFFGMKIATYANARTTLEARKGVGKAFIVAFRSGAVMGFLLAANGLLVLYITILLFKIYYGDDWEGLFEAITGYGLGGSSMALFGRVAGGIYTKAADVGADLVGKVERDIPEDDPRNPAVIADNVGDNVGDIAGYGVLIFLDSYAESSCAALVVRSISSFGISHDLTAMMYPLLVSSVGIIVCLITTLFATDFFEIKAVKEIEPALKKQLIISTALMTVGVAVISWIALPTSFTIFDFGSQKEVQNWQLFLCVAVGLWAGLIIGFVTEYYTSNAYSPVQDVADSCRTGAATNVIFGLALGYKSVIIPIFAIAISIFVSFSFAAMYGIAMAALGMLSTIATGLAIDAYGPISDNAGGIAEMAGMSHRIRERTDALDAAGNTTAAIGKGFAIGSAALVSLALFGAFVSRASIQTVDVLTPKVFIGLIVGAMLPYWFSAMTMKSVGSAALKMVEEVPKQFNTIPGLLEGTAKPDYATCVKISTDASIKEMIPPGALVMLTPLIVGTFFGVETLSGVLAGSLVSGVQIAISASNTGGAWDNAKKYIEAGASEHARTLGPKGSDAHKAAVIGDTIGDPLKDTSGPSLNILIKLMAVESLVFAPFFATHGGLLFKYL

SEQ ID NO: 3324 - protein, 90 aa, Brassica napus
EGNNVFAWGRGTNGQLGIGECLDRNYPQIIEALSVDGESGQHIESSNFDPSAGKSWVSPAERYAVVPDEKTGQTDGSSKGNGSDMSVPTN

SEQ ID NO: 3325 - protein, 716 aa, Shewanella sp. MR-7
MIYQSPTIQVELLEDNIAKLCFNAPGSVNKFDRETLASLDAALDSIKQQSNIQALVLTSGKDTFIVGADITEFLGLFAQDDAVLLSWVEQANAVFNKLEDLPFPTASAIKGFALGGGCETILATDFRIADTTAKIGLPETKLGIIPGFGGTVRLPRVIGADNALEWITTGKDQRPEDALKVGAVDAVVAPEALEAAAIQMLKDAVAEKLDWQARRHRKMSPLTLPKLEAMMSFTTAKGMVFAVAGKHYPAPMAAVSVVEQAATKGRSDALQIEHQAFIKLAKTDVAKALIGIFLNDQLVKGKAKKAGKLAKDVKSAAVLGAGIMGGGIAYQSASKGTPIVMKDIAQPALDLGLGEAAKLLSAQVARGRSTPEKMAKVLNNITPALDYAPVNHADVVVEAVVEHPKVKAQVLAEVEQYVSEDAIIASNTSTISINLLAKSMKKPERFCGMHFFNPVHKMPLVEVIRGEHSSEETIASVVAYASKMGKTPIVVNDCPGFFVNRVLFPYFAGFNGLLAEGGDFAAIDKVMEKQFGWPMGPAYLLDVVGLDTGHHAQAVMAEGFPDRMGKSGNDAIDVMFENKRLGQKNGKGFYAYSVDSRGKPKKDVDPTSYELLKAAFGEQKAFDADEIIARTMIPMIIETVRCLEEGIVASPAEADMGLVYGLGFPPFRGGVFRYLDTMGVANFVALADKYAHLGGLYQVTDAMRALAANNGSYYQA

SEQ ID NO: 3326 - protein, 288 aa, Arabidopsis thaliana
MARNSDNDMCKEERKRESFFKVLQRVDISSENMRALPYDFVRSFSNNELSRKMKIKARWGSSWEVEICKNPRFYFMEKSGWEKFVSDNALGASEFLTFTHKGNMRFTVNIFMQDGKEVLQPPQSMSFMASSRPPKREQGIPSLATTIAAESNGGGNYKRKLNFEKKKAEESHNSKRTDKVFSVQRESAGASSSSVAEFSMFIKKSYLIYMWFPKSVQSIHMPKQRTIFKIHHPNMKKSWNVVYVVSGTKSSFSAGWKGLAQEYPLAVGDTCKFSFIKQHELILFVSKP

SEQ ID NO: 3327 - protein, 340 aa, Legionella pneumophila str. Lens
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARKMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 3328 - protein, 347 aa, Triticum aestivum
  misc_feature (124)..(124): Xaa can be any naturally occurring amino acid
  misc_feature (225)..(225): Xaa can be any naturally occurring amino acid
  misc_feature (259)..(259): Xaa can be any naturally occurring amino acid
  misc_feature (299)..(299): Xaa can be any naturally occurring amino acid
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLXDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWGXPTAKYVEKCKYPTDGSSPKSLRYIGSMVADVHRXTLLYGGIFLYPADKKSPSGKLRVMYEVFPMSFLMEEAGGXQSFTGKGRSLDLIPTDIHERSPIFLGSSDDVEEIKALYAEEAKKAGSA

SEQ ID NO: 3329 - protein, 445 aa, Clostridium acetobutylicum ATCC 824
MEEINAKVVTKVPGPKSRELLKKREKYVAKGVSCSYPVFVEEAKGALVKDIDGNVFVDFAGGIGVQNIGHRDDGVVEAVKEQLDKYIHACFHVNMYEPYVDLAEKLTEITPGNFAKKAMFANSGAEAVENAIKIARAYTKKSGIISMNGSFHGRTNMTMSITSKYKPYKNGFGPFVCETYKADYAYCYRCPLGCKFKDCGIACAEKLKTMLKTVVSPDMIACLIVEPVQGEGGFVVPPKDYFKALQQICNENNIVFIVDEVQAGFARTGKFFAHEYFDVDADIITMSKSIANGLPISAVVGKAEIMDAACVGGIGGTYGGNPLSCVAAIKVIDKIKEANLNEKSIELGKSIMNRLNEMKEKYNVIGDVRGLGAMIGVEFVKDKDTKEPNKEIVSSILDYCFKHGVIFLNAGLLGNVLRFLPPVVMTDEQLKYGLDTLEEAIRIAI

SEQ ID NO: 3330 - protein, 327 aa, Clostridium acetobutylicum ATCC 824
MNVLVCGGAGYIGSHMAAYLLENGHNVVIVDNLTTGHKESILNNKLYVGDLRDEDFLNKVFDENKIDAVIDFAANSLVGESVANPLKYFDNNIQSVVKLLEAMKNHDVKYIVFSSTAATYGEPDNIPILEGDKTFPTNPYGESKLAVEKILKWCDNAYGIKYTALRYFNACGAHISGNIGEDHNPETHLIPLILQVALGKRDKIMIYGDDYDTEDGTCVRDYVHVSDLASAHLLALERLKNGGKSAIYNLGNGKGFSVKQVVEATRKVTGINIKAEIGERRAGDPGTLIASSDRAILELGWKPKFNSLETIIETAWKWHKNHPNGYK

SEQ ID NO: 3331 - protein, 365 aa, Iris x hollandica
MDSTPVIQIPTPYPFSDEEACLYAMQLRSFSVLPMTLKAAIELDLLEIIAKAGPGAYLSPAEISSQLPTENPEAPAMIDRMLRLLACYSVVSCRVDAAGDDGKPRRRYGAERVVKYLTKNEDGVSMAALTLMNQDKVFMESWYHLKDAVLEGGIPFKKAFGMSPFEYQGTDPRFNKVFNEGMRNHSAFIMKKILETYQGFDSVKLLVDVGGGLGGTMKAIVTKYPHIEGINFDLSHVISEAPPIPGVKHVGGDMFESVPSGDAIFMKWILHDWSDAHCLKLLSNCWKALPEDGKVIVMEGILPTIPEPTSAAQGVVHIDLVMMAHNPGGKERTKAEFESLARDAGFSGSKALCSYANCWILEFYK

SEQ ID NO: 3332 - protein, 201 aa, Ashbya gossypii ATCC 10895
MQEETEFEQFEENDPRINYKVRAKKTLEEYKQLDAEDESLAKWKESLGLSSDVLPLEFPGDTRKVVIKAIQLLVDTDAEPITFDLSTEESIKELASKRYKIREKSVYKLKITFKVQHEIITGLRYVQYIKKAGIAVDKIDDHLGSYAPNTAKKPVYEVELPESEAPSGFLARGNYNAVSKFIDDDQANHLTLNWSVEIVKK

SEQ ID NO: 3333 - protein, 494 aa, Acinetobacter sp. ADP1
MKNPVTFSQRLLRRKPINFLVQETQQGGKTLKRSLTLFQLTMFGVGATIGTGIFFVLSEQVPVAGPAVLISFILAGITAGLTALCYAELSSMIPASGSSYSYAYATLGEGVAFLVAACLILEYGVSAAAVAIGWSEYLNNLIHNVFGVHLPNWLLSAPFVADGYKLHLGGTGLINLPAAILVFLCCMLLMRGVTESARINAVMVLIKLCVLILFISIAATAFNAEHLTPFSPHGFAGISAAAGSIFFTFIGLDAVSTAGEEVENPRRNLPLAIISALFVVIIFYILVALTALGAQEQGLFKGQQAGLAVILQEITGSTWPAIILAAGAVISVFSITLVVLYGQTRILFAMSRDGLAPKIFHRVSTQTLTPNANTLIVAVIVSIIAGFVPADVLWDLTSMGTLIAFTVVSIGVLVLRYRMPDAPRGFKVPFFPALPVLSICACLYLISSLSAIVYVIAAIWAVIAATYYFSCASKNSVLEAGSEAYSHQNGDDHQ

SEQ ID NO: 3334 - protein, 369 aa, Aspergillus oryzae
MPLYAFGSNGSGQLGIGHDEDVSIPTRCLFEASEPEALISSEGNSTNSIRRIAAGGNHTLLLFSDGAVYAAGCNDDGRCGAEPGDSLMKFWRVIVRDEVSGQSCETFRDVSACWEGTFLVAAAGDRVFVLGSGAKGELGLGEGVVRATGPVPVKDFPPSGTEIVGVASGMGHTVVVLSDGEVYGWGAARKGQLGEAAKGRKVVWEPVRVEGLPFRATGAVCGREFTVVTGDKSKGEFVILGSADNRWNVLSDAPPALEVYRGIWASWHGVYVQRDGGVLAWGRNDRGQLPPVDLPVVSELAVGSEHALALLDGGTVVAFGWGEHGNCGPVADEQGNVKGKYALIPLSMEGESQVVGVGAGCATSWVVMS

SEQ ID NO: 3335 - protein, 329 aa, Moritella sp. PE36
MGLIVNGKWHDQWYETKNSEGKFERQASRFRDTISNEEGSRYPAEAGRYHLYVSLACPWAHRTLIFRQLKQLQDIISVSVVKPEMLSNGWEFATNDADGNTNGDYSDSLYQSDYVYQLYLKAAPDYEGRVTVPVLWDKKTQSIVNNESSEIIRIFNTAFNELTGNHDDYYPTDLQPEIDTINERIYDTINNGVYRAGFATTQEAYDQAFEELFASLDWLEARLSNHRYLLGEQLTEADWRLFTTLLRFDAVYHGHFKCNRNKLSEFHHISNYVRELFQFEGIKSTVDLEYTKIHYYASHDTINPTLIVPRGPQQDFTAPHDRDRLTNKV

SEQ ID NO: 3336 - protein, 142 aa, Thiobacillus denitrificans ATCC 25259
MAVQRTFSIIKPDAVAKNVIGKIVSRFETNGLKVVASKMKHLSRQEAEGFYAVHKDRPFFKDLVDFMVSGPVVLQVLEGEDAIAKNRTLMGATDPKKAEPGTIRADFAESIDANAVHGSDAPETAAVEIAYFFPASEVYAGR

SEQ ID NO: 3337 - protein, 529 aa, Blastopirellula marina DSM 3645
MTMTAPAPDHNSDASRISDEKILVLDFGSQYAQLIARRVREQNVYCEIVRHDISVERIAAHNPRGIILSGGPSSVYEEGAPQCDPGIFAMGIPVLGICYGMQLICQAFGGQVKNTSQREYGHAKISISPNEDLFGGLPSETDVWMSHGDQVTNVTESFEPLASTSTCPIAAMRHKELPLYAMQFHPEVTHTPLGFQILRNFVISVCDCEGLWKLHDFAQQTIAEIRERVGDNRVICGLSGGVDSAVVAALLYQAIGPQLSCILVDNGLLRKQEAESVIAEFTKHFKTDLHVVDAKDQFLKELAGITEPQEKRRRIGYQFVECFKAEALKIKDAKFLAQGTLYPDVIESGAALDGPAATIKLHHNVGGLPKELGFELIEPLRDLFKDEVRKLGLELGLPEDLVWRHPFPGPGLAVRCLSDITEEKLSVLREADSIVVSEIKAAGLYRQTSQAFAVLLPVQSVGVMGDARTYENAVAVRCVNTDDFMTATWSYLPYEVLARISTRIINEVKGVNRVCYDISTKPPATIEWE

SEQ ID NO: 3338 - protein, 351 aa, Yarrowia lipolytica CLIB122
VPKTQKAVVFEEVNGPLMYKDIPVPTPAKDELLVKVQYSGVCHSDLSIWKGDWAQQLRFSPKMPLVGGHEGAGEVVGMGDQVTGWQVGDRTGVKFISGSCLTCEHCSAGWDQHCVAPGVSGLLKDGSFQQYACVKAATAPRIPDSCDLAGVAPVLCAGITAYTALKNSGLKAGEWVVITGAGGGLGSYAVQYAKCMGFRVIAIDTGDDKETHTKELGAEVFIDFAKSGAGMIAEIHKLTGGGAHAVVNFAVQDAAVEAATLYVRTRGTLVLCALPPNGTVKSHILNHVGRGLTIKGSYVGNKLDTQEAIDFYARGLVKTKYRLGELSKLEEYYQQMLDGKIVGRVVVDNSK

SEQ ID NO: 3339 - protein, 798 aa, Ashbya gossypii ATCC 10895
MNDKLPRADDLEATWNFVEPGIGQILGRDGSPHAGRVQKLLSAAMYMDVYTAIYNYCVNKSRSTGHFQSDSAQRQSNQSSILVGGEIYEKLKAYLHDYIVNLSKDPDETFLQFYVRRWKRFTIGAVFLNHAFDYMNRYWVQKERIDCKRNIFDVNTLCLMTCKQVMFDQHCQGLVDEILQQLTLQRDGRIVNQTDITTAIKSFVALGIDPSDLKKLNLNVYIQNFETAFLNSTREYYRKMSQEYLQTHSVTDYIFEAHSRIAEEESKIVLYLDDHTRKPLSDTLNEVLIAEHAEELKSEFILLLKSRDETKISTLYELMQRDFTLLPELAKSFEEHVEDVGQSEVRKLLESHKEASNSDSGKKAAPLSPRDYIKTLIDVHVGFSVLTDECFQKSPLFARALDSASRRDINNNQFALAPGSFKNTTSKTPEMLAKYSDQLLKKNKNGTDGDKDMSVDDIMTIFKFLTDKDAFEYHYRKNLAKRLIHGTSTSEENEEMVIQRLQSENSMEYTGRITKMFQDVRLSKQLGQEFDSQIKSEPDYSKERYPEFQPFVLAETMWPFPYQEVEFKLPQELVAEHQKLVDLYVKKHSGRVLKWLWPLSRSELRADIGRPGRPPFHFTVTLFQMAILLMFNENDTLSFEQIQEGTNLTTQHIILSMLPFIKMKLLHQSPPGLESMGLLGTQYKLNLPYKLAKSKVNFAAGVKGDVSLSGSGKADNMDSDNINKELNKERQLFLEACIVRIMKAKRVVSHATLVNECIAESHQRFNAKVSLIKKAIDNLISKEYLQRSRDGESYEYLA

SEQ ID NO: 3340 - protein, 331 aa, Bacillus clausii KSM-K16
MGDLFADIKRQVESHKPSIVLPEGTDERVLQAAAKLAADNVVKPIVIGDNDAILALADKLKITLEGITIYNPETYPGIDEMVDAFVARRKGKETEESARKLLQDVNYFGTMLVYMEKADGLVSGAAHSTGDTVRPALQIIKTQPGIKRTSGVFVMVKEDKKFVFGDCAINISPNEEELAEIATATADTAKLFGIEPKVAMLSFSTLGSASSQETKKVSAATKIAQESRPDLIIDGEFQFDAAFVPAVAQKKAPDSPLKGEANVFIFPSLESGNLGYKIAQRLGGYDAIGPILQGLNKPVNDLSRGCNVDDVYKLSLITGMQAITQKTGQGV

SEQ ID NO: 3341 - protein, 323 aa, Physcomitrella patens subsp. patens
MDRLAALLIALFCLLATVLKVESEGLVYDYYANSCPNAEKIIHDTVYKLYEKKGNIATSLIRYVFHDCFDSCDASVLLESSKGVPAEKESHSQVGMRNGKWINNIKKAVEDSCPGVVSCADVLALGGAAGAQVLGGPAIKLKTGRKDSRVSLKSVADTGIPTPQSNVSFVLDYFSKMGINTEETVALLGAHTIGRAHCVSFEERIYPTVDPKMDPVFASMLKYRCPQQKTGAEPVHFTYFRNDEQSPMAFDNHYYVNLMANQGLLHIDSEIAWDSRTKLFVVEYAKDNALWHKNFATAFTKLSEHNPLTGTQGEVRKHCSYTL

SEQ ID NO: 3342 - protein, 539 aa, Bacillus cereus G9241
MIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFSREETLKKEPLVKQEGLKGGGYYVEYRTDDARLTIEVMKEAIEHGAKAVNYAKVDGFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSTTKHMPISGGHVDGSKGLPAFIAKKAGEGTKYGLTTAQAEEFAKFYGSNVDILFDLAKKHKDEAKEYNMPLDVLIPLVYAMDYEMTAKPVDFFVRRRGAVFFNIHWVYEWKEAVINYMAAKLGWSKEEQMKYTAELEKALTDAVVPVDQQEQAAALA

SEQ ID NO: 3343 - protein, 267 aa, Blastopirellula marina DSM 3645
MSKIGFLGAGQMAQALASGFVRADLVHPADIIAVDPFPAARTSFGQLVPGASVSDSAAKLAAEVDVIVLAVKPQMLQAAIAGLGLIGDNVLLVSIAAGTSLARLAEWTRSTRIIRVMPNTPCLIGESASAFCAGEGATTDDVALVEKLLGAVGVVRKVDEKLMDAVTGLSGSGPAYVYVLIEALADAGVRVGLPRDAALQLAAQTVRGAAGMVLQTGDHPGVLKDRVTSPGGTTIAGLQALEAGGFRSAAYDAVIAATARSKELGAE

SEQ ID NO: 3344 - protein, 152 aa, Prochlorococcus marinus str. MIT 9303
MAVERTFVAIKPDGVQRGLVGEILGRFERKGFKLVGLKQLAPSRELAGEHYGVHRERPFFAGLVDFITSGPVVAMVWEGDGVIASARKLIGATKPLEAEPGTIRGDLAVNIGRNVIHGSDGPDTAQFEINLWFSPEELNAWTPSDQSWRVES

SEQ ID NO: 3345 - protein, 236 aa, Mycoplasma genitalium G37
MDWKTSEMLFPFPVYMAPLTSKFAAYKKKIANWLTVYRIFIALPTIIFIALDNQLGVLANFSVGAISISLQISLLIGGFLFLTAVISDYLDGYLARKWLAVSNFGKLWDPIADKVIINGVLIALAINGYFHFSLLIVFIVRDLVLDGMRIYAYEKKVVIAANWLGKWKTIMQMVGIVFSCFVWSFKQSEIASLNSGLFFWLLTQLPYYLAAVFSIWSFIVYNIQIYQQLKAYNSKL

SEQ ID NO: 3346 - protein, 308 aa, Zea mays
MAEDSVQVIGEVQEVVEVHAGTDQRGRGAMRWTSVMSAFVLRRMCQLISSGVRTDKGFKEVHLNQVAKALQEFIGSEVTGTQVYNHLRKWRQRWMRVAKLRELSGANWDEDLCMISLEDEHYNGHIKAHPKDAEFLNKPIENYKEMMTIFGTGLATGKYAMGSNEALGSPCEVATSSVKTDSLDEDKSGKSVKTDSLGEATKDMKEGSSGVGNKRKRGVLTDEDTLMLSKMTDAVKDVAAAIRETKVEVINPDLYVAVMYMPGFSEEALICAFSHLVDNKAQGDAFVHMTDSHRVLWLRTWLAKNYFL

SEQ ID NO: 3347 - protein, 356 aa, Helianthus annuus
MRPMSLVHSCSIFTGSSFIKTTPINNKPTFKIHQRPTIRSTISAAIVEEEVVELQQKPKPTFNFNAYMLGKGNSVHKALDESIMIKNPPTIHEAMRYSLLAGGKRVRPILCIAACELVGGEEATAMPAACAVEMIHTMSLIHDDLPCMDNDDFRRGKPTNHKVYGEDVAVLAGDSLLAFAFEYVSSRTEGASPARVLAAIGELAKSIGTEGLVAGQVVDIASTGGQDIGLDQLEFIHIHKTAALLEASVVLGAILGGGSDAQVEKLRTFARCIGLLFQVVDDILDVTKSSEELGKTAGKDLLVDKTTYPKLLGLDKSRQFAEELLAEAKQQLEEFESQAAVAPLLALAEYIAYRQN

SEQ ID NO: 3348 - protein, 489 aa, Patagonula americana
  misc_feature (483)..(483): Xaa can be any naturally occurring amino acid
  misc_feature (485)..(485): Xaa can be any naturally occurring amino acid
GSGVSTLEKKNLGRIVQIIGPVLDVAFPPGKMPNIYNALVVKGRDTVGQPINVTCEVQQLLGNNRVRAVAMSATDGLTRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLXMXSHLK

SEQ ID NO: 3349 - protein, 233 aa, Desulfitobacterium hafniense Y51
MDIYGSLSAVRQRIQQAAVKSGRDPSAIKLLAVSKTMSAGTVQRAYEAGQRSFAENRVQEWQDKVTQLPEDCEWHLIGRLQTNKVKYLDERINLIHSLDRLSLLETLESQGAQRNIIWPTLVQVNIARDSQKAGLLAEEVEDFLREAAGCQHIQVYGLMTIGALGASPEDTQGFFRELRLLKERLQQKNLPHVNLKELSMGMSQDFEWAIQEGSTIIRVGRQIFGERIDLNHE

SEQ ID NO: 3350 - protein, 227 aa, Clostridium acetobutylicum ATCC 824
MAKDNLKKISAKKALEYIKDNTVIGLGGGETIGYLCDYLKEKIKSGFNIKVVTPSIKTRNTCIENGIEVLYTSSVEHLDVAFDGCDQLDEKLNALKSCGGIHSKEKIIASMADKYILLTNESKFVKKLDSTYPIVLEILEESAGYVKRRISEIGGKATFRSSAAKDGFTITDSGNLLLDVFFDELGDAKELQKGLKGITGVVETSLFVDLVSQAIIAYEDDIKIISK

SEQ ID NO: 3351 - protein, 334 aa, Photorhabdus luminescens subsp. laumondii TTO1
MKTLGEFIVEKQQDFSHATGELTALLSAIKLGAKIIHRDINKAGLVDILGTSGVSNVQGEVQMKLDLYANEKLKAALKARGEVAGIASEEEDDIVIFEGDRAENAKYVVLMDPLDGSSNIDVNVSVGTIFSIYRRITPIGQPVTEKDFLQPGHRQVAAGYVVYGSSTMLVYTTGCGVHAFTYDPSLGVFCLSHEKVQFPPNGNMYSINEGNYIKFPMGVKKYIKYCQEQDEATQRPYTTRYIGSLVADFHRNLLKGGIYIYPSTASHPSGKLRLLYECNPMAFLAEQAGGKASDGANRILDITPSKLHQRVPFFVGSKSMVEKAESFMAEFPDE

SEQ ID NO: 3352 - protein, 138 aa, Hopea bilitonensis
EKNIPVLLGLLSIWNVSFLGYPARAILPYSQALEKLAPHIQQVSMESNGKGVSIDGVPLPFEAGEIDFGEPGTNGQHSFYQLIHQGRVIPCDFIGSAKSQQPIHLKGEMVSNHDELMSNFFAQPDALAFGKTPEELHK

SEQ ID NO: 3353 - protein, 252 aa, Delftia acidovorans
MVDTNFKDHFSSGSAGYAAYRPTYPTELVDALANISPGLERALDCGCGTGQLSVLLAERFAEVVATDASAAQIDKAQPYDGVTYRAALAEESGLPDASVDLITVAQAAHWLDLDRFYAEVQRVARSQAAVALITYGVLHVEGAVDGAIQRFYYDTIGPYWPTERRHVEDGYRSLPFPFKEVALPPLAIEVQWRLDDLIGYLNTWSAVKAAEKALGSNPVDALAETLHKEWGDPALRHRVTWPLSVRAGHVQK

SEQ ID NO: 3354 - protein, 139 aa, Solibacter usitatus Ellin6076
MSVERTFSIIKPDAVKAGQAGEILAMIQKAGFKIIGLRMTRLTELQAGGFYAVHKERPFYQGLVKFMTEGPIIVMALEREDAVKGLREVMGATNPANAAEGTIRKKFAENIERNCIHGSDAPETAAVELAFFFSSAELL

SEQ ID NO: 3355 - protein, 424 aa, Xylella fastidiosa 9a5c
MSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 3356 - protein, 196 aa, Candida albicans SC5314
MSVPSILATTALLTVGGYMLFTGAGESFNIGEFLESTSPYMWASLGIGSCIGFSVVGAAWGIFITGTSILGAGVKAPRITTKNLISIIFCEVVAIYGLIMAIVFSAKLTSVPSKSLYTKENLYTGYSLFWAGLTVGISNLICGIAVGITGSTAAISDAADSSLFVKILVVEIFGSVLGLFGLIVGLLMTGKAQEFS

SEQ ID NO: 3357 - protein, 248 aa, Zea mays
RGLYASLHIAQSRPNACAKALNEHFKLNRTAEQISNHLKTVKKKYVRINQLRAESGSGWDEDLFMVTMDHEQYTTHFANDKNKGDDEYINKPLPYYGNLATIYGNSTATGRFVKTSNDPLGVDELNTQKEMENIGTPTNGLNDKEGSPPKRDEGGPSRPSKRAKKDECGADPLVQAFQSGAETIANAIEKAAASKGLPNGLFEAVDSLPGFELEHKSRYYSHMLGDPNLANGFMNVPVLYKITRWPIS

SEQ ID NO: 3358 - protein, 138 aa, Hopea odorata
EKNIPVLLGLLSIWNVSFLGHPARAILPYSQALEKFAPHIQQVSMESNGKGVSIDGMPLPFEAGEIDFGEPGTNGQHSFYQLIHQGRVIPCDFIGSAKSQQPIHLKGEVVSNHDELMSNFFAQPDALAFGKTPEELHE

SEQ ID NO: 3359 - protein, 262 aa, Oryza sativa Japonica Group
MAVVASRCTGLLLPDLGASLAGFRRRRSTPASSLSFRPRRARRRLGSLSCIAPPDSAEPQTDEPAAKDDSTEDKAEASSASQDAGNPTFPNKDLSRRIALASTIGAVGLFAYQRLDFGGVSLKDLAANATPYEEALSNGKPTVVEFYADWCEVCRELAPDVYKVEQQYKDRVNFVMLNVDNTKWEQELDEFGVEGIPHFAFLDKEGNEEGNVVGRLPKQYFLDNVVALASGEPTVPHARVVGQFSSAESRKVHQVADPRSHG

SEQ ID NO: 3360 - protein, 338 aa, Escherichia coli CFT073
MIIKRCRELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEAGNIGYKIAQRLGGYRAVGPLIQGLAAPMHDLSRGCSVQEIIELALVAAVPRQTEVNRESSLQTLVE

SEQ ID NO: 3361 - protein, 479 aa, Ustilago maydis 521
MSAEQAKQEEQAQAASTSAATETSTSTTMTVDEAKEEALRQVEFYFHDSNLPFDKFLFTLTRKDPEGWVPIATIASFKRMRAIKDLLGIEGIAQVLRGSKELLDVSEDGANVRRRKELVPVKDAFDRSIYAKGFGDETETLQKELEAFFNTFGKVNSVRMRRDMESSAKPKPFKGSVFVEFAEMDDRNKFLAQAAAVEPEQDGGKGVHFQDTQLVVMSKDAYVKMKMEEKGIDPSSNRINRGSEQTHKKFNAFKEMNKQQRDGSSRAKKDDQEKPKRSDPLEFEYNGKPLTTRPDGTVDPDAVEFPANSVLKFTGAGQGGNWKDLKDTLVTVHPTSFVEFPTGAVEGAVGFKESLSDDKLAEIKSKNITVGGNVVEFVRVDEETAKNFYIERANFRASFMLDRREQDAQRGGSRGNGSYSRGGRGGGRGGRGAKFGRGGGRGGFGRAGGDKRKRDNDSAAAGRDDDAPPTIGKKAKTDE

SEQ ID NO: 3362 - protein, 474 aa, Prochlorococcus marinus subsp. pastoris str. CCMP1986
MKDSEVKNICCIGAGYVGGPTMAVIADNCPSLKVNVVDINEERIKKWNEKDFDRLPIYEPGLAEIIKRCRNKNLFFSIDIKKHIESADMIFLSVNTPIKKSGLGKGQASDLKYIESSTREIAKYAKGETIIVEKSTLPVRTAETIKSILESNDKSFNNQKFSVLSNPEFLAEGTAINDLENPDRVLIGGENPEAITALEEIYVNWVDKNKILKTNLWSSELSKLVANAFLAQRISSINSISAICETTGADINEVSRAIGMDTRIGEKFLNAGPGYGGSCFKKDILNLVYLSKYYGLNEVASYWQKVVDLNVWQQHRIRKIIVKKLFNNLTSKKIGIMGFSFKANTNDTRESPAIQICKDLIEEGADLRIYDPKVNKFQIEKDLEQNQFNDNGEGSWTLCKSIKDIAIDADAIVIATEWEEFKSLDWSDISRLMRSPKWLFDTRGITNSKDIKQHNINYWKIGLGDSSSNIKFNF

SEQ ID NO: 3363 - protein, 308 aa, Prochlorococcus marinus subsp. pastoris str. CCMP1986
MIKPNRLANKNFLSSLDITTDEVFHILDLSKKFKNKKLNINLHNKVLGLIFDKSSTRTRVSFQVAMSRLGGTTIDLNPTTSQIERGEPIKDTARVLSRYCDVIAIRTFNHADLEEYARWSTKPVINALTDLEHPCQALADFLTIYEEFLDFKDVVLTFIGDGNNVANSLILCGALLGVEVRIACPKGYEPNSMVINKAYEIYKNRNLLKITNDPDTAVLGANVLYTDVWSSMGEENQKAEKDKVFNGFTIDNDLVSKADKEAIILHCLPAYRSKEITDEVFESKKNRIFDQAENRMHVQQALLSCLLY

SEQ ID NO: 3364 - protein, 340 aa, Mycoplasma genitalium G37
MIGAKTRVAIVGGIGYIGSCFASFIKEQNDKLIVTVIDNNKNNHVIKLLKKIGIEFYFADLLDRHKLTEVIAAIQPDVVFHFAAKTSVSESVHNPLKYFDCNVIGTLNLISAISNLQKPIKLFFASSAAVYGQTTNSYISEEIVITETQATNPYGLSKFLDELILNAVAKNSQLQVVCLRFFNVAGAILPFGNFNGNTTLLIPNLVKAFLKQTPFFLYGNDYATKDGSCIRDYIHVYDICNAHFLLWKWLNDHRQIKFETFNLGSGIGTSNLEVIDIAKKVFYPSRLNLEIRPKRSWDPAILVANVAKAKQTFQFKITRNLKDMISDERNFYENFYNDAY

SEQ ID NO: 3365 - protein, 162 aa, Ustilago maydis 521
MSNVFFDITKNGSPLGRITFKLYDDVVPKTAKNFRELCTGAHGFGYEGSSFHRVIPDFMLQGGDFTAGNGTGGKSIYGAKFEDENFKLSHTKPGLLSMANAGPNTNGSQFFITTVVTSWLDGKHVVFGEVVEGLDIVKAIENEGTKSGKTKSKITIAKSGVL

SEQ ID NO: 3366 - protein, 123 aa, Paxillus involutus
  misc_feature (28)..(28): Xaa can be any naturally occurring amino acid
  misc_feature (89)..(89): Xaa can be any naturally occurring amino acid
HSFYQLVHQGTKLIPSDFLAPATSHNPXADSKHHRILLSNFFAQPEALAFGKTEEEVRKELGSGASEALVKSKVFEGNRPSNSIMFPLXTPRTLGALIALYEHKIFTQGVIWGINSFGMLDVV

SEQ ID NO: 3367 - protein, 615 aa, Francisella tularensis subsp. tularensis SCHU S4
MSKYTILDKINTPSDLKLIPESQLKILSAELRAFLVDTLDVSGGHFASSLGATELTVALHYVYNAPYDNIVWDVGHQTYIHKILTGRKDKLVTIKKDGGISGFPKRSESEYDTFGVGHSSTSISAALGMAIADRLQGKSSNTVAVIGDGAITGGMAFEALNHAGGIKEDILVILNDNEMSISDNVGGLSAHFSKIISGGFYNSIREKGKEVLKNIPPIFEFVKKVETQTKGMFVPANFFEDLGFYYVGPIDGHDVTELVKTLRILKDHKGPKLLHVITKKGKGYTKAESDPIKFHHVAPSFHSGENITTKISKPTYSNIFGDWICQKAAKDKRLVGITPAMKEGSDLIRFSQLYPHRYFDVAIAEQHAVTFAGGLACQGLKPVVAIYSTFLQRAYDQVIHDIALQNLDVLYAVDRAGLVGADGATHDGSFDLAFMRCIPNHVIMTPSDENEAYHMLEFGYEYNGPAMVRYPRGAGIGAEITGSLDLELGKAKIVKQGSKIAILNFGTLLPLAKQLAEKYHATVIDMRFVKPLDEIMLDKVSQTHEIILTLEENCIAGGAGSAVNEYFVAKDLSNKIIVRNFGLQDKFLNHGTKDLLLAQSKLCVENISQELDKLI

SEQ ID NO: 3368 - protein, 516 aa, Francisella tularensis subsp. tularensis SCHU S4
MTDIHNHKILILDFGSQYTQLIARRVREVGVFCEIFPHDVAADFIKNYQAKGIILSGGPESVYDSDVKAPEIVFELGVPVLGICYGMQTMVMQHGGEVKGADQSEFGKAIINILNSTNNIFSNMEHEQLVWMSHSDKVTQTGEHFEIIASSTNAPVAAVAHKNKPFFGVQFHPETTHTENGKQIIENFVVNICGCDTLWNIENIIENDIKEIKQKVGTDKVILGLSGGVDSSVVAAILHQAIGDQLTCIFVDTGLLRLNEGDQVMQVFAEHMDINVIRINAKNRFLDALRGICDPEQKRKIIGKLFVDIFDEEAAKIENAKWLAQGTIYSDVIESAGNNQSKAHVIKSHHNVGGLPKEMKLKLLEPLRELFKDEVRKLGLGLGLPYNMLYRHPFPGPGLGVRILGEIKKEYVETLQKADAIFTEELYKHNLYHDVSQAFGVFLPVKSVGVVGDQRRYEYVIALRAVVSIDFMTATWANLPYDFLSLVSNRIVNEVKQVSRVVYDVTGKPPGTIEWE

SEQ ID NO: 3369 - protein, 123 aa, Paxillus involutus
  misc_feature (18)..(18): Xaa can be any naturally occurring amino acid
  misc_feature (28)..(28): Xaa can be any naturally occurring amino acid
  misc_feature (89)..(89): Xaa can be any naturally occurring amino acid
HSFYQLVHQGTKLIPSDXLAPATSHNPXADSKHHRILLSNFFAQPEALAFGKTEEEVRKELGSGASEALVKSKVFEGNRPSNSIMFPLXTPRTLGALIALYEHKIFTQGVIWGINSFGMLDVV

SEQ ID NO: 3370 - protein, 176 aa, Photorhabdus luminescens subsp. laumondii TTO1
MSLNLVPAGKELPEDIYVIIEIPANADPIKYEIDKESGALFVDRFMSTTMFYPCNYGYINNTLSLDGDPVDVLVPTPYPLQPGSVIRCRPVGVLKMTDESGEDAKLVAVPHSKLTKEYDHIKDVNDLPELLRAQITHFFEHYKDLEKGKWVKVDGWDNVEAAKAEIISSFERAAKK

SEQ ID NO: 3371 - protein, 123 aa, Paxillus involutus
HSFYQLVHQGTKLIPSDFLAPAASHNPIADSKHHRILLSNFFAQPEALAFGKTEEEVRKELGSGASEALVKSKVFEGNRPSNSIMFPLMTPRTLGALIALYEHKIFTQGVIWGINSFGMLDVV

SEQ ID NO: 3372 - protein, 102 aa, Mycoplasma genitalium G37
MVTEIRSLKQLEEIFSAKKNVIVDFWAAWCGPCKLTSPEFQKAADEFSDAQFVKVNVDDHTDIAAAYNITSLPTIVVFENGVEKKRAIGFMPKTKIIDLFNN

SEQ ID NO: 3373 - protein, 384 aa, Solibacter usitatus Ellin6076
MKIHEYQAKAILAQYKVPVPRGHVAYTEADAETAAKTLGGSVVVKAQIHAGGRGKGGGVKVAKDAAEALELAKKILGMTLVTHQTGPEGRLVQRLLIEETLPIERELYLGIVLDRVQGKPVFMASSAGGMDIEEVAAKTPELILKETLEYPGLSPYQARKLAFGIGIPAASVNAAAAAMTALSKAYWAMDASLAEINPFILTTDGKVYALDAKITFDDNALYRHKELVELRDLNEEDPLEVEASKHGLNYIKLDGTVGCMVNGAGLAMATMDIIKFAGGSPANFLDVGGGANAEQVKNAFRILLSDHSVKAVLINIFGGILRCDTLATGVVAAARDLNIQVPIVVRMEGTNVEAGRQILLESGFNFTVGADMWDAAQKVVKLAA

SEQ ID NO: 3374 - protein, 489 aa, Saccellium lanceolatum
GFGVSTLEKKNLGRIVQIIGPVLDVAFPPGKMPNIYNALVVKGRDTVGQPINVTCEVQQLLGNNRVRAVAMSATDGLTRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLK

SEQ ID NO: 3375 - protein, 142 aa, Oryza sativa Japonica Group
MGIHEHVEGIKAHWAKNFSFLDYFKKVYGRDKPLPKWTDADVDEFIASDPVYGPQLKAMRESRKFALGGALVGGAHLGGIALKYSKAPHGVVLATGFGAICGAVVGSEVAEHWYQLYKTDKQGANLRFIYWWEDKVAGNQKS

SEQ ID NO: 3376 - protein, 335 aa, Erwinia carotovora subsp. atroseptica SCRI1043
MQPFYKRHFLRLMDFTPAEIAHLLALSTKLKADKKNGIETRRLQGKNIALIFEKDSTRTRCSFEVAAYDQGAQVTYLGPSGSQIGHKESIKDTARVLGRMYDGIQYRGYGQQIVETLAQYAGVPVWNGLTNEFHPTQLLADLLTMQEYLPGKALSDMTLVYVGDARNNMGNTMLEAAALTGLDLRLVAPKACWPDAGLVAECQAAAKQTGGSITLTEDIAAGVAGADFIYTDVWVSMGEPKETWKERIALLKPYQVNMAMIAATGNPQVKFLHCLPAFHDDQTTMGQQMAEQYGLHGGMEVTDEVFESAHSIVFDQAENRMHTIKAVMVATLAQD

SEQ ID NO: 3377 - protein, 123 aa, Paxillus involutus
  misc_feature (18)..(18): Xaa can be any naturally occurring amino acid
HSFYQLVHQGTKLIPSDXLAPATSHNPIADSKHHRILLSNFFAQPEALAFGKTEEEVRKELGSGASEALVKSKVFEGNRPSNSIMFPLMTPRTLGALIALYEHKIFTQGVIWGINSFGMLDVV

SEQ ID NO: 3378 - protein, 146 aa, Brucella melitensis 16M
MKYQKSAEAIAKLSAEQYRVTQENGTERPGTGEYLYNKEPGIYVDIVSGEPLFASSDKYESHCGWPSFTKPIERANVTELTDMSHGMVRTEVRSAHGDSHLGHVFPDGPVDRGGLRYCINSASLRFVPKDRMEAEGYGDYLDQVEG

SEQ ID NO: 3379 - protein, 221 aa, Medicago truncatula
MSKGDNVVVLDFWASPFCARVKIALEEKGVPHVDNEEDLFGKKSELLLKSNPIHQKVPVFLHNDKPVLESGIIVSYIDQVWSSNPLLPADAYDLAQARFLADFIDKKVFDTGRSIWASNGEEREVGTRDFIEVLKHLEEALGEKDYFGGDVFGYVDIIAIPHSAWFLAYEKLGNFKVEDHSPKISAWIKRSLQRESVKKVLPDPEKVYQFVLHFRKISGLE

SEQ ID NO: 3380 - protein, 116 aa, Arabidopsis thaliana
MGESSGSSSSLAAINSSNIGFQLLKKHGWKEGTGLGIAEQGILVPLQAEPKHNKRGLGAKQPAKRKVAQPQAKDEEVSKQSKKLSKKMRKMMEHEKHLQEKEFERAFFREFWPDNV

SEQ ID NO: 3381 - protein, 138 aa, Parashorea lucida
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 3382 - protein, 325 aa, Burkholderia xenovorans LB400
MNTSTQARAKGRVVILGIYVTDLTFRAGRMPQIGETIAGSAFAMGPGGKGSNQAVAAARAGADVVFCTRIGNDAFGAIARATWAAEGITARASVIEGVSTGAAHIFVDDNTGMNAIIVASGAAGTMEPADVDAIEADIAAARVFVTQLEQPLEAARRGLEVARRHGVITVFNPAPALPLDDGIFPLCDYITPNETEATALTGVPIANADDARRAADVLLAKGVGTVIVTLGEGGALLHSAAQSILVPAYHCGRVVETAGAGDGFTGGFAAALARGDDAMTALRFGCALAGISVTRPGTAPSMPTLDEVNQVLKQPNQPAGVSQPC

SEQ ID NO: 3383 - protein, 796 aa, Burkholderia xenovorans LB400
MSVAEYFSSMEYGPAPEDDQPARAWLAQHEERFGHFIGGAWHAPAAGERFASHAPATGERLADIAQGDAADIDAAVAAARAAQPGWFALGGAGRARHLYALARMVQRHSRLFAVLEALDNGKPIRETRDIDVPLVARHFLHHAGWAQLQESEFADYAPLGVVGQIVPWNFPLLMLAWKIAPAIATGNCVVLKPAEYTPLTALLFAELAHRAGLPAGVLNVVTGDGRTGAALVEHPQVDKIAFTGSTEVGRLIRSATAGSGKSLTLELGGKSPFIVFDDADLDGAVEGVVDAIWFNQGQVCCAGSRLLVQEGVEARFIAKLKRRMATLRVGTSLDKSIDLGAIVDPVQLERIQSLVETGRREGCSVWQSPETTMPSGGCFYPPTLVTGVAPASTLAQEEIFGPVLVTMSFRTPDEAIALANNSRYGLAASVWSETIGRALDVAPRLACGVVWINATNLFDAAVGFGGYRESGYGREGGREGIYEYLKPRAWLNLAERRTARSAGGSAATVDALSNVTSIDRTAKLFIGGKQARPDSGYSLPVHAPDGTPVGEVAAGNRKDIRNAVEAARAAQKWSQASTHNRAQVLFYLAENLAVRGDEFVRQLMVRNGAAQAAARAEVDASVQRLFTYAAWADKFDGAVHTPPLRGVALAMHEPLGVIGIACPDEAPLLGFISLAAPALAMGNRVVVLPSEASPLTVTDFYQVAETSDVPGGVLNIVTGERGALLPALAKHDDVDAVWCFGGAADWTLVERESVGNLKRTFVDHGRQFDWFDRSSEGRPFLRQAVQVKNIWIPYGD

SEQ ID NO: 3384 - protein, 759 aa, Escherichia coli CFT073
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKSGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 3385 - protein, 785 aa, Nostoc punctiforme PCC 73102
MSNRFSRRKFVKFAGGVIAGSAAVGSAPLVNLLAANAQSSTGYKVVGYFENWSQYRQGGGKFLPAQIDPSLYTHINFAFGIFGYITKGIAPNNPRLTGDYRIQPIEWNDQTVLYPEIQKLKLKNPNLKTLLSIGGWGFNDPQDPIQIGTYTYNLFSQMAASAAGRQQFIYSALEYAQKYKFDGIDLDWEYPGYQGRGGRPEDFANFLALVREFRTAISGRNFLLTIASSAIVPSGVPDQYRSNPGSYFQWLAQCAQYLDWLNVMSYDYHGAFPDDKVTGMNAPLPQDSTPKGPFSVKNTIEAYLAAGIPNSKIVMGIPTYGRTFKVSSPLSLTDNGPGKSYSSVGPAGISTVTPGVLSYYEIQNRISSGSLTRRWHEPTLTPYAYNSQTSEWVSYDDTESIGYKTSYLIEKKLGGAMIWAIGLDQFQSGFPLIKRVKSILDNPALRPKLPSYFVSGGRRYNQYSFLCTHNSFANSDENWTAANQFNTITKQLNDGVRALMLDIYNAEFDSLLGGKGVYLLHNFNPNASFPGINYALPLKHLYDALNEVVAFLKNNRNEVVTIFLEDYVYPDTNKLKEELDKVTGLKELIYDPDNNPNWSVRVTGEWPLLSEMIEWNKRLIIFSDKNHNNLTTKIGVAYDRNYILQNFWSLGVGGTDWDCQSRWRDGYHYQIVPEGTPYSQWRYADPQLHPKVVEKKSALFLFNHFRDTPTRITAALDNTYDKIMDRIENRCCNSAFLPKEKTTKQLPNFVAVDFWQEPVLYNNKAANVVQELNRRWENKLGCANR

SEQ ID NO: 3386 - protein, 212 aa, Ashbya gossypii ATCC 10895
MTSPCTDIGTAIEQFKQNKMIIVMDHISRENEADLICAAAHMTAEQMAFMIRYSSGYVCAPMTNAIADKLDLPLMNTLKCKAFSDDRHSTAYTITCDYAHGTTTGISARDRALTCNQLANPESKATDFTKPGHIVPLRARDGGVLERDGHTEAALDLCRLAGVPEVAAICELVSERDVGLMMTLDECIEFSKKHGLALITVDDLKAAVAAKQ

SEQ ID NO: 3387 - protein, 233 aa, Gibberella zeae PH-1
MPRPKKSSSTEITIHVYDLLPPGRLSSVLWTVGASLLHSGVVINGKEYAYGGHDKRGLTGVYWTKPKTEPPGGTFRCEILHGFTLATEQEIEATLRAASDEFLGTSYNLLTKNCNHFTSYLCKRLTGQSGPGWLNRAASIGVALPCVVPRDWIEPPEYDTSEGALLDDYDNSNETTGMLKSTNPHLLTDSNDDSGDDDWNSEDERRRGGSGKGKQALRDTAGRRLPPAERALR

SEQ ID NO: 3388 - protein, 659 aa, Escherichia coli CFT073
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAVGKVKATAHKCDLCAGRENGPACVENCPADALQLVTDAALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVAVTVYDRHPEIGGLLTFGIPSFKLDKSLLARRREIFSAMGIHFELNCEVGKDVSLNSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCRIRFLRTRLGEPDAQGRRRPVPVEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 3389 - protein, 394 aa, Gibberella zeae PH-1
MPPKKQVVEEKIPLGRPGNNLKSGIVGLANVGKSTLFQAITKSNLGNPANFPYATIDPEEARVVVPDDRFDWLVEKYKPKSVVPANLTVYDIAGLTRGSSTGAGLGNSFLSHIRAVDAIFQVVRCFDDAEIIHIEGDVNPTRDLDIISEELRLKDIEFTEKALENQKKKTRMGGQSLEQKKAVQDQATLEKVLAWLNDGKDVRKGNWGPKEIEVINPLFLLTAKPVVYLVNLSEKDFIRKKNKHLPKIVEWINENAKGDPLIPISVSYESRLTLCETEAESKEEQKTAGADSVLPKVILQMRKTLQLGSFFTVGPDEVRQWTIRNGTKAPQAAGVIHNDFEKTFIQALVFNYNILKELGDESEVKAKGKIMTKGKEYVMEDGDIVHFKAGAAKG

SEQ ID NO: 3390 - protein, 375 aa, Ashbya gossypii ATCC 10895
MSFAGSLIISAISGVIYKYGGQEFQAIEEVPMGLRELTVGFVQDRILLITSRATNIATNATPDFFRDQAYRYPVRALIRSCTTRRYFVVNISIFVFYSAIYVVITVIYFLTIFPVYLGLSVILGPAGIVMAWLHMLLHTNNLAMMVLRMSQVSRYTLKNALKVNGNIELLENPPVPVKLFYPLDTPYFWMNHFPWKMLEYMGGAFTMVVLLLVSAIPVFGPVFFNILISPFVTRLYLAKYLRLRGFNNIQREERFYDNFGQYVAFGLVATCLEIPPFLSGITYATNNIAVALWDPEKEPSFLSAEDDDDDETDDDDDDDDEDDDDDDEDDEDDDDDEDDDDEDDDDEDDEDDDEAVSDSSSSSDDSPSEKEELSP

SEQ ID NO: 3391 - protein, 404 aa, Vibrio vulnificus CMCP6
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 3392 - protein, 173 aa, Francisella tularensis subsp. tularensis SCHU S4
MLKNIPCGKDIPNDFNVVIEIPQDSDPIKYEFDKNSNMIVVDRFMSSTMRYPCNYGFVPNTLYDDGDPIDVLVLAPYPLAVGCVINCRAVGVFKMEDDGGVDAKVIAVPSSKLTKEYDHINDVDDLPVSLKQKIEHFFTHYKDLDSGKWVKVEGWDNAAFARKEIEKSVKNYK

SEQ ID NO: 3393 - protein, 56 aa, Triticum aestivum
RIFLNLISAPEGIQCICKRFPSLKIVTSEIDYGLNEEFRVIPGLGEYGDRYFGTDN

SEQ ID NO: 3394 - protein, 182 aa, Shewanella sp. MR-7
MSGPLRTYQGIHPQLGDNVYVDPASVLVGDIALDTDASIWPMVAARGDVNHIRIGKRSNVQDGSILHVTRKSASRPEGHPLLIGDDVTIGHKAMLHGCKVGNRVLVGMGAIILDGAILEDDVILGAGSLVPPGKVLQSGYLYVGSPAKQARPLTEAELKFLPESADNYVRLKNEYLAEPQPE

SEQ ID NO: 3395 - protein, 91 aa, Triticum aestivum
  misc_feature (39)..(39): Xaa can be any naturally occurring amino acid
  misc_feature (54)..(54): Xaa can be any naturally occurring amino acid
  misc_feature (64)..(64): Xaa can be any naturally occurring amino acid
QKVRTHVEEAQGGHEQLEPDGDQRVEFPPFLAELVLLRXECHESDNHRQDDFAXQTCCPVWSAXGIRSVRLYARDGEVLRSVKLLMRFEFS

SEQ ID NO: 3396 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 3397 - protein, 294 aa, Idiomarina loihiensis L2TR
MVKKVVIPVAGLGTRMLPATKAIPKEMLPLVDRPLIQYIVEECAAAGLTDVILVTHSSKNSIENHFDTSFELETTLEQRVKRQLLAEVKAICPEKTTIMHVRQGVAKGLGHAVLCARPLIGDEPFAVVLPDVLVDDASCKLNRDNLAEMVKNFEASGHSQVMVEKVPQQDVNKYGIADINGAELSPGEQAGITQLVEKPSVEDAPSDLAVVGRYVFSADLWSLLEKTPVGAGNEIQLTDAMAMLLEKQPVNAYYMKGKSHDCGNKLGYAQAFVEHALRHPDLGADMKAYIQSLK

SEQ ID NO: 3398 - protein, 514 aa, Shewanella sp. MR-7
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 3399 - protein, 342 aa, Photorhabdus luminescens subsp. laumondii TTO1
MNLSKNILQTIGNTPVVMLNGRYTKGINVFLKMENINPGGSIKDRIAVAMLERAEAQGELRPGMVVIEPSSGNTAIGLAMACAVKGYRFIAVLDRMVPAAKRDKIKAFGAEIIFLPEFEAGKDTVKYRIDLTKEIIKVYPNAFSPMQFENQVNPDEHYRSTGRELYEIFGNNLTACFATAGSCGTLTGISRYLKEKDPQVRIYGVEPVGSIIFGGEPGKYLVQGAGLAFIPSILDRTNIDITLKVADIDAFRVARKLARNEGILIGGTGGCAVSAALNRLDDFKPGDNIVVIIPDSGERYIDTIYNDAWLFENNFSELIEESKTEPQLEEIITNMGCVLNEF

SEQ ID NO: 3400 - protein, 375 aa, Brucella suis 1330
MKFKAAVLDRHGVERPYNQTKPLVIREIELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 3401 - protein, 138 aa, Shorea faguetiana
EKNIPVLLGLLSIWNVSFLGYPARAILPYSQALEKFAPHIQQVSMESNGKGVSIDGVRLPYEAGEIDFGEPGTNGQHSFYQLIHQGRVIPCDFIGSAKSQQPIHLKGEVVSNHDELMSNFFAQPDALAFGKTPEELHK

SEQ ID NO: 3402 - protein, 333 aa, Oryza sativa Indica Group
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEIAVEKFSEATIGYKKDKEVATRWAKLFTTPYFLVSVVEDIEGVELCGTLKNVVAIAAGLVDGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYSEHTPNLSIINGSNAYY

SEQ ID NO: 3403 - protein, 127 aa, Triticum aestivum
  misc_feature (53)..(53): Xaa can be any naturally occurring amino acid
WIPRAAGIRHQQYSSSLATSSLSSAPSQDAYLDQRLVAAKRCSKEAAMAGAKXAAAVATIAAAIPTLASARMLPWARAHLNPTGQALIISTVAGMAYFIVADKTILSMARKHSYETAPEHLKNTSFH

SEQ ID NO: 3404 - protein, 138 aa, Shorea maxima
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKNQQPIHLKGEVVSNHDELMSNFFAQPDALAFGKTPEELHK

SEQ ID NO: 3405 - protein, 501 aa, Lachancea kluyveri
MESRLGWLTELQTETGANLRRTSIIGTIGPKTNNPETLVALRKAGLNIVRMNFSHGSYEYHQSVIDNARKSEELYPGRPLAIALDTKGPEIRTGTTTNEVDYPIPPNHEMIFSIDDKYAKACDDKVMYIDYKNITKVIEKGKIIYVDDGVLSFEVLEVVDEQTLKVKSLNAGKICSHKGVNLPGTDVDLPALSEKDKSDLRFGVKNGVHMVFASFIRTAQDVLTIREVLGEDGKDVKIIVKIENQQGVNNFDEILKVTDGVMVARGDLGIEIPAPQVFAVQKKLIAKCNLAGKPVICATQMLESMTYNPRPTRAEVSDVGNAVLDGADCVMLSGETAKGNYPINAVTIMAETALIAEQAIPYVATYDDLRNFTPKPTSTTETIAAAAVSSVFEQKAKAIIVLSTTGDTPRLVSKYKPNVPIVMVTRNPRAARFSHLYRGVFPFVYESDTESEWTKDVESRLNFGIAKAKEFGMLKEGDTIVTIQGFAAGVGHSNTLRVLTV

SEQ ID NO: 3406 - protein, 501 aa, Saccharomyces castellii
MESRLARLTTLQVTAGDNLRRTSIIGTIGPKTNNPEVLVALRKAGLNIVRMNFSHGSYEYHQSVIENARKSEELYPGRPLAIALDTKGPEIRTGTTTGEVDYPIPPNHEMIFSTDEKYAKACDDKVMFVDYANITKVISKGKIIYVDDGVLSFEVLEVVDGKTLKVKSLNAGKICSHKGVNLPGTDVDLPALSEKDKADLRFGVKNGVHMVFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAILDGADCVMLSGETAKGNYPINAVTTMADTALIAEQAIAYQPLYDDLRNLTPKPTSTTETVAASAVAAVYEQKAKAIIVLSTSGTTPRLVSKYRPDCPIILVTRNPRAARFSHLSRGVFPFVYEADSVADWTEDVELRLKFGIEKAIEMGVMKKGDTYVSIQGFKAGEGHSNTLQVSNA

SEQ ID NO: 3407 - protein, 138 aa, Shorea patoiensis
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFICSAKSQQPIHLKGEVVSNHDELMSNFFAQPDALAFGKTPEELHK

SEQ ID NO: 3408 - protein, 256 aa, Mycobacterium sp. KMS
MQVAIVTGASSGIGFGCATTLAEQGMAVLGTGRDEERLAELEKAVGSDRIATVAVDLTDDDGPARVVAAALERWGRIDFLVNNAGVGSPKPLHETDDESLDYFLNLMLRAPFRLSRDVIPHMQPGSAIINVTSTFAVVGGLRGGAYSAAKGGLTALTAHIACQYGAQGIRCNAVAPGVTLTPMVATRLEDERFRKINTEMTPHQRLGRVEDIAATVAFLCSEGGSFINGQTIVVDGGWSSTKYLSDFALNSDWVPR

SEQ ID NO: 3409 - protein, 259 aa, Xylella fastidiosa Temecula1
MVAVNLKTKEEIEQMRIAGRLAATVLDVVAPYVKPGVTTAELDQICHNYIVTVQGAIPANLGYRGFPKTICTSVNNVICHGIPSDAKVLKDGDIINIDVTVIKDGWHGDTSRMYYVGNPSVMARRLVETTYEAMWRGIRAVKPGATLGDIGHAIQTYAENERFSVVREYCGHGIGKVYHDNPQVLHYGRPGEGLVLESGMTFTIEPMINEGTRHHKVLPDGWTVVTKDRKLSAQWEHMIAVTEDGVDVLTLSPNDIGST

SEQ ID NO: 3410 - protein, 779 aa, Thiobacillus denitrificans ATCC 25259
MSRDYIVPLDALSMADVPRVGGKNASLGEMISRLADAGVKVPGGFATTAQAFWDFLDHNGLRARIGAVLDALDVTDVTALAAAGAEIRAAVEGGRLPPALESGLREAYAALGDDVSVAVRSSATAEDLPDASFAGQQETYLHVRGAEALLAHLKKVFASLYNDRAIAYRVHHGFAHADVALSAGVQRMVRADTGCSGVLFTLDTESGFRDVVFITAAYGLGETVVQGAVNPDEFYVHKPTLALGFPALVRRERGEKAIRMVWRDGKTVIEDTPPELRQRFALSDAEVLELARQAVQIERHYGRPMDVEWAKDGVSGELFIVQARPETVKARAAAGGERYVLGGTGEVRVSGRAIGQKIGAGPVRVIATPAEMNRVQRGDVLVTDMTDPDWEPVMKRAAAIVTNRGGRTCHAAIVARELGIPAVVGAGDATTVLRDDEAVTVSCAEGDTGFVYAGRLPFEVETLASESLPTPPVKLMMNVGNPERAFEFAQIPNHGVGLARLEFIIARMIGVHPLALLDHAGQPQGVRDEIAARAAGYADPVAFYVDKLAEGIATLAAAFWPQPVIVRLSDFKSNEYANLVGGERYEPKEENPMLGLRGAARYVSTLFRPAFELECRALKKVRETLGLGNVEVMIPFVRTVEECAAVVALLAANGLRRGEHGLRLIMMCEIPSNVLLADDFLRHVDGFSIGSNDLTQLTLGIDRDSGLVAEGFDERNPAVRKLLAEGIAACRRNGKYIGICGQGPSDHPDLAQWLVEQGIGSISLNPDTVVATWKRLAHG

SEQ ID NO: 3411 - protein, 128 aa, Zea mays
  misc_feature (34)..(34): Xaa can be any naturally occurring amino acid
  misc_feature (44)..(44): Xaa can be any naturally occurring amino acid
  misc_feature (48)..(48): Xaa can be any naturally occurring amino acid
  misc_feature (82)..(83): Xaa can be any naturally occurring amino acid
  misc_feature (102)..(102): Xaa can be any naturally occurring amino acid
  misc_feature (104)..(104): Xaa can be any naturally occurring amino acid
  misc_feature (112)..(112): Xaa can be any naturally occurring amino acid
MGLTRVGLAGLAGMGQNLALNIAEKGGGEAGYNXLSSKGDETVXRAKXKGDLPVCGVHDPACFVSSIQKPRVRIMRVKAWAXXGQTIATRAAHLDRGDCVGXGXNEWDENTXRREKAMEERGLLYLGM

SEQ ID NO: 3412 - protein, 407 aa, Prochlorococcus marinus subsp. pastoris str. CCMP1986
MTRFNFDVITLFPKAFELINNLGVITRALEKNLINVNLHDLREYGEGNYRQVDDKPYGGGSGMVLKPEPIYKAHDSIDKLPNSKTLLMTPQGKVLKQQDLLRWSSLDQLIIICGQYEGFDERVRCLADEEVSIGDYVLSGGEIPSISIINGLTRLLPGTLGDPGSLIDESHNSSLLEYPHYTRPLIFREMRVPDILVSGNHEEIKLWRKQKMLERTLDRRNDLISNDDYKKLPKSKRINRDSNEIMKFRIGNGYDIHRLVEGRDLIIGGVKMQHPDNLGLDGHSDADVLSHSIMDALLGALSLGDIGKYFPPSDQKWKNADSLFLLSKVIELIRKEGWEVNNIDSVIVAERPKIKPHVQLMKNNISNTLQINGSFIGIKATTNEKLGPEGREEGISCHSVVLLEKKE

SEQ ID NO: 3413 - protein, 427 aa, Thiobacillus denitrificans ATCC 25259
MSAIIDVIAREILDSRGNPTVEADVLLESGVIGRAAVPSGASTGSREAIELRDGDKSRYLGKGVLKAVEHVNTEICEAIIGLDVEDQAFIDQTMIELDGTENKSRLGANALLAVSMACARAAAEQAGLPLYRYLGGAAPMQLPVPMMNIINGGAHANNNIDMQEFMVIPVGAPSFREALRYGAEVFHALKKLLDDAGMTTTVGDEGGFAPNLESHEAALKLIVQAIEKAGLQPGIDVAIGVDCASSEFYKDGLYHIDSENLKLTSAAFTDYLAAWCDKYPIISIEDGMAEGDWDGWKILTDRLGRRVQLVGDDLFVTNAKILKEGIEKDIANSILIKVNQIGTLSETFQAIEMAKQAGYTSVISHRSGETEDTTIADLAVATNARQIKTGSLSRSDRMAKYNQLLRIEEELGDTASYPGRDAFRQRG

SEQ ID NO: 3414 - protein, 365 aa, Solanum lycopersicum
MAFLATISGLDNLFLSNTPNNNFAFSRKLPPSQSYSFLHKKIHASDVANSFQTFQVKERDVSSKAEKFILPEFEFQEYMVTKAIKVNKALDEAIPMQEPIKVHEAMRYSLLAGGKRVRPILCMASCEVVGGDESLAIPAACAVEMIHTMSLVHDDLPCMDNDDLRRGKPTNHKIFGENTAVLAGDALLSLAFEHVATKTQNVPPQRVVQAIGELGSAVGSEGLVAGQIVDLASEGKQVSLTELEYIHHHKTSKLLEAAVVCGAIMGGGNEVDVERMRSYARCIGLLFQVVDDILDVTKSSDELGKTAGKDLITDKATYPKLMGLEKARQYAGELMAKAMNELSYFDYAKAAPLYHIASYIANRQN

SEQ ID NO: 3415 - protein, 326 aa, Bradyrhizobium sp. BTAi1
MTCFQTIAVIGAGAWGTALAAVAARAGRDVTLYARDADHASHIASARENPRLPGIPLASRIAVTADLARAARADTVLIVVPAQHLRGAVMHVAPLLAPGTPLVACAKGIEHGTHKFMTEVIAEAAPCATPAILSGPSFAHDVARGLPTAVTLAAPDEALAAALVQALGSPTFRPYHSTDVRGVEIGGAAKNVLAIAAGIVAGRQLGASALAALTTRGFAELVRLGRAHGARSETLTGLSGLGDLILTCAGPQSRNFAAGLALGRGEPLPAGKLAEGQYTAPVLVELAAARGVEMPVAQAVAAILAGAVTIDAAIEALMLRPFKAEE

SEQ ID NO: 3416 - protein, 363 aa, Solanum lycopersicum
MRSMNLVDSWGQACLVINQSLPYNSFNGLMKINSKNRKILKQSLSYRTFSSLTVSAIATNEKVVMEKEEFNFKVYVAEKAICVNKALDEAIMVKDPPKIHEAMRYSLLAGGKRVRPMLCLAACELVGGNQGNAMAAACAVEMIHTMSLIHDDLPCMDDDDLRRGKPTNHKVYGEDVAVLAGDALLAFAFEYLATATTGVPPSRILVAVAELAKSVGTEGLVAGQVADLACTGNPNVGLEMLEFIHIHKTAALLEASVVIGAILGGGADEEVDKLRRFAQCIGLLFQVVDDILDVTKSSSELGKTAGKDLAVDKTTYPKLLGLEKAKEFAAELNGEAKQQLAAFDSHKAAPLIALADYIANRQN

SEQ ID NO: 3417 - protein, 357 aa, Acinetobacter sp. ADP1
MTDLKFTDLVEPVVIDKKTALRVTVLGGGSFGTAMANLATRNGCNTMIWIRDQKMADEINQTHFNQRYLPDFNLEPELKAVSDLELAVRDRDIIFVAIPSHSFREVVKQISPYITAQAIVSLTKGIEANTFSFMSDIIREELPEVPYGVLSGPNLAKEIVAGMPSGTVIASDSELVRYAVQHALHSALFRVFGSDDVHGVELGGALKNIYAIAMGMAAAYNIGENTKSMIITRALAEMSRFAVKLGANPLTFLGLSGVGDLFATCNSPLSRNYQIGYALGSGKTLDQAIKALGQTAEGINTIVQVRTRAIELDVYMPITNALYEVIFEGAPPLNIALALMKNGHRSDVEFVLPHHQV

SEQ ID NO: 3418 - protein, 504 aa, Chlamydomonas reinhardtii
MASPVPPRLLYIGGEWVAPVKGGSLPVINPATEKEFARIPNATSEDVDAAVAAATAAFKSGHWSKTTGAYRAKYLKAIATKLREHKAVLAKAETMDCGKPIDEASWDMDDVATCFDYYAGQAEALDGRNGAAPAIDVGMSEFDVRVRREALGVVGLITPWNYPLLMAAWKVAPALAAGCTAVLKPSELASLTCLELAAIAAEVGLPPGVLNVITGTGQDAGAPLSAHKGLAKVAFTGSAATGRLVAQAAAANIRPASMELGGKSALIVFEDADIEKAVEWAMFGCFWTNGQICSSTSRLLVQEAVAPAFLQQLKKRAEAINVCDPLTEGCRLGPLVSEGQYRKVLSYVEAGKAEGAQLLTGGGRPAGAPGTAGYWLAPTVFAGVKPHMRIWREEIFGPVLSVGTFSTEAEAVAAANDSEYGLAGAVISADPDRCKRVAEALECGIVWINCSQPCFCYAPWGGIKNSGHGRELGEWGLDNFLSVKQITKYVSPDIWGWYNPPSKL

SEQ ID NO: 3419 - protein, 509 aa, Xanthomonas axonopodis pv. citri str. 306
MNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 3420 - protein, 500 aa, Oryza sativa Indica Group
MALPLLRLLLLLVLSSVPLSCQLAHSTAADTQNWGQTSVVHLRNAHTRKLLGLLDDISGRTGSLHALLLEESPKQAPPHHHNRHGGHHRAAHTPAPSPAPSPSPFTAPPKSASPAAITIPISPSTPQPKAESNPAVEDAPAQPRHSWRNYGLVTAGSAVFLVMTIASVIYCRAKKVGTVRPWATGLSGQLQRAFVTGVPSLKRSELEAACEDFSNIIGSTSSCMLYKGTLSSGVEIAVLTSSTESGKEWSKECESQYRKKITNLSKVSHKNFMNLLGYCEEENPFTRAMVFEYAPNGTLFEYLHVREAENLDWMARVRISMGIAYCLEHMHQLNPPVVPRNFNSTTIYLTDDFAAKVSDLDFWNDSKGSFNSATSDETVMVEIDSMVHQYGIILLEILTGRVPYSESDGPLEHWASGYFEGKMTLAELIDPSLGSFPEDAARALCDVARWCIEPEPSKRPLMSQVAGRMKEITSLGPEGATPKVSPLWWAELEIMSGQAT

SEQ ID NO: 3421 - protein, 558 aa, Oryza sativa Indica Group
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISASLHAALDATLAFLDKAVKPVLVAGPKLRVAKAGGAFVDLADASGYAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGAEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 3422 - protein, 164 aa, Triticum aestivum
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQIWKPHCMSVLKPARPLLSFQIVNLLKWQGTNRHCHPVIWIA

SEQ ID NO: 3423 - protein, 580 aa, Oryza sativa Indica Group
MKKKKNGMGAAADRGRLLALAHHDKLNPTKPSEAQRRFKPSIQQLPFFFFFFFLEAAFLGLFLLSPLPSFLGQGQMQMQQRRKPPPAAAPVAAKQPSPRRTPGPLSFAGALLSLLVVATFLYINDHGNMMPPHASPDPNLRLLQEAAHQKVNSILLSRHAPAPPPRTNTNTSSSDQHLRLINIPMSSDLDLELGGNSTSSSGVEIQFEQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 3424 - protein, 306 aa, Zea mays
MPYTGYPLAPSHNRASAVLPPTSAPPTSAPASLAALPSPPSAITAAASFCTGSVAATTPQIRWVDVHGAAPGMSSSASSVEGDAAGEFTEVVIVRHGETSWNASRIIQGHLDAELNDIGRQQAVAVAHRLSKEVKPVAIYSSDLKRAAETAQTIARICNVPNVVFDPALRERHIGDLQGMTLQDAATERPEAYKAFMSHKRNQQVPGGGESLDQLSERCVSFLYDIVGKHKGERVILVSHGGTIRELYRHVSPTKPLHGKIHNTSVSVILVSDATGRCIVKMCGDVSHLQETGVLENAFGGDKTSA

SEQ ID NO: 3425 - protein, 561 aa, Zea mays
  misc_feature (412)..(412): Xaa can be any naturally occurring amino acid
MEEQNSWLRTKFSNTVYARVDPRRVPVAPLSKDVERKLHKFFKMKKTVSMPVDRDDGDTGTAFKHCASLPLVRSQPQLDREKVNKPERASLEIPSSSQMISESCKTPKARSLVKTPSSMMLLSYLNKLPSNQGHSSHKAYGSQSRPRSKSPLPSIVPSEVFREAKSSSQRFASPPPQRGGSAKSIYGKSFGRQVSDMGQSPRWRSTPVVSGKHKSQKDNAWTRKYSGGRRVSAVNPADDRRAQMVRMNQAVQTTVDWTLDPSKLLVGHRFASGAYSRLYRGYYDDNPVAIKFIRQPDDDDNGKMAAMLEKQYNSEINSLSHLYHKNVIKLVAAYKCPPVFYIITEFLPGGSLRSYLNNTENHPIPLEKTISIALDIARGLEYVHSQGIVHRDIKPENILFDEDSCVKVADFXIACEETLCDVLVEDEGTYRWMAPEMIKQKAYNRKVDVYSFGLVMWEMVSGRVPYENLTPFQVAYAVANRNLRPTISPECPSALGPLIEQCCALQPDKRPDFWQIVKVLEQSHSILSQGGCLDAQKSGTCQDPKKRLMQWIQKLKPTHGA

SEQ ID NO: 3426 - protein, 615 aa, Oryza sativa Indica Group
MGTYKCCLIFKRRFRWNDAPPPDDVRALFANHSAGGGPHMAADGLRAYLQATGQDGDVDMERLVEQIRQLQGRGGRIPRVGRALPLLTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKKHAFEASPYPVIITLEDHLTPDLQDKAAKMVLEVFGDILYYPDKDHLKEFPSPQDLKGRVLLSTKPPKEYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRPSLANSAEMPNLFGQNRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSELIPGIRAVALHDRKGIKLNNVKLLMRFEFE

SEQ ID NO: 3427 - protein, 461 aa, Desulfitobacterium hafniense Y51
MEQYQVGILGGGPGGYVCALRAAQLGLSVVLVEKERLGGTCLNKGCIPTKTLVKSAELWREIKHAEEFGIQLGGALLHYPQIAARKKEVVNTLVSGIEQLMKAKKITVLKGWGEVKEANRIEVTTETGKVELHVENLVLATGSIPTKIPVPGVDLPGVVTSEELLEQETLPDSLVVIGGGVIGLEFASIYHEFGVKVSVVEMLPSLLPNIDEEIPKRLAPLLKRSGLEILTKAFVREIKPKEEGLVVIVEDGKGLKELPAQQVLLATGRRPSLSGIHGDALGLELDRGAIKVNSQMQTSVPKVYALGDVVGGAMLAHVASMQGMVAAEHMAGQQVSMEGRAIPSAIFTYPEIAAVGETEQALKASGQNYKVSKFPFSANGKALALGEIMGLVKLLADEEGVVIGASIMGPQASSLIQECVLAVEKKIKAEDLAKIIHAHPTLPEAIMEAAHGISAKPLHLA

SEQ ID NO: 3428 - protein, 138 aa, Shorea xanthophylla
EKNIPVLLGLLSIWNVSFLGYPARAILPYSQALEKFAPHIQQVNMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 3429 - protein, 494 aa, Brassica juncea
MVLSRAATESGENVCSTFGSRYVRTALPKHKIGESSIPKEAAYQIIKDELMLDGNPRLNLASFVTTWMEPECDKLIMESINKNYVDMDEYPVTTELQNRCVNMIARLFNAPLEETETAMGVGTVGSSEAIMLAGLAFKRNWQNKRKAEGKPYDKPNIVTGANVQVCWEKFARYFEVELKEVKLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRTQQDLPDELIFHINYLGADQPTFTLNFSKGSSQIIAQYYQLIRLGFEGYKNVMENCRENMVVLREGIEKTERFNIVSKEVGVPLVAFSLKDHSFHNEFEISEMLRRFGWIVPAYTMPADAQHITVLRVVIREDFSRTLAERLVADIVKVLHELDTLPSKISKKMGAEDFGNVKGKKVDRDVLMEVIVGWRKFVKDRKKMNGVC

SEQ ID NO: 3430 - protein, 407 aa, Moritella sp. PE36
MALYVQKYGGTSVGSIERIEAVAQRVKKSCEQGNQIVVVVSAMSGETNRLLGMAKALDEHAARREMDVLVSTGEQVTIALLTIALQKAGVDAISMTGDQVQLKTDNSHGKARIKTVETENLQRHLDAGKVVVVAGFQGRDEDNNITTLGRGGSDTTAVAIAAVLKADECQIYTDVNGVYTTDPRVEPRARKLDRITFEEMLEMASLGAKVLQIRSVEFAGKYNVPLRVLSSFEEGEGTLITYEDVKKMESAIISGIAFNRDEASLTISGIPDEPLVAANILTPIGDAGIDVDVIVQNAHGKDGLVDFTFTVHRDDYQAARVLLEKTCEELSGKNVQGNDRIAKISIVGVGMWNHPGVAKTMFEVLGSEGINMQLISTSEIKISVIVDEKYLELGVRALHAAFNLDVA

SEQ ID NO: 3431 - protein, 138 aa, Shorea biawak
EENIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKNQQPIHLKGEVVSNHDELMSNFFAQPDALAFGKTPEELHK

SEQ ID NO: 3432 - protein, 138 aa, Shorea laevis
EKNIHVLLGLLSMWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELRK

SEQ ID NO: 3433 - protein, 312 aa, Aspergillus oryzae
MAVADTRFKLNTGAEIPALGLGTWQSQPGEVEKAVSHAISVGYRHIDGAFCYQNEEEVGKGIRDALASGKVKREDLFVTTKLWCTYHSRVEEALEKSLKNLGLDYIDLYLMHWPLAMNPNGNHPLFPKHEDGSRDIDHSHSHVQTWKNMEKLLATGKVKAIGVSNYSVRYLEQLLPEATVVPAVNQIENHPSLPQQEIVDFCKKKGIHITAYSPLGSTGSPLFTAEPIVEVAKKKGVTPATVLLSWHIARGSSVLAKSVTPSRIEDNRKLVQLDESDMATIAKYTDDLAARKAFQRFVYPPFGVDFGFPDKS

SEQ ID NO: 3434 - protein, 357 aa, Rhizobium leguminosarum bv. viciae 3841
MTNKLMKAAVVREFGKPLAIECVPVPVPGPGEILVKVVACGVCHTDLHAADGDWPVKPTPPFIPGHEAAGIVAALGSGVTEFKEGDAVGVAWLHDACLRCEYCETGWETLCEHQHNTGYSCNGGFAEYVIASAAFAARLPQNVNFSEIAPILCAGVTTYKGLKETEARPGEWVAISGVGGLGHVAIQYAKAMGLKVVALDVAAAKLDLARQVGADLALNVLSEDTIEKVLKVTSGGAHGVLVTAVSPPAFSQALSMVRRKGTVSLVGLPPGNFPMPIFDVVLKRITVRGSIVGTRRDLDEALAFATEGRVRAEIAKAPLDDINDIFAGLKAGTIEGRMVLDIAGQASALATQGQSAA

SEQ ID NO: 3435 - protein, 522 aa, Arabidopsis thaliana
MSALCRSSSLIALYCVECLSVIKIMLQFCKENSLNQTFQTLQSECQVSLNTVDSVETFISDINSGRWDSVLPQVSQLKLPRNKLEDLYEQIVLEMIELRELDTARAILRQTQVMGVMKQEQAERYLRMEHLLVRSYFDPHEAYGDSTKERKRAQIAQAVAAEVTVVPPSRLMALIGQALKWQQHQGLLPPGTQFDLFRGTAAMKQDVEDTHPNVLTHTIKFGKKSHAECARFSPDGQFLASSSVDGFIEVWDYISGKLKKDLQYQADESFMMHDDPVLCIDFSRDSEMLASGSQDGKIKIWRIRTGVCIRRFDAHSQGVTSLSFSRDGSQLLSTSFDQTARIHGLKSGKLLKEFRGHTSYVNHAIFTSDGSRIITASSDCTVKVWDSKTTDCLQTFKPPPPLRGTDASVNSIHLFPKNTEHIVVCNKTSSIYIMTLQGQVVKSFSSGNREGGDFVAACVSTKGDWIYCIGEDKKLYCFNYQSGGLEHFMMVHEKDVIGITHHPHRNLLATYSEDCTMKLWKP

SEQ ID NO: 3436 - protein, 266 aa, Xylella fastidiosa Temecula1
MITIPSDLHESVIAIATDSGRAIMKIYQDHFKVQIKADMSPLTQADLISHQIIVHGLKQLTPSLPVLSEESTGITWEERRHWKSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNGGFIALGDATLPWRDWLP

SEQ ID NO: 3437 - protein, 690 aa, Mycobacterium bovis AF2122/97
MADSSAIYLAAPESQTGKSTIALGLLHRLTAMVAKVGVFRPITRLSAERDYILELLLAHTSAGLPYERCVGVTYQQLHADRDDAIAEIVDSYHAMADECDAVVVVGSDYTDVTSPTELSVNARIAVNLGAPVLLTVRAKDRTPDQVASVVEVCLAELDTQRAHTAAVVANRCELSAIPAVTDALRRFTPPSYVVPEEPLLSAPTVAELTQAVNGAVVSGDVALREREVMGVLAAGMTADHVLERLTDGMAVITPGDRSDVVLAVASAHAAEGFPSLSCIVLNGGFQLHPAIAALVSGLRLRLPVIATALGTYDTASAAASARGLVTATSQRKIDTALELMDRHVDVAGLLAQLTIPIPTVTTPQMFTYRLLQQARSDLMRIVLPEGDDDRILKSAGRLLQRGIVDLTILGDEAKVRLRAAELGVDLDGATVIEPCASELHDQFADQYAQLRKAKGITVEHAREIMNDATYFGTMLVHNCHADGMVSGAAHTTAHTVRPALEIIKTVPGISTVSSIFLMCLPDRVLAYGDCAIIPNPTVEQLADIAICSARTAAQFGIEPRVAMLSYSTGDSGKGADVDKVRAATELVRAREPQLPVEGPIQYDAAVEPSVAATKLRDSPVAGRATVLIFPDLNTGNNTYKAVQRSAGAIAIGPVLQGLRKPVNDLSRGALVDDIVNTVAITAIQAQGVHE

SEQ ID NO: 3438 - protein, 417 aa, Triticum aestivum
  misc_feature (395)..(395): Xaa can be any naturally occurring amino acid
MSISTASRRALSRIGGALRRSLSSSSSSSVPDASGYHVSGGPSFMRAAVFWEPGRPLTMEEFRMPRPKAGEVLVKTKACGVCHSDLHVMKGELPFASPCVVGHEITGEVVDHGMHTPAEIVNRFPVGSHVVGAFIMPCGNCFYCVKGQEDLCESFFAYNRAKGTLYDGETRLFLRSNGKPVYMYSMGGLAEYCVVPANALAILPNSLPYTESAILGCAVFTAYGALRHAAEMRAGDSVAVIGVGGVGSSCLQIARAFGASEVIAVDVLDEKPQNAKTLGATHTVNAAKEDAVERIKEITGGRGVDVAVEALGKALTFSQCTQSVRDGGKAVMIGLAATNVVGEVDITRLVRRQVKIIGSYGARARQDLPQIVKLAESGAFNLENAISRKCKFEEXANSAYEDLNQGKIVGRAVVEIM

SEQ ID NO: 3439 - protein, 289 aa, Thiobacillus denitrificans ATCC 25259
MQQVRKAVFPVAGLGTRFLPATKASPKEMLPIVDKPLIQYAVEEAMDAGITDIIFVSSRTKRTVEDHFDKAYELETELAARGKNRDLELVQSIRPAGVNFIYIRQAEALGLGHAVLCARPVVGEEPFAVILADDLLDGATSVMKQMVDQYSYYQCSVLGVQQVAPEDTASYGIVDATPLADRVSRVNAIVEKPKPEEAPSTLGVVGRYILTPRIFDHIQQITPGAGGELQLTDAIAGLLKEQQVLAYAYDGVRYDCGSKLGYLQATVEYALKHKEVAADFEAYLKTRMC

SEQ ID NO: 3440 - protein, 519 aa, Moritella sp. PE36
MDNGNQKVMTNDVNNRVLDLIVVGGGINGAGIAADAAGRGLTVGLYEAADFASATSSASSKLIHGGLRYLEHYEFRLVSEALAEREVLLKKAPHIVKPMRFRLPHRPFLRPAILIRAGLFLYDNLGKRTTLKGSKQVNLAKSGLLKKEITKGFEYSDCWVDDARLVILNAMAAQRNGAEVENYCRVEKAVRKDGLWQVTMLNEQTNVRFERTARALVNAAGPWVKQFFDDSMEENSPRNIRLVKGSHIVVPRIHDEEQAYILQNKDNRIVFVIPYMEDFSIIGTTDVEYVGDPRKVAISDDEVDYLIDVVNEHFVKQLNPSDVVWTYSGVRPLCDDESSSPQAITRDYTLEIEQEGTQAPLLSIFGGKLTTYRKLAESAMKLISPYFDKMGDSWTADTALPGGDFNYPRAQLVENICSQHLWLNPETATRYVNQFGTDSWDLFAGCTSEADFGIHFGHGVYSREIDYLIETEFAKKAEDVLWRRTKLGLYLSKEQQAAVADYVNAKVVKLKPVKLDKVG

SEQ ID NO: 3441 - protein, 498 aa, Ralstonia eutropha JMP134
MDPWTTRSLRCARAWLLAVLALLSFAVHAQDTSAPATTFKPEELEALVAPIALYPDSVLAQVLMASTYPLEIVQAARWVKANPKVKGDDAVKAVADQPWDVSVKSLVAFPQALEPMNDKLDWTQKLGDAFLAQEKDVLAAVQRLRAKAQQTGNLKSNEQQNVIVEQAPAQAPVQGPAPSQAAAPQTVVRIEPANPEVIYVPSYNPTVVYGSWGYPSYPPYYWPPYPAYYPGAALATGFAWGVGLAAAGAIFGGCNWGGGDVNVNVNRATNIDRNFDRTKVQNGKWNHDASHRKGVAYRDNASREKFGGRSSAGADRRNDFRGRDGLGDRGGAGNRGGVGDRGGVGDRGGVGDRGGVGDRGGVGDRGGVGDRGGVGDRGGVGDRGGVGDRGGAGNRAGVSDRQAGAGGRGGAAGGGRDNAFQGVGGGASQRDVDRGRSSMQSTGYRQSGASHGGGGGFSGGGGRGGGGGGSFSGGGGRGGGGFGGGGGRGGGGGRGGRR

SEQ ID NO: 3442 - protein, 553 aa, Oryza sativa Indica Group
MRRSLVIVMVACSCATAIARGGGGGGGGLKLNFYSESERCPRAEEVVREEVRRLYEEHGNTAVSWLRALFHDCMVYSCDASLLLHTTTTTGVSEQSSHRSFGMRNFKYITAIKAAVERECPATVSCADILALAARDGVAMLGGPSVAMRTGRRDSRESYYGVVEQYIPNHNDSVSTVLSRFAAIGVDTEGAVALLGAHSVGRVHCFNLVGRLYPQVDGSMEAAYGEYLRGRCPTAAATEDTREVVYARNDRVTPMLIDNMYYRNLLAGRGLLLVDQQLASDARTAPYVRRMAADNDYFHQRFAAALLTMSENAPLTGAQGEVRKDCSASLPPASSSTSSHPSELLPFHLPSVDANAGGAAANLAHALPPPVPNLARAVGAPPGKRIEVVWERENTLLSFGRAAAHTAVAFVEFNVQPSSDKQIRRAAPAQSASSLGSTMLHDWLRAISEYEKPSIDMATIEKAWADEKKAIADADYEGNPSKVNTSSEKKACVDEGKSISDAETDDEGVGVPEKKACIAEGKSISDAETDDEGVGVPQNLQMKDLHDIMFPTC

SEQ ID NO: 3443 - protein, 490 aa, Oryza sativa Japonica Group
MMDLADPNHRLIAGAALLVATLAFIKLLLSSAGGGKKRLPPTIPAAPLVGGLLRFMRGPIPMIREEYARLGSVFTVPILSRKITFLIGPEVSAHFFKGNEAEMSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSSLFHDLDNGMQPVSVIFPYLPIPAHRRRDRARQRLKEIFATIIKSRKASGRAEEDMLQCFIDSKYKSGRSTTEGEITGLLIAALFAGQHTSSITSTWTGAYMLRFKQYFAAAEEEQKEVMKRHGDKIDHDILAEMDVLYRCIKEALRLHPPLIMLLRQSHNDFSVTTKDGKEFDIPKGHIVATSPAFANRLPHIFKNPDSYDPDRYAPGREEDKAAGAFSYISFGGGRHGCLGEPFAYLQIKAIWTHLLRNFEFELVSPFPETNWKAMVVGIKDEVMVNFKRRKLVVDN

SEQ ID NO: 3444 - protein, 233 aa, Candida glabrata CBS 138
MADEERMKEFQEANKAVFDPNTRQVWENQVNKTEDDAVKPEADEDEDEDDAATSGIVPTLQNIVATVNLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 3445 - protein, 493 aa, Brassica juncea
MVLSKTASESDVSIHSTFASRYVRTSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGIHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHDEFEVAETLRRFGWIVPAYTMPADAQHVTVLRVVIREDFSRTLAERLVADFEKVLHELDTLPARVQAKMANGNANGVKKTEEETTREVTAYWKKFVEAKKSNKNRIC

SEQ ID NO: 3446 - protein, 577 aa, Escherichia coli CFT073
MIKPTFLRRVAIAALLTGSCFSTVAAPPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDALADDLKTYGSEVLPNHENSKAIFWKEGEPLKKGDKLVQANLAKSLEMIAENGPDEFYKGTIAEQIAQEMQKNGGLISKEDLAAYKAVERTPISGDYRGYQVYSMPPPSSGGIHIVQILNILENFDMQKYGFGSADAMQIMAEAEKYAYADRSEYLGDPDFVKVPWQALTNKAYAKSIADQIDINKAKPSSEIRPGKLAPYESNQTTHYSVVDKDGNAVAVTYTLNTTFGTGIVAGESGILLNNQMDDFSAKPGVPNVYGLVGGDANAVGPNKRPLSSMSPTIVVKDGKTWLVTGSPGGSRIITTVLQMVVNSIDYGMNVAEATNAPHFHHQWLPDELRVEKGFSPDTIKLLEAKGQKVALKEAMGSTQSIMIGPDGELYGASDPRSVDDLTAGY

SEQ ID NO: 3447 - protein, 278 aa, Oryza sativa Indica Group
MPREICINLKSLQSQNSFNVIPPTSRATNYVVLRYYDVKGDPEGFKAGIIDESHCHYMVVFQYGSIVLFNVSDHEADGYLKIVEKHASGLLPEMRKDDYAVVEKPTLETWMQGGLDFIILRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 3448 - protein, 493 aa, Brassica juncea
MVLSKTASGTDVSVHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGNHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHNEFEVAETLRRFGWIVPAYTVPADAEHVTVLRVVIREDFSRTLAERLVADFEKVLHELDTLPARVRAKMANGKAKVVKQTEEETTREVTAYWKKFVETKKTNQNKIC

SEQ ID NO: 3449 - protein, 262 aa, Brassica juncea
MVLSHAASDSDVSVHSTFASRYVRTSLPRFKMPENSIPKEAAYQIINDELMLDGNPRLNLASFVTTWMEPECDKLIMASINKNYVDMDEYPVTTELQNRCVNMIAHLFNAPLGRDETAVGVGTVGSSEAIMLAGLAFKRKWQNKRKAEGKPFDKPNIVTGANVQVCWEKFARYFEVELKEVKLSEGYYVMDPEKAVEMVDENTICVAAILGSTLNGEFEDVKLLNDLLVLKNKENGWDTPIHVDAASGGFIAPFLYPELEWD

SEQ ID NO: 3450 - protein, 158 aa, Triticum aestivum
MAPTVMASSATSVAPFQGLKSTDGLPVSVSNGGRIRCMQVWPIEGIKNFETLSYLPPVSTEALLKQVDYLIRSKWVPCLEFSKVGFIFREHNASPGYYDGRYWTMCKLTMFGCTDATQVINEVEEVKKEYPDAYVRIIGFDNMRQVQCVSFIAFKPPG

SEQ ID NO: 3451 - protein, 319 aa, Shewanella sp. MR-7
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSQRHFDAIPWQQMDIFHLCSNTFTEAAIFNASLYGARCANSFNKIVSFDVNLRLSLWPDIALLAERVEQCFRYTQVLKMSREEAEYLALTRNKSFEDYLQFCLAQGVEVILITDGANPVQCITVNERFSVPVPQIKAVDTTAAGDSFMAGFLFALGSELAFDLEHLTLKHRLACQTQLRKAIEFAVRCGAVTCGQKGAFPALPTLSQVS

SEQ ID NO: 3452 - protein, 337 aa, Oryza sativa Japonica Group
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKECALVQNDKDYQPEGVQWYQNIGLASSPLGAIDFVHPYLIQWLKIANGIMDHCSSLPFEFEWQRIQTPKHEHFSIADVH

SEQ ID NO: 3453 - protein, 455 aa, Clostridium acetobutylicum ATCC 824
MDQTKSKNQNLSRGLKNRHVQLLAIGGAIGTGLFLGSGRSIHLAGPSILFAYMITGAICFLVMRALGELLVSNLNYHSFVDFVQDYLGNGAAFITGWTYWFCWISLAMADVTATGLYVQYWIPSLPRWVPSLVILLILLIMNLTAVRLFGEMEFWFALIKVVAILALIIVGIFMIIKGFSTSAGAASFTNLWKHGGWFPNGSNGFILSFQMVVFAFTGIELVGLTAGETEDPEHVIPKAINNIPVRIIIFYIGALAVIMSIYPWNSINPDKSPFVQVFAAVGVAAAATIVNFVVLTSAASACNSGIFSTSRMVFSLANENNAPESMKKLTSHKIPSNATIFSAAVILIAVILNYIMPEGVFVLITSISTFCFIFIWAIIVICHIKYRKANPELASKNNFKMPLYPIANYIILAFFAFVIVTLALNSETRVALFVTPVWFIVLGIIYFISKSKKKN

SEQ ID NO: 3454 - protein, 370 aa, Hypocrea jecorina
MPVGTVLVTGGTGYIGSFTTLSLLDAGYDVVIVDSLYNSSKVAIDRIELLSGRRPDFYQIDITDEKALDEVFAKHPAIDSVIHFAALKAVGESSIIPLEYYRVNVGGSIALLQSMTRHNVTNIVFSSSATVYGDATRFPNMIPIPEHCPIGPTNTYGRTKSMIEDVITDHVTAQRNNLQKEGKPFEQWNGALLRYFNPCGAHPSGIMGEDPQGVPFNLLPLLGQVATGQREKLLVYGDDYPSRDGTAIRDYIHVVDLARGHLMALNYLRSNQPGVKAWNLGSGRGSTVFEIIKAFSDVVGRPLKYEVVPRRAGDVLDLTANPTLANKELGWKTEHTMEQACEDLWRWVKNNPQGYRQEPPAELLAAIKKA

SEQ ID NO: 3455 - protein, 175 aa, Hypocrea jecorina
AGGVGTLLVQMLRTVGAKIVATASTEEKLALAKKYGADYVVNSNDDIVARVNEITGGHGIDVIFDGVGKATFDADLQMLALKGHLISFGNASGAVPPFNILQLGPKNGRLMRPVVNGYVAERADLERYTSELFDLVLSKKVEVKIHKIYPLKDAAQAHIDLESRKTTGKLLLKID

SEQ ID NO: 3456 - protein, 340 aa, Gibberella zeae PH-1
MQMATERHFYYHGKEGYQEECSNCHWCQIRSFPTHSTLPVTVVNEQDFEVLPDDFRFIKNVVLGVGVRQAEDSFHSGCSCDNDAECQFTGCHCLADLDEEDSSEDDDDPFGDFINGMDIDRPRRKAYAYHAHGAKAGLLRSKFHNSKMPIYECHQSCACSINCPNRVVERGRTIPLEIFRTEDRGWGVRSPVSIRKGQFVDRYLGEIITSTEADRRRSQSAISQRKDVYLFALDKFTDPDSLDTRLKGPSLEVDGEFMSGPTRFVNHSCEPNMRIFARVGDHADKHIHDLALFAIKDIPRGEELTFDYVDGVSHEGEEPGEKSHMTPCLCGSKNCRKFLW

SEQ ID NO: 3457 - protein, 791 aa, Xylella fastidiosa Temecula1
MNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 3458 - protein, 479 aa, Prochlorococcus marinus subsp. pastoris str. CCMP1986
MTDTNFDFDLIVIGAGYGGFDAAKHAAEKGLKVAIIESGDMGGTCVNKGCVPSKALLAASGKVREIANYEHLAKFGIHASPVRFERSKIADHANNLVSNVRENLTKTLKRSGVEIILGFGRLEGNQKVGVRDNNGIDRIFTCKNIVLATGSSPFVPPGITLDNRTVFTSDEAVKLEWLPRWIAIIGSGYIGLEFADVYTALGCEVTIIEALENIMPTFDPDITKIAKKNLIQSRDIDTKSNVFATKITPGCPVKIELTDAKSKEIVENLEVDGVLVATGRSPNSKNLNLDSVGIETIKGYIPIDDQMRVLNGEKIIPNVWAVGDVTGKLMLAHTAAAQGTIAVENICGENIEINYGSIPAATFTHPEISSVGLSETDAKEIASKEGFTLGVVKSYFKANSKALAELESDGILKLLFNKDSGKVLGAHIFGMHAADLIQEIANAISRNQDVMQLSTEVHTHPTLSEVVEVAYKQAASQVK

SEQ ID NO: 3459 - protein, 368 aa, Blastopirellula marina DSM 3645
MVNLAATMKDVIHLSIGQPDFQCPQHIVEAHIDALRAGHLGYTMDAGLPELLTELAKYYTARTEREITEDNILITTGATEAMYLAISVTSAPGRQFLIPDPTFPLYAPLVRMHGGEVKAIPTRAENGHQLDPQEVIDAIGPRTFAIILNSPSNPTGTVYPPETIEAIVQEAAYQGIRVISDEVYDHLILDDLEYASVLRHTSDLDHVMIASSFSKTYAMPGLRIGWIISSQGAIKMLRRYHMFTTTVANTPAQWAGVAALQGTTACVDEMVREYRRRRDRVVQLVSETPNLTGYWPQGGFYIFPSLPRTCNGSTLALRMLEEIGVCVVPGEAFGESCINSLRISYSTSMETIEEAFQRMIPWMAKQEM

SEQ ID NO: 3460 - protein, 417 aa, Prochlorococcus marinus subsp. pastoris str. CCMP1986
MELVDAPHSKCGTFGYVGSSPTAPTLMNTYTRFDISFKKGNGCWLWDEKGKKYLDAVAGIATCSLGHSNRILRKKLSAQLKKVQHISNLYKIEEQEELSKYLTKQSCAESVFFCNSGAEANESAIKLIKKYGNTVHKGKESFILAAESSFHGRTLATLSATGQPKYQKGFEPMVKGFKFFKYNDIASVKKLFEELKANNQKASGILVEPIQGEGGVIPGDKKFFKELREICNKYNSLLILDEVQSGVGRTGKMWGYENLEIEPDGFTLAKGLGGGHAIGALLVQKKANIFTPGDHASTFGGNPFACRAAITVLEEIKRRKILKNVLERGNQLNEGFTKISAKFPKIISGIRGLGLIQGLVINDSYTDAKTITLKAFDKGLLLVPAGGNVVRFVPPLIISRNEINILLKKLDLIFEEM

SEQ ID NO: 3461 - protein, 272 aa, Bacillus thuringiensis serovar konkukian str. 97-27
MDKQIGFIGCGNMGMAIIGGMLNKKIVSSNKIMCSDLNTTNLENASEKYGISITTDNKKVAKNADILILSIKPDLYASVINEIKEEIKSDVIVVTIAAGKSIKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 3462 - protein, 796 aa, Vibrio vulnificus CMCP6
MFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEITQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANHK

SEQ ID NO: 3463 - protein, 428 aa, Blastopirellula marina DSM 3645
MSFIVDIRGLQVLDSRGNPTVEVEVTLDDGAMGRAAVPSGASTGVHEANELRDGDKSVYVGKGVTKAVENVNTVLAEVLLGEDALNQAEIDRKMIELDGTPNKSKLGANAILGVSLAVAKAAAQSSGLPLYRYLGGVGARLLPAPMMNILNGGSHADNNVDVQEFMVMPLGFDNFSDALRCGVEVFHSLKGVLKGKGLNTAVGDEGGFAPNLGSNIEALDLIMESIEKAGYKPGEQVFIALDCASSEYYNGETKKYTIDGKEFDSAAMVDFLADWASKYPIVSIEDGCDEDDWEGWKLLTEKLGDKVQLVGDDLFVTNTERLARGIQEGIANSILIKVNQIGTLTETINAITMAHNNGYTSVSSHRSGETEDSFIADLAVALGCGQIKTGSASRSDRMAKYNQLLRIEAELGENAMYGGPIFPTLKNK

SEQ ID NO: 3464 - protein, 208 aa, Aquifex aeolicus VF5
MIVELSHPLIKHKVNTARIQDTSAEKLRKTLKELGFMLVYEALKDILLEEKEVRTWIGNKRFNYLNEEEIVFVPILRAGLSFLEGALQVVPNAKVGFLGIKRNEETLESHIYYSRLPELKGKIVVILDPMLATGGTLEVALREILKHSPLKVKSVHAIAAPEGLKRIEEKFKEVEIFVGNVDERLNDKGYIIPGLGDIGDRLYAVSVY

SEQ ID NO: 3465 - protein, 430 aa, Clostridium perfringens str. 13
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYIVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKEYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIVAIGVIALFQALQKKSAK

SEQ ID NO: 3466 - protein, 357 aa, Glycine max
NYVVSKRPMKGHGREMIQLGVPIADAPPDVDNVTGISKDKKVESIPSLFQDIIERLAASQVMTVKPDACIVDFFNEGEHSHPNNWPPWFGRPVYTLFLTECDMTFGRIIVSDHPGEFRGAVRLSLVPGSLLVMQGKSTDFAKHALPSIHKQRIIITFTKSQPKCSLPNDSQRLAPPAASHWAPPQSRSPNHVRHQLGPKHYPTVPATVVLPAPSIHAPPNSMQPLFVPAPVAPPMSFPTPVPIPPGSTGWTSAPSRHPPPRIPVPGTGVFLPPPGSGTSSQHLPCTVPEVNPSVETLTVSGKENGKSNHNTNSSPKGKMDGNIQGGQESNGNADGTQAEQAVVEKEQESNDTTAANH

SEQ ID NO: 3467 - protein, 509 aa, Clostridium perfringens str. 13
MRDLVLVVDFGGQYNQLIARRVRECGVYCEIIPYTYSIEKIKEKNPKGIIFTGGPNSVYGENTPTLDKEIFNLNVPVLGICYGDQLMAHLLGGKVDTAPVREYGKTNVTLDNSSKLFAGIEADETCWMSHTDYIAEAPEGFKIIAHTDVCPVAAMENEERRLYGVQFHPEVEHTPFGQNMMRNFLYNICGLENSWSMASFAEEKIAEIKKIVGDKKLICALSGGVDSSVAAVMVHKAVGKQLTCIFVDHGLLRKDEGDQVEKIFKEGFDMNLIRVNAQDRFLGKLKGVSDPETKRKIIGEEFIRVFEEEAGKLGDIKFLVQGTIYPDVVESGTDTSAVIKSHHNVGGLPEDMEFSLIEPLRELFKDEVRAVGEELGIPHHLVWRQPFPGPGLAIRVLGEVTEDKLEVVREADAIFREEIALAGLESEIWQYFAVLPNIQSVGVMGDERTYCHTVGLRAVTSSDGMTSNWAHIPYEVIDKVSRRIVNEVKGVNRIVYDVTSKPPATIEWE

SEQ ID NO: 3468 - protein, 555 aa, Pseudomonas putida KT2440
MRIVPFQYLALAAAILSCSSVYAATLEGGAVAAPDQYGAQVAADILKKGGNAVDAAVATAFTLAVTYPEAGNIGGGGFMTLFVDGKPYFLDYREVAPKAATRNMYLDDKGEVIENLSLVGARAAGVPGTVMGLWEAHQKFGKLPWSELLTPAIGYAKNGFKVAEKQYQYRNDAQGMFKTATNFNDYFGNMKVGELFKQPEMAQTLERIADKGVSEFYQGKTADLLVAQMQADKGLITKEDLKDYKAVWREPMAVSWRGNVVYTAPPPSSGGVALAQLLGIKEDRAADFKGVAHNSAQYIHLLAEIEKRVFADRADYLGDPAFTKVPVDQLVAKDYLAKRAAQVNPKAISDTDKVKPGLEPHQTTHFSIVDKQGNAVSNTYTLNLDYGSGVVVKGAGFLLNDEMDDFSAKPGAANAFGVVGGDANAIEPGKRMLSSMSPSLMTRDGKVELVIGTPGGSRIFTSIFQVMNNLYDYGMPLDKAVAAQRVHHQLLPKDTIYFDSYAPLTGPVADELKKMGYVLEDQGWEMGDIQAIRVDGAKLETASDPRGRGVGMIVK

SEQ ID NO: 3469 - protein, 599 aa, Magnaporthe grisea 70-15
MRFTSSLRGGLVALLALGQPACIWSKTIAHDFHLSWITTNPDGAYAKPTIGINNQWPPPLISATVGDEVVVNLHNGLGNTTTSLHFHGLFQNGTNHMDGAVGVTQCPVPPGHTFTYRFKVDQPGTYWYHAHNNGQYPDGLRGPVVVHDPAGPHEGKYDDDIVLTLSDWYHRPMKELIAGFLNYKNPSGAEPVPQAALMNDTQDLRVKVEPEKTYLVRMVNVGAFASHFVRFEGHQVRVVEADGVWMEESAPVDVLYLAAAQRYSVLLKAKSDATQNFAIVSTMDEELFDDAPEDLNPSVTGWLVYNEEKPLPEPDKLAPDSGILLDDMNLVPADKFRLLDAVSQSIEFNIHMKILGNGVNYAFFNNITYVGPKVPTLYTALTVGGATAATNPIVYGSHTNTHVLRHNDVVELVVNNFDDGDHPFHLHGHNFQVITRSDADAGPFVPSNRPRLQRDIPLRRDTVLIRGNGHAVLRFVADNPGAWLFHCHIEWHMEQGLVATLVSAPEQLLASGAKHPQLPRSHLESCKLSGMAAAGNAAGNADDVLDLTGENRPPPPLPKGFTTKGYVALVCSGVAAVMGMASIWYYGNIPDMQKGYEAI

SEQ ID NO: 3470 - protein, 173 aa, Brassica napus
MSTMKPSRSDEVSDPDQQIKNSNEIRAGFDSLAPKRPTKPTRSEPAPLGSFSTSDQTTDHPEADKFQNLQSQTHGNILHGGGSAAVQDEFLETEYYTNLTSIDKQHHTTGSGFINVVKEDSGEEAVPAAAALDDDGGEKAGYKSNPATNDWIPAAEEDLTSEFSSKPNRSESS

SEQ ID NO: 3471 - protein, 538 aa, Pseudomonas aeruginosa UCBPP-PA14
MPAIQSELDVNGEDFARNREAMLAAVAGFRELEQKVLDKAAEARPKFEKRGQLLPRERLALLLDPGAPFLELSSLAGYKLHDDKDGTQAGGGIIAGIGYIAGVRCLVSASNSAIKGGTISPTGLKKTLRLQQIAMENKLPVVTLTESGGANLNYAAEIFVEGARGFANQARISAMGIPQVTVVHGSSTAGGAYQPGLSDYVVVVRGKAKMFLAGPPLLKAATGEIASDEELGGAELHAQVAGTAEYLAENDADGVRLAREIVGMLPWNAQLPARPARSWREPLYPVEELLGVVPADPKKPYDVREIVARIADGSEFLDFKNEFDGQTICGHLRIEGHACGLIGNNGPITPQGAAKAAQFIQLCEQSNTPLLFLHNTTGFMVGTESERQGVIKHGSKMIQAVANARVPKLTLVVGGSYGAGNYAMCGRGLDPRFIFAWPNSRTAVMGGAQAGKVLRIVTEEKHAKEGKEADPKMLDMLETVTAQKLDSQSTALYGTASLWDDGLVDPRDSRRLLGYLLDICAEAEARPLKGNSFGVARF

SEQ ID NO: 3472 - protein, 592 aa, Arabidopsis thaliana
MMGICEMKSCCSWLLLISLLCSLSNESQAISPDGEALLSFRNAVTRSDSFIHQWRPEDPDPCNWNGVTCDAKTKRVITLNLTYHKIMGPLPPDIGKLDHLRLLMLHNNALYGAIPTALGNCTALEEIHLQSNYFTGPIPAEMGDLPGLQKLDMSSNTLSGPIPASLGQLKKLSNFNVSNNFLVGQIPSDGVLSGFSKNSFIGNLNLCGKHVDVVCQDDSGNPSSHSQSGQNQKKNSGKLLISASATVGALLLVALMCFWGCFLYKKLGKVEIKSLAKDVGGGASIVMFHGDLPYSSKDIIKKLEMLNEEHIIGCGGFGTVYKLAMDDGKVFALKRILKLNEGFDRFFERELEILGSIKHRYLVNLRGYCNSPTSKLLLYDYLPGGSLDEALHVERGEQLDWDSRVNIIIGAAKGLSYLHHDCSPRIIHRDIKSSNILLDGNLEARVSDFGLAKLLEDEESHITTIVAGTFGYLAPEYMQSGRATEKTDVYSFGVLVLEVLSGKRPTDASFIEKGLNVVGWLKFLISEKRPRDIVDPNCEGMQMESLDALLSIATQCVSPSPEERPTMHRVVQLLESEVMTPCPSEFYDSSSD

SEQ ID NO: 3473 - protein, 568 aa, Xylella fastidiosa Temecula1
MSSSSIEDIKGKSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRVGNIIGFITRADLITISTAIVTTQRDFGNRTLRKRARFKYTIDDRGLDCIVGEIQQRAGITLQPARPFVFEHNGDRYGWIEGEDGHWHLTLSLPAGRIADTEGSTLLSGFREIAQLGIGEFRMTPNQNVVIAGISPGQRAAIDALVTQYGLDTGNRAPTALGRHAMACVALPTCGLAMAEAERYLPDFNAKLQPILEKYGLAEAPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 3474 - protein, 278 aa, Pyrus x bretschneideri
FVRNLGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRLKALK

SEQ ID NO: 3475 - protein, 323 aa, Triticum aestivum
MSAAPPTVPPAATAADDEILYESMPRLRVYRSRVERYLVGSEFVAVSTDAATGVASRDTAISPNVSARLYLPRLDAADGTLPVLVYYHGGGFCLFSAFDSTYHAYLNAFAAYANVLVVSVEYRLAPEHPVPAAYADSWDAVAWVLSQAAASAGAEPDPWLARHADLSLLYLSGDSAGANIAHHIAMRAGASVRGLVLVHPYFLGSDEVGSDGLDPAMRERLGRLWRVACPAAAGEDDPLINPLADGAPGLEALACGRVLVCVAGADVLRDRGRAYYDRLVNSGWRGQAEMWQAPGKGHRFHLLEPGCDEAAAQDRAISGFLNR

SEQ ID NO: 3476 - protein, 214 aa, Glycine max
SCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLVWDVESQPNRHAVLGATNSRPDLILTGHQDNAEFALAMCPTEPYVLSGGKDKTVVLWSIEDHITSAATDSKSGGSIIKQNSKSGEGNDKTADGPTVGPRGIYCGYCYLIDTILFSV

SEQ ID NO: 3477 - protein, 543 aa, Rosa hybrid cultivar
MASHLAMLMTKLPKLQNLSASDHSSVVSLNLFVALLCACIVIGHLLEENRWVNESITALLIGVSTGVLILLISGGKSSHLLVFSEDLFFIYLLPPIIFNAGFQVKKKQFFRNFITIVMFGAIGTLVSCTIIAFGATQIFKKLDIGSLDIGDYLAIGAIFAATDSVCTLQVLHQDETPLLYSLVFGEGVVNDATSVVLFNAIQSFDLTHLDSRIALKFMGNFLYLFFASTMLGVITGLLSAFIIKKLYFARHSTDREVALMMLMAYLSYILAELFYLSGILTVFFCGIVMSHYTWHNVTESSRVTTKHAFATLSFVCETFIFLYVGMDALDIEKWRFVSDSPGTSVAVSSILLSLVMLGRAAFVFPLSFFSNLFKKNQSEKISLQQQVVIWWAGLMRGAVSIALAYNQFTRSGHTQLRANAIMITSTISVVLVSTVVFGLMTKPLIRLLLPHKQLTSTNSIMSDPPSPKSVIVPLLGQDSEADLSGHEVRRPASIRDLLTTPTHTVHRYWRKFDNAFMRPVFGGRGFVPFVPGSPTERNNTQWQ

SEQ ID NO: 3478 - protein, 304 aa, Zea mays
  misc_feature (77)..(77): Xaa can be any naturally occurring amino acid
  misc_feature (109)..(109): Xaa can be any naturally occurring amino acid
MEPGLPRLVVLVRPRPPISMSLRASIIGLPNVGKSNLFNAIVVRCFEDDDIVHVNGRVEPGSDIDVINLELIFSDLXQIEKRLDKLNKSDTQVKVKEQAEKSGLEKIQXALMEGKPARSVDLAEHEKEVIKHLYLLTMKPVISVANVIESDLAEPDINPRVKEVAKAASYLQYGMVTILAQIETELAELPLEERVEYLKSLGVAESGLGNLVKATYNLLGLRTYFTTGDKVHHLCCVTAPQAAGVIHSDFQKGFIRVETVSYDDFVAAGFLGVAREKGLEKFQKHRVKKFWQHFHFILIAVPRQ

SEQ ID NO: 3479 - protein, 589 aa, Bradyrhizobium sp. BTAi1
MRTFTFDRRRFLSRLAWAAGVTLLLAGGAPARAFDAQGIDIPLPPGVTAPAQPPAHGMVVAQERIAAQVGERILALGGNAIDAAVATGFAMAVTYPVAGNIGGGGFMVIHLAASHEDVAIDYRETGPAAMTRDSFLGADGKPDNAKSRDSALSIGVPGSVAGLALALEKYGSGKFTLAQLLHPAIVLAREGIPVADDVAVTLPMMAPRLAKWTSSAAIFMRPDGAALKEGDRLVQRDLATTLTAIAEQGPRGFYEGPVADKLAKAIQDAGGIMTTDDLKSYQPVLRTPVRGTYRGHDIVSMPLPSSGGTVLVEMLNILEGFPLAELKQGSPASLHLLIEAMKRAYADRARYLGDPAFVDAPVRAMLSKDYAARQRASIDPMRATSAGDVLNIKPLREGSNTTHFSVVDNDGNAVSNTYTLNFPYGVGLVAAGTGVLLNNELDDFTAAPGASNAFGLVGFEANLPGPGKRPLSSMSPTIVLKDGQPVLVTGSPGGSRIISTVLQVIVNVLDYQLDVREAVKAPRLHHQWMPDEVRVEKGFADDVLADLRALGHRIEEPMGRTSANSILVTPAGLIGAPDPRSKGAAAAGR

SEQ ID NO: 3480 - protein, 213 aa, Triticum aestivum
MASKSAVTPGGQPKGKEEPSSMADVYNHELTPLQKHVAFFDRNKDGVIHPSETYEGFRAIGCGVALSALQRRLHQRDCSGPKTIPENMKVGAFKFPIYVKNIHKGKHGSDSGVYDANGRFVPEKFEEIFKKHAHTRPDALTGKELNELLQANREPNDLKGRVGGFTEWKVLYSLCKDKEGFLHKETVRAVYDGSLFVKLEQERKQAKESAKKK

SEQ ID NO: 3481 - protein, 145 aa, Yarrowia lipolytica CLIB122
MAPKKSVKKNVDATLEKKDAPPVAVPVHVTKSADNDNTNVFTKVLNNYTKQSTPKLKLIDSFLAFLVVLGVFQFVFCLLVGNFPFNAFLGGFASTVGQFVLTAALRIQTAKQNAKEFPGVSSERSFADFLLGSLVLHFCVYHFIN

SEQ ID NO: 3482 - protein, 139 aa, Brassica napus
  misc_feature (76)..(76): Xaa can be any naturally occurring amino acid
DFDTMAQSGAAFARQFKKNDPVLDMVDKKIFKRGRYRVTPGAWCARSHSNWWTDPCSEWGDVNVVKGGPQAKKLYXTVTNFFDDLSSETNQCKLKRKMVGSVGISYTPGPAPSLHCFNVCNGFNSLPADCIYKTAGRFH

SEQ ID NO: 3483 - protein, 102 aa, Arabidopsis thaliana
  misc_feature (21)..(21): Xaa can be any naturally occurring amino acid
  misc_feature (47)..(47): Xaa can be any naturally occurring amino acid
MASSMLSSANMVASPAQASMXARFNGVRASAGLRGTGRGSCDMNSVXEDGGRDNCVLVGAPSVKTKFETRGYIPDLTDAAWAWGAEGLIRHWGSPLRKHSKC

SEQ ID NO: 3484 - protein, 332 aa, Thermotoga maritima
ARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 3485 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLTLPIDKIDPTHSYVKDIDDLSKHTLDKIKHFFETYKDLEPNKWVKVKGFEN

SEQ ID NO: 3486 - protein, 273 aa, Cochlearia officinalis
MANLRESSRDKSRWSLEGMTALVTGGSKGIGEAVVEELAMLGARVHTCARDETQLQESLREWQAKGFQVTTSVCDVSSRDQREKLMETVSSLFQGKLNILVNNAGTCITKPTIDYTSEDFSFLMSTNLESSFHLSQLAHPLLKSSGLGSIVLISSVASVVHVNVGSIYGATKGAMNQLARNLACEWASDSIKVNSVCPGFISTPLASNYFRNEEFKKEVENIIPTGRVGEANEVSSLVAYLCLPAASYVTGQTICVDGGFSVNGFTFKSLPLR

SEQ ID NO: 3487 - protein, 543 aa, Haemophilus influenzae R2846
MSKQIQIPDIGSDEVTVTEVMVNVGDTISVDQSIINVEGDKASMEVPAPEAGVVKEILVKVGDKVSTGTPMLVLEAAGTAPVADAPTAPAADEPTAPVVATAPTASAIVEVNVPDIGGDEVNVTEIMVAVGDTITEEQSLITVEGDKASMEVPAPFGGVVKEILVKSGDKVSTGSLIMRFEVPGAAPAASASDSASAPQAAAPAAATTAQAPQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVIIPHVTHFDKADITDLEAFRKEQNALAEKQKLGVKITPVVFIMKAVAKALEAYPRFNSSITEDAQRLILKKYINIGVAVDTPNGLVVPVFKNVNKKGIIELSRELMEVSKKAREGKLTASDMQGGCFTISSLGGIGTTHFAPIVNAPEVAILGVSKSSMEPVWNGKEFAPRLILPMSLSFDHRVIDGADGARFISYLGSVLADLRRLVM

SEQ ID NO: 3488 - protein, 508 aa, Pseudomonas putida KT2440
MNAPQSPNSTKVEQVKLLIDGQWVESKTTEWRDIVNPATQEVLARVPFATVEEVDAAVAAAQRAFQTWRNTPIGARMRIMLKLQALIREHTKRIAQVLSAEQGKTLADAEGDIFRGLEVVEHAASIGTLQMGEFAENVAGGVDTYTLRQPIGVCAGITPFNFPAMIPLWMFPMAIVCGNTFVLKPSEQDPLSTMLLVELALEAGVPAGVLNVVHGGKQVVDAICTHQDIKAISFVGSTEVGTHVYNLGSQHGKRVQSMMGAKNHAVVLPDANRTQTINALVGAAFGAAGQRCMATSVAVLVGKAREWLPDIKEAASKLKVNAGCEPGTDVGPVVSKRAKERVLGLIESGIKEGAKLELDGRDVKVPGYEQGNFVGPTLFSGVKTDMQVYTQEIFGPVLVTLEVDTLDEAIALVNANPFGNGTGLFTQSGAAARKFQSEIDIGQVGINIPIPVPVPFFSFTGSRGSKLGDLGPYGKQVVQFYTQTKTVTARWFDDDSVNDGVNTTISLR

SEQ ID NO: 3489 - protein, 295 aa, Zea mays
  misc_feature (44)..(44): Xaa can be any naturally occurring amino acid
  misc_feature (150)..(150): Xaa can be any naturally occurring amino acid
KYPKFPNRVTPASQKPNSRSRSSSPQPRAAPSPPPSPWSAPPPXPPPSGKPTQDELKRLAAHRAVELVEPGMTLGLGTGSTAAHALDRLGDLLRAGALPGVAGVPTSLKTEAHAARVGIPLLPLDAASIALSIDGADEVDPDLNLVKGRXGGSLLREKMVEGAGARFAVIVDESKLVPRLGCTGAVPVEVVPFGAPHTLGLIRGLFHGLPGFHARLRTTTVPEGEQGSEQQPFVTDNGNYIVEMFFDGGIRGDLRDISDRLLRITGVVEHGMFLGMATVAIVAKKDGTVAVMERK

SEQ ID NO: 3490 - protein, 474 aa, Haemophilus influenzae R2846
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLAAFTDPHTLVVRDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVAAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHCVLGGAIVGSNGGELLGEIGLAIEMGCDAEDIALTIHAHPTLHESVGLAAEVFEGSITDLPNAKAKKK

SEQ ID NO: 3491 - protein, 180 aa, Haemophilus influenzae R2846
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISQGDNVLIIDDLLATGGTVEATVKLVQRLGGTVKHAAFVINLPELGGEKRLNHLGVDCHTLVNFEGH

SEQ ID NO: 3492 - protein, 98 aa, Vitis vinifera
MLDAILPYSQALEKFAPHIQQVSMKSNGKGVSIDGVPLPLGAGEIDFGEPGTNGQHSFYQPIHQVICFSVVLSKVVNCVSLKLLRDCQFQLCLIQEFL

SEQ ID NO: 3493 - protein, 112 aa, Brassica napus
TQTLTKKMSSSDSSSAESRLATAKTVLTTAASVAATAMLAKSLVQDYLPDEVHQYISYGFRIFFGYFSSQMTIIIEEFEGFVHNEVFEAAEAYLATKISPSNKRIKVSKHEK

SEQ ID NO: 3494 - protein, 287 aa, Roseovarius nubinhibens ISM
MTKRLLSFGHGYSARALAAELLEHGWTIYGTTRDAEKAEALAEEGVQPIIWGQGDIEPILAKSTHILISAGPDEAGDPVLNTYGDLIRDYAAQLDWAGYLSTTGVYGDHGGGWVDEETPLAPSTRRGEMRQAAEAQWRAVPGLPLHIFRLAGIYGPGRGPFAKVRRGTARRIIKPGQVFSRIHVEDIAQVLAASIARPDPGAVYNLCDDDPAPPEEVIAYAAELLGLPVPEAVDFDAAEMTPMARSFYAESKRVRNDRIKEALGVTLRYPDYRAGLQALAAAEKPEV

SEQ ID NO: 3495 - protein, 998 aa, Thiobacillus denitrificans ATCC 25259
MNHYAITMPQLSDTMTEGVVVTWEKQPGDRVERGDIVATVETDKAIMDVEVFKAGYLAGPLADVGATIAVGAALGYITDTAGDVAIAADEVVAEQAQTEMIPHHAGTPIVMPQLSDTMTEGVVVTWEKQPGEAIKRGDIVATVETDKAIMDVEVFQEGFLSGPIADIGSVVEVGHPMAFIVDDAAKANDTGVTISADHKVKDTHKVAPPAADKPAHLPIPKTAPSQVAAAGNAVPVPRPQGRQASPYARKVAAQLGVNLTGLAGSGPSGVLVAADVARARPSMQEVAHALPQVDVPGQGRPMTSMEKAVSHAMTASLTLPTFNVTVNIDTAALTAATKAKKVSVTVAIAKACSVAMAKFPRMNWAYQPVDKLVERANHDFGVAVMSNDGGLVVPILHGVEKKSLEALQGDWTGLVERARVRKLAPPEYSNPTFTISNMGMLGVSHFTAIPTPGISAILAIAANGPQGTPFTITGDHRVLNGADVALYLTTLKQTIEAPDAWLSGGTAAETAGAAATTSAPVSPIPEGNWDVQVVVVGGGPGGEDCARDLADHGVKVMMVNNEPFPGGECLWRGCIPSKAWRAAADNIRNRAHDAEMGVDGTANPKLNWAQVEKHRRWVQTSRGEMALKADKGMKIDVREGYGEFVDAHTLKITPPEGEAYTVSFGAAVIATGAPAFVPPIPGARENLATGGVVTSDTIWNLANPPKKLGIVGGGVIGVEMAQIFRDFGTEVLMLERHDRILAEIEEEIGKVLIASLEKEITVVTSADIREVGGKPGKMTLRYADKEGAESTFDCDVVLMATGKRPDTSRLNLDKVGVALDGAAIKVDARCCTSTPNIYAVGDVIGGYMLAHTAATQGRVAASNLLGHASEYDQDRDCGVTFSRPQAGFVGLSVAQAKAKGIDAVEAKMPMSIDAKAMITGETEGMIKLVADKTTGRIIGVHYLADHTDTLIGTGVMMVAGEMTLTQVAKAIFPHPTQTELFGELARRLLNRLRRTAKK

SEQ ID NO: 3496 - protein, 143 aa, Escherichia coli CFT073
MAIERTFSIIKPNAVAKNVIGSIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 3497 - protein, 377 aa, Oryza sativa Indica Group
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPEILNMDIMEKVLEVKGEDAVKMARELALKEGLLVGISSGANTVAALELAKKPENKGKLIVTVLPSLGERYLSSALFEELRAEAEAMQPVPVD

SEQ ID NO: 3498 - protein, 153 aa, Oryza sativa
  misc_feature (148)..(148): Xaa can be any naturally occurring amino acid
SSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAXSCRNN

SEQ ID NO: 3499 - protein, 175 aa, Escherichia coli
SLLNVPAGKDLPEDIYVVIEIPANADPIKYEIDKESGALFVDRFMSTAMFYPCNYGYINHTLSLDGDPVDVLVPTPYPLQPGSVTRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 3500 - protein, 810 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKDNPEAMEEDEVDDIAEIKAAHFEESMKYARRSVSDADIRKYQAFAQTLQQSRGFGSEFRFPDQPTAAAGSAAAADPFASAAAAADDDDLYS

SEQ ID NO: 3501 - protein, 430 aa, Pseudomonas sp. QDA
MMIPVILSGGSGSRLWPLSRKQFPKQFLALTGEHTLFQQTLERLAFEGMDTPIVVCNKDHKFIVQEQLAALKLETQGILMEPFGRNTAPAVTMAAMKLVNEGRDDLMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDADIYDTCVLALERSEEEDEVLSIDEATFACCPDNSIDYAVMEKTQRACVVPMSAGWSDVGCWSSLWDVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPV

SEQ ID NO: 3502 - protein, 209 aa, Zea mays
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSSRSPSPYRHHA

SEQ ID NO: 3503 - protein, 297 aa, Yersinia pestis CO92
MRYAFPTQQLKDNVMQTVKLNNGIAMPLLGFGVFQMTNTAECERAVIDAIETGYRLIDTAASYQNETQVGNALKLSGIARDELFITTKLWLQDTYYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 3504 - protein, 1114 aa, Oryza sativa Japonica Group
MGGVEPPPPPAPAPAGLAAWLVARGVKRRAVSAKRSWPPLCGRFPAPPPPPPTAPVAGDDGSKGVEGVVANQGGAEGVAVSPDRSVPLSGGPTAASSLPPPPPSIIAGNVGDNSVEGRGDVGDKGVHGVTEGNEEEQVASAVVSSAACIGALSHGPSQPEAERMEVDEGEGRETGEAQLPNDTDARLSDDQGMGEVLDVMPLAVAAPVSCGANVSNGSAENVRDVASLLMDREGGKWGCEFERKEVTSDRDGRETESRVGVGQLERTNDVHDGGRKKRWLMSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPNLKIKFDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPLKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 3505 - protein, 288 aa, Zea mays
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 3506 - protein, 211 aa, Herminiimonas arsenicoxydans
MTTSLTSVPAAAAVLPAVELDYVASCELPMPWAKFRLHAFTEPATGKEHVAITLGDVANGEPVLARIHSECLTGDALFSLRCDCGPQLEAALQKIAEEGRGALFYLRQEGRGIGLVNKIRAYQLQDAGADTVEANEALGFKPDQRNYRLCLPMLQHLKISSLRLMTNNPRKITAMEQLGLKVVERVPLVITHNPFNERYLATKAGKLGHLF

SEQ ID NO: 3507 - protein, 1115 aa, Streptococcus agalactiae
MLKKQFGNFGEKSRKVRVKMRKSGKHWVKSVMTQIGYVILSRFSGKEKSSKVQTTSEDLSRTKTSASILTAVAALGAVVGGTTDTTSVSAEETPTATELTGNEKTLATAETVVVAPEVKTVNSDSSSHSTSESQSMSTSTLQSTSASLSASESLMDSTSASLSESSSLSEYSSLSLSSSESVSASESVQSSEAATTARVQPRAMRVVSSASDMETLPAALISGEGDVTTVQGQDVTDKLQNLDIKLSGGVQAKAGVINMDKSESMHMSLKFTIDSVNRGDTFEIKLSDNIDTNGASNYSIVEPIKSPTGEVYATGIYDSQKKSIVYSFTDFAASKNNINGILDIPLWPDDTTVQNTKEDVLFSVKIKDQEATIKETVKYDPPVRIDFAGGVSVDSRITNIDDVGKKMTYISQINVDGKSLYNYNGLYTRIYNYSKESTADLKNSTIKIYKTTSDNIVESMVQDYSSMEDVTSKFANSYPEKGWYDIYWGQFIASNETYVIVVETPFTNAVTLNTTLSDYNENNGVEHNHTYSSESGYSDVNAQERKILSELVSSSESVSSSESVSNSESISTSESVSNSESISSSESVSSSESISTSESVSTSESISSSESVSSSESVSSSESISSSESVSNSESISSSESVSNSESISSSESVSSSESISNSESISSSESVSTSESISSSESVSNSESISSSESVSSSESISNSESISSSESVSTSESISNSESVSSSESVSTSESISSSESVSNSESISTSESVSTSESISSSESVSSSESISSSESVSNSESISNSESVSSSESVSNSESISSSESVSNSESISTSESVSTSESISSSESVSNSESISSSESVSNSESISSSESVSNSESISSSESVSNSESISSSESVSSSESVSSSESISTSESVSNSESISSSESVSNSESISSSESVSNSESISSSESVSNSESISSSESVSSSESISSSESVSSSESVSNSESISSSESVSNSESISSSESVSSSESISSSESVSNSESILSSESVSSSESISSSESISSSESVSMSTTESLSESEVSGDSEISSSTESSSQSESMNHTEIKSDSESQHEVKHQVLPETGDNSASALGLLGAGLLLGATKSRKKKKD

SEQ ID NO: 3508 - protein, 324 aa, Herminiimonas arsenicoxydans
MTKAIRINKTGGPEVMEYLDVELAAAGPGEALIHQMACGLNYIDVYFRTGLYPQTLPAGLGMEGAGVVAAVGEGVTHVKPGDRVAYAGGPPGAYAESRVLPAKVLVKLPASIDFETGAAMMLQGLTAQYLLRRTFRLQGGETILFHAAAGGVGLIACQWARALGVTMIGTVGSDEKAALAKAHGCTHTINYNTENFVERVKEITHGAGVPVVYDSIGKDTFIGSLDCLSPMGMLVSYGNASGPVPPFSLTELASRGSLFVTRPSIFTYTAKRDDLEQMSAELFGMIESGKIKLSINQRYALKDVAQAHIDLESRKTTGSTILIP

SEQ ID NO: 3509 - protein, 163 aa, Pseudomonas putida KT2440
MRHIISLLLENEPGALSRVVGLFSQRNYNIESLTVAPTEDPTLSRLTLTTVGHDEVIEQITKNLNKLVEVVKLVDLSESAHIERELMLVKVKATGAQRAEIKRTTDIFRGQIVDVTASVYTVQLSGTSDKLDSFIQAIGTASILETVRSGVTGIARGDKVLSI

SEQ ID NO: 3510 - protein, 334 aa, Herminiimonas arsenicoxydans
MKRISLTQYLIEEQRLHNNIPAELRLLIEVVARACKTISHAVGKGALGEVLGSAQSENVQGEVQKKLDIISNDILLEANEWGGHLAAMASEEMETIHPIPNRYPMGEYLLLFDPLDGSSNIDVNVSIGTIFSVLKAADGMQAAKEADFLQAGSKQVVAGYAVYGPQTVLVLTTGNGVQCFTLDREMGSWVMTQKNMQIPADTKEFAINASNARHWYPPVKRYVDEMLAGTTGPRGKDFNMRWIASMVADVHRILNRGGIFMYPADAREPDKPGKLRLMYEANPMAFLVEQAGGAATDGQQRILDIQPEKLHQRVPVFLGSKNEVDLVTSYHKTK

SEQ ID NO: 3511 - protein, 468 aa, Pseudomonas taetrolens
MSKSVQLIKDHDVKWIDLRFTDTKGTQHHVTMPARDALEDDFFEVGKMFDGSSIAGWKGIEASDMILLPDDDTAVLDPFTEDATLILVCDIIEPSTMQGYDRDPRAIAHRAEEYLKTTGIGDTVFAGPEPEFFIFDEVKFKSDISGSMFKIYSEQGSWMSDQDIEGGNKGHRPGVKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSETALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 3512 - protein, 650 aa, Listeria monocytogenes EGD-e
MILLQVQQISKFFGAEVILDNIKLEVKTGDRIALVGRNGAGKSTLLKIIAGKMSYDGGTISKPKSVEIGYLAQNTGLESSKTIWDEMLSVFDSLRKMEADLRKMELRLGEPELYNDPEKYQALMTDYDTLQHTFKESGGYTYEAEIRSVLNGLRFYPEDYEVEIASLSGGQKTRLALAKLLLAKQDILVLDEPTNHLDIETLAWLETYLQNYHGSLLIVSHDRYFLDKVVNQVYEISRTKIDYYKGNYSSFVNQKQAKLEQMWKEFDKQQKQIAKLEDFVARNIVRASTTKRAQSRRKQLEKMDVLGRPQGDEKAAHFGFQFEKQTGKDVLMVDQLSIGYAKDKRIASNLTFEMKRQDSLALVGPNGIGKSTLLKTLIRDIPALSGEFHFGAGVKIGYYDQEQAKLTSNKTVLMELWDDYPELNEVNVRTTLGNFLFSDDDVLKNVQSLSGGEKARLALAKLTLLEANVLILDEPTNHLDIESKEVLEAALIDFEGTILFVSHDRYFINRIASKIVELAPEKATVFLGDYDYYQEKLAEEKELARLDAEDRRKKGEQVEATASVRKLNYQEEKEQQKLLRQRKRKLEEIEKSMEETDEKIAELELQLTNPEVFQDHEKALEITQELDAVKADGEKLMEEWEQISEELESI

SEQ ID NO: 3513 - protein, 1817 aa, Arabidopsis thaliana
MHEGKDNEYVPTANAETFAPLATLSEDGDSDNNELMEIRELMDIRKLHQIYIKRAGVVDVTSQEAVLTWRGEILRQGMEKAQRFVAIPKPLKLDAEHYGYWKVLIRQSIQSIDMDAWFAVEDGWTPPTTKDAKGDIVLKSRTEWTSDENTTANHNSQAMSVILGSLPRNKFTQVLQDSFEGTNNVNHTRLDMLALEFENQTMEVEESVDDFTGKLSSITHEAVVLGKTYKDKKMLKKFLRSLPDKLQSHKSAIDAYDTDSVNDEHGFPLEKVRILIEELTLKRKGNKELISEKGILMEKVSTLEKELGEERIKSQGLEKQLEDQLRNIKMLSRGNKDLDELLTVGRTSNVTWSLGYDGTSSKGGTPAHRTDAPSKARKALTRSMATHNWRQLNYQVMNRVVPVNNFAKFVFVKAKTRSEARVSQSTVKQLSRRTRNCFCSNQGQITASYWMKKHNVCHHVADKQGRTTFKSVRTGDNCYMWNLSNPHSKHFVQSGVLNPKCLHSRTWLLVARCSSLVSVRIISHMMIWEGFGGRKLPSLLVADESGTESDVHGYHYKSRMQCKILTGLDPWKIAEVQVVDASSWVATWSREEENLNKAMVLYAEPEPTSRRSELPNKENQDEHAAVSPEPTVIVELPDECESTVVHVHRSETPIQAETRNQTCDQVPPLNNQNPQVVQISDANWSPTTSEGYASIDRALLVYRIAHKLSFDFVRDWVYEFSPAKINELFGLEYMDVRTQRMEIARIMDDEVAIYLTDGKEKALKKLVGNTFSNSGKELFKLCCTNWSPTTNDAYAQPDRAKLVFMVAHKTPFDFGKMVFEHIMQLALKAEAKLYIPFPSLVYQLLQSQHPVKVHDEKSVPLVQTKKKTAKKPSTQGVQTGDSTNGSGHRRAMKLAIEVLQTALDADSDNNELMEIRELMDIRKLHQIYIKRAGVVDVTSQEAVLTWRGDQRRKSGSMNDYIMVICGEWFCSSTGEWKLEICNQLFSRVVPIHEGITLVVLNEALLQEFGVKGLNPMLSYSVPNKNMFATKDKTPPVMVTSEIGLQYYLKTLRENRGLNLFVKFEEKVDTPNLSCETLGGSAKRKVESLYDTASGSRNADTNSGDISFGVSKSPNVLVTPVDDEFMDALHDAQKKIARNDGLKSNEEVIVDDEDDIFVDDLFGDNKTEETEDGIDIFDDTMPCGGYDKEFWGNFLSDDYGCSNAEELMSKGGVDARYKGKNNKDVSFEGLNDKVGTSEDKVVQCTGSVVFDHAVFVSGGGSGVNAEKVKTEWAAKTKVGCKAGSSHGLRGGARKLEEIDDEEFDIPPLFEDIEYEVENIPDLDLEDDGKGIYKGKVYASKEDCQIGLAIYAIKNMFHFNQTRTKWNYSVLSCSDEKCDWRILATLMKGTGYYEIKKASLDHTCSLDTRGQFMQKATSKVIASVFKAKYSDPTSGPVPMDLQQLVLEDLRVSASYTKCWRARESALTTVARSDEESYCYLAEYLHLLKLTNPGTITHIETQRDVEDESKERFLYMFLAFGASIAGFKHLRRILVVDGTHLKGKYKGVLLTASGQDANFQVYPLGFAVVDNRHSSILVAVKRVFPQANHGACIIHLCRNVQAKYKNKALTQLVKHAGYAFTGMANWTRHYFRGQRFNLMTSNIAETLNMALNKGPVPPEVDKQITKTMLTTNGSKVGRITNWSYEISCMLGGRNVVDLEKKQCTCKRYNKLKIPCSHALVAANSFKISYKALVDDCFKPHAWVSSYREAVFPEAIGRDEEIPEELEHRSMLPPYTRRPSGRPKVARIPSTREYKARVIKGQVVQIQFEQVVTVDDFEIAI

SEQ ID NO: 3514 - protein, 546 aa, Coprinopsis cinerea okayama7#130
MSEDRSCCGVVEESAARARARRYDDPKPQPWLVLKLMVAVTLGIMGYAGYVYIGVFVVPMLEERPRTVAGRDVGIALLVPFSVLYAWMVWAYAKVVLTSPGYARDYVEKTQKPMIQQSALAALYPLQTDDMNAIARPSYEDILKATGPPPPSPPKPPPGSISQSNSMASVPQGSAPGMGRTASTITIRSGSSHGRIRFDAGEMANPTLHEDTDEERTAVWSADNSPPAARPSTAGSAASTVPDIEVQAGTLDAPGVPSVPAPQRRRRKTGKSGDRDTPLCLKLLFCCWGSQGNDNADQMERGEYDKSPAKIRKKRRAPPKPKMWIARRPPMTPYLHAAHRYCDKEGFVKPYRTHHCRSCGTCVLKYDHHCPWIGQCVGARNHKFFFNFCVAAFFLTAYVFGTMLAYTAIAHTRGPSIDTSPHQFVIIALSAVFAIFTFALAISHAWLIMHGQTTVENMQIRTMKHRESQQLNNAFGFCQFQAKYLTRKEWDKEWGELDTEGHLWWIGGWILPIGRSKSDGLDYPVNPRFDPEGRWRKREEWPPEFR

SEQ ID NO: 3515 - protein, 881 aa, Streptococcus agalactiae 2603V/R
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIGQAVRLGKEVKPNLKIGICGEHGGEPSSIEFCYQLGLHYVSCSPFRIPIAKLAAAQAKIKQSRNDITIDK

SEQ ID NO: 3516 - protein, 368 aa, Sordaria macrospora
MATHNIVVFGGDHCGPEVVVEAIKVLKSIETNSPSAGKFNLQNHLLGGASIDKHHDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIERIARLAGFLALAKNPPAKVWSLDKANVLATSRLWRKTVTDVISKEFPQLQLEHQLIDSAAMLLVKNPRALNGVVITSNLFGDIISDEASVIPGSIGLLPSASLGGIPDGKGKCNGIYEPIHGSAPDISGKGIVNPVGTILSVAMMLRYSLNLPKEADAVEAAVKAAIDNGTKTKDLGGSATTSDMGNAVVAELEKILKA

SEQ ID NO: 3517 - protein, 555 aa, Mesembryanthemum crystallinum
MQASSCLVKGNLGFEVQNRRRGVLAVAGLGGFKNSSPILSSNLRFVNGVINKKSSSCKLTTSGSVLMGAGLARMGLDHVFQSTAKYRSVKAQAASGDYEDPAPVKFQGKSSASVLPYVGVACLGAILFGYHLGVVNGALEYLSPDLGIAGNTVLQGWVVSILLAGATVGSFTGGSLADKFGRTRTFQLDAIPLAIGAYLCATAQSVQTMMIGRLLCGIGIGISSALVPLYISEISPTEIRGALGSVNQLFICIGILAALVAGLPLAGNPLWWRTMFGIAAIPSVLLALGMAMCPESPRWLFQQGKVAEAEKASAALYGKERVPEVMNDLKASVQGSSEPEAGWFDLFSSRYRKVVSVGAALFLFQQMAGINAVVYYSTSVFRSAGIESDVAASALVGAANVFGTAIASSLMDRQGRKSLLITSFSGMAASMLLLSLSFTWPVLAPYSGTLAVLGTVLYVLSFSLGAGPVPALLLPEIFASRIRAKAVALSLGMHWASNFVIGLYFLSVVTKFGISRVYLGFASVCMLAVLYIAGNVVETKGRSLEEIERALSPAV

SEQ ID NO: 3518 - protein, 540 aa, Nostoc punctiforme PCC 73102
MNTVVTLPTEQAPQTLENVGRFDRPLIIILDFGSQYSELIARRIRETQVYSEVLSYRTTSEQLRQLNPKGIILSGGPSSVYGDNAPHCDPEIWNLGIPVLGVCYGMQLMVNQLGGEVAKADRGEYGKASLYIDDPTDLLTNVEDGTTMWMSHGDSVTQMPSGFELLAHTENTPCAAIADHERKLYGVQFHPEVVHSIGGIALIRNFVYHICDCEPTWTTAAFVEEAIREIRTRVGEKRVLLALSGGVDSSTLAFLLYKAIGEQLTCVFIDQGFMRKYEPERLVKLFQEQFHIPVEYVNARDRFLAKVAGVTDPEEKRRRIGHEFINVFEETSKRLGHFDYLAQGTLYPDVIESADTNADPQTGERVAVKIKSHHNVGGLPKDLRFKLVEPLRKLFKDEVRKVGRSIGLPEEIVQRQPFPGPGLAIRILGEVTSERLNILRDADLIVRQEINQRGMYHDFWQAFAVLLPIRSVGVMGDQRTYAYPIVLRIVTSEDGMTADWARVPYDVLEVISTRIVNEVKGVNRVVYDITSKPPGTIEWE

SEQ ID NO: 3519 - protein, 117 aa, Glycine max
MAGSQDQLEIKFRLSDGTDIGPKSYSAATSIATLKESVLAQWPKDKEYGPRTVKDLKLISAGKILENNRTVGECQSPLCDLPGGVITMHVVVQPPSVEKDKKVASEAKQSKCVCVIL

SEQ ID NO: 3520 - protein, 403 aa, Streptococcus agalactiae 2603V/R
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 3521 - protein, 327 aa, Vitis vinifera
  misc_feature (130)..(130): Xaa can be any naturally occurring amino acid
  misc_feature (146)..(146): Xaa can be any naturally occurring amino acid
MDTQEHQIDLGHLMAFDPLHHFPSPPTSREELVKECLQKGTVLVQLIADALFNLPSTEDIDGPLVKLPPPMTRLPREKHLPKPKPPTKWELFAKAKGIKNRKKDKIVYDEQTGTWKRRHGYDRVNDDKDXPIIEAKMTDAGEDPFXKRQAEKKKRVEKHEKNRLQNLKQAAKVGALPSHIQLAATALPITGTQAAPKKASKNELQDIASMAAAATASGGKFDKKLVGEKPEKHKGKYRKFLPVVEGTGIGSQEKQQTEKVLNRLISKNSHEILNVDKAINMYNVKKEKKRKNQRGKDSSTSSKLKPKKQLQKKSLKKGGSSKKGKSK

SEQ ID NO: 3522 - protein, 320 aa, Streptococcus agalactiae 2603V/R
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 3523 - protein, 236 aa, Thiobacillus denitrificans ATCC 25259
MSETIAARLLTLHDRLARAALDCARDPRAVTLLAVSKTYDHNAVRNIARLGHREFGENYLQEALDKQRALADLDLVWHFIGPIQRNKTRRVAENFSWAHCVDRLCIAERLSEQRPADAPPLNVCLEVNVSGEPSKGGVPADAAIALAKQVSALPRLRLRGLMAIPAPTRDRACQRAAFARVRRLFEALKAHGLPVDTLSMGMSGDFEAAIAEGATIVRIGTAIFGPRFYPELAAHR

SEQ ID NO: 3524 - protein, 370 aa, Bradyrhizobium sp. BTAi1
MATHKLLLLPGDGIGPEVMAEVKRLIGWLNGKGLASFETEEGLVGGAAYDAHGASISEADMDKAKAADAIIFGAVGGPKWDGVPYEVRPEAGLLRLRKDLGLFANLRPAVCYPALADASSLKREIVEGLDIMIVRELTGGVYFGEPKTITDLGNGQKRAVDTQVYDTYEIERIARVAFDLARKRRNKVTSMEKRNVMKSGVLWNEVVTAVHNREYKDVTLEHQLADSGGMNLVKYPKMFDVIVTDNLFGDMLSDIAAMLTGSLGMLPSASLGEVDAKTHKRRALYEPVHGSAPDIAGKGLANPIAMLTSFGMALRYSFDLGALADKLDAAIAAVLASGLRTADIKAEGSTPASTAQMGEAIIKELEKLTA

SEQ ID NO: 3525 - protein, 331 aa, Bacillus thuringiensis serovar konkukian str. 97-27
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKRDFNGNYFLYHLLGAENVIVVPNGADLMEEMHKVAKEVSEKGNTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 3526 - protein, 246 aa, Herminiimonas arsenicoxydans
MTRLALVTGGMGGLGEAICIKLAALGYQVVTTYSPSNTTAGEWLATMKASGYDFRAYPCDVSDYDSAQQCVALIKKEIGEIDVLVNNAGITRDMTFKKMEKTDWDAVMGTNLDSVFNMTKPVCDGMVERGWGRIINISSVNAQKGAFGQTNYSAAKAGMHGFTKALALEVARKAVTVNTISPGYIGTKMVTAIPQDVLDTKIVPQIPMGRLGKPEEVAGLVAYLASDEAAFVTGANIAINGGQHMY

SEQ ID NO: 3527 - protein, 724 aa, Oryza sativa Japonica Group
MATVPTPSEAHGGATPTAADVEMVEASELRRRGKPSGDRATGPSRDGAAAAANKAAAPSVERVFADRPVPSWRGAADGARVRGELLPGHHVQRHRDEAELTTGIIPSLNVSAGLLGFFFVRLWTAAIERVGLLRQPFTRQENTVIQTCVVAGYDIAFSGGFGNYILSMSERIAGLGTEANNAQNIKNPHLGWIIGFLFLVSFIGLFGLVPLRKVMIIDYKLTYPSGTATAFLINGFHTPHGAKIAAKQVKKLGIFFILSFFWGFFQWFYTATDDCGFHKFPSLGLQAFQHKFFFDFSPTYVGVGMICPHIVNVSVLLGGILSWGIMWPLIAKKRGDWFSADLPDGSLHGMQGYRVFIAIALILGDGLYNFLKMIILTAFSLRSQIKKKNASTLPVSDDGMVTTTAAVSYDEERRNELFVKDQIPWYVAYGGYAVVAAISIGTVPQIIPQLKWYQILVAYIVAPILAFCNAYGTGLTDWSLVTTYGKLAIFAFGAWTGASHGGVLAGLAACGVMMNIVSTAADLMQDFKTGYLTLASPRSMFVSQVIGTAMGCVIAPCVFWLFYKAFDNIGISGSDYPAPNAAVFRSIAILGVDGFSSLPKNCLNLCYAFFAAAIVVNLIRDLVPKVSRFIPIPMAMAIPFYIGSYFAIDMFIGTVILFVWQRVDRAKADTYGPAVASGMICGDGIWVLPQSVLALAKVKPPICMKFLSRRTNDKVDAFLTTLGK

SEQ ID NO: 3528 - protein, 400 aa, Bacillus thuringiensis serovar konkukian str. 97-27
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKENDFLPNLELIPEEIADKAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRYGAAFCEKNRAIYQERRDTLVDGFRTFGWNVDKPAGSMFVWAEIPKGWTSIDFAYALMDRANVVVTPGHAFGPHGEGFVRIALVQDKEVLQQVVENIRNSGIFALEKVDELVKN

SEQ ID NO: 3529 - protein, 642 aa, Oryza sativa Japonica Group
MPTASELSRSWAAAAAEGEEAAAQSVERVFADRPVPSWREQLTVRAFVVSFFLVIMFSVIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 3530 - protein, 207 aa, Brassica napus
ALVVSSTSWTPDENFGILLEAAVMYDRRVAARSEGSETAEIAEEQRLYPNLLFIITGKGPEKEMYEEKIKRLNLKHVAFRTMWLSAEDYPLLLGSADLGVCLHTSSSGLDLPMKVVDMFGCGLPVCSVSYSCIQELVKDGQNGLLFSSSSELADQLLILFKGFPGNCDALMSLKAGAMETGSSGRWATEWEDCAKPLINQVVSQNAE

SEQ ID NO: 3531 - protein, 415 aa, Oryza sativa Japonica Group
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMKLVSWYDNEWGYSNRVLDLIGHMALVNAKP

SEQ ID NO: 3532 - protein, 389 aa, Synechococcus sp. RS9917
MSMVPLDAVPEELSAEERQRYARHLSLPELGLEGQKRLRSASVLCVGTGGLGSPLLLYLAAAGVGRIGVVDFDQVEASNLQRQVIHGSASVGQAKTRSAASRLHDLNPHVQVVEHNTRLDPSNALQILEPYDLVCDGTDNFPSRYLINDACVLLGKPCIYGSVQGFEGQVSVFNRTADSPNYRDLVPQPPPPGLVPSCAAAGVLGVMPGLIGLIQATEAIKLIAGLGTCLDGRVLLVDALAMRFRELTLAPSPTREPIQHLIDYQAFCGHSGSAFAQEKQVESVSVRELKALLDSGADLLLIDVRNPAEVEVAVIEGSEHFPLSAIESGAAIEPIRNRASGRSLYIHCKLGSRSAKAVALLAEHGIEAINVSGGIEAWSLEVDETVPRY

SEQ ID NO: 3533 - protein, 390 aa, Pseudomonas putida KT2440
MAQPYSARSRAIEPFHVMALLARANELQAAGHDVIHLEIGEPDFTTAAPIVAAGQAALAAGHTRYTAARGLPALREAIAGFYGQRYGLNIDPERILITPGGSGALLLASSLLVDPGKHWLLADPGYPCNRHFLRLVEGGAQLVPVGPDVNYQLTADLVERYWDKDTVGALVASPANPTGTVLGREALACLARTTHERHGHLVVDEIYHGLTYGMDAPSVLEVDDSAFVLNSFSKYFGMTGWRLGWLVAPPGAVADLEKLAQNLYISAPSMAQHAALACFQPEALAIFEERRAEFARRRDYLLPALRELGFRIAVEPQGAFYLYADISAFGGDAFAFCRHFLETQHVAFTPGLDFGRHLAGHHVRFAYTQSLPRLEEAVQRIARGLQSWQG

SEQ ID NO: 3534 - protein, 339 aa, Burkholderia xenovorans LB400
MDTRSELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYEAAQEKS

SEQ ID NO: 3535 - protein, 328 aa, Burkholderia xenovorans LB400
MDPTGHADPDMKAVLDALRSLDPKPIEDCTVAEARQQPTPADAVRKLMSDPAFSARPSLELEAVRTEDIMIPGATGSNPARVYTPQGEGPFPLILYFHGGGWVLADLDTYDATPRSIAAQSRAIVVSAHYRQAPEHRLPAAHEDAFAAWRWVVEQAPKLCGDAGKIAVMGESAGANLAINVAIHARDTGVRMPMHQALIYPVASNNIVSISYEENRNARPLNKPMMLWFLHNVINSESDLTSSLIDVVSADLSRLPPAVVVTAGIDPLRSDGEKLAQKLHSAGVPVEHRNYRGATHEFFGMAAVVQAARDAQAFVSLAQRQAFGGAPL

SEQ ID NO: 3536 - protein, 347 aa, Listeria monocytogenes EGD-e
MKNTIKWIAIGFAGIILLPLLIVFFIYKKAVGKKDYNPEVLENLDKASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 3537 - protein, 730 aa, Idiomarina loihiensis L2TR
MSLKKLLLLLIIVALFISAFAFDLTQYLSLDVLKEKQQQLNQLFVDYPFQVFAIYFVVYVASTALSLPGATILTLGAGAIFGLGWGLLLASFAASLGAFLAFLSARFILHDWVQEKFGDRLTAINRGMERDGAFYLLSLRLVPLFPFFVINLVMGLTKIKAWTFYWVSQVGMLLGTAVYVNAGTQLAQISSLGDVISADLIGAFVLLGIFPLIAKAVLAFVKRRKAFKGYKKPKSFDNNLVVIGAGSAGLVSAYIAATVKAKVTLIEKHKMGGDCLNTGCVPSKALLHVAELAHNARNASSAGVHVGEVSVDFKQVMQQVKSVIKDIEPHDSVERYTKLGVDVEQGDARIVSPWEVEVTSNVEGKSETKRITTRSIIIATGAKPLVPDFEGLDKVDYLTSDTLWELDELPKRLLVLGGGPIGCELSQAFQRLGSQVTQVEMAERLMGPEDADTVELLTRRLTAEGIDIRLNHKALRFEQHNGESVLIAEQTVDNESVDNQNADQSKDVEIPFDKVLIALGRQPNITGFGLEELGVQTNKTVSTNELLQTNFPNIYACGDVAGPYQLTHVASHQAWYASVNALFDPFKTFRADYSVIPWVTYTSPQVANVGLTEQQAKKADKPYEVTEYDIGELDRAIADDSAYGRVKVLTKPGKDELLGVNIVGPQAGELLAEYVLAMKYGIGLNKILGTIHSYPTLAEANKYVAGEWKRANAPQKLLTWVEKFHRWRRS

SEQ ID NO: 3538 - protein, 357 aa, Chlamydomonas reinhardtii
CIYKFGTSPDSKATVSGDHWDHGLNGENWEGKDGAGNAWVCKTGRKQSPINVPQYQVLDGKGSKIANGLQTQWSYPDLMSNGTSVQVINNGHTIQVQWTYNYAGHATIAIPAMHNQTNRIVDVLEMRPNDAADRVTAVPTQFHFHSTSEHLLAGKIYPLELHIVHQVTEKLEACKGGCFSVTGILFQLDNGPDNELLEPIFANMPSREGTFSNLPAGTTIKLGELLPSDRDYVTYEGSLTTPPCSEGLLWHVMTQPQRISFGQWNRYRLAVGLKECNSTETAADAGHHHHHRRLLHNHAHLEEVPAATSEPKHYFRRVMLAESANPDAYTCKAVAFGQNFRNPQYANGRTIKLARYH

SEQ ID NO: 3539 - protein, 793 aa, Chara corallina
MAAVAEGLNAMTTIPTTTAPADLALAAVTGNTIVSETAVLIFIPAACVIGILFAVLQWSVVGKISVRPSGGGMNYPLMGDEGLEDSSVVTRCAEIQEAISEGAVSFLMTEYKYLSYFMVGFFIVIFAFLGATEDFGTDRKPCEWDATKLCGSGVMNALLSAVAFALGAITSTLCGFLGMKIATFANARTRSRRGGGVGPAFKAAFRSGAVMGFLLTSLGLIVLYFTILIFQRYYGDDWIGLYESIAGYGLGGSSVALFGRVGGGIYTKAADVGADLVGKVERNIPEDDPRNPAVIADNVGDNVGDIAGMGADLFGSLAESTCAALVVSSLSDFGKEMNYVAMSFPLLITGAGILVCLITTLVATDLTSGVSNIKGIEPALKQQLVISTVLMTPVIALLAWGCLPDTFEIINGAETKVVKKWYMFFCVACGLWAGLLIGYTTEYFTSHQFTPVRDVADSCRTGAATNVIFGLALGYKSVIIPILAIAFTVFVSHTLAAMYGIACAALGMLSTLSTCLAIDAYGPISDNAGGIAEMAEMGPAIREKTDALDAAGNTTAAIGKGFAIGSAALVSLALFGAYINRAGITSVDVILPKEFVGLIVGAMLPYWFSAMTMKSVGKAALAMVEEVRRQFNTIAGLMQGTVKPDYKRCVEISTDASLREMIPPGCLVMLTPLVVGGLLGKETLAGILAGALVSGVQIAISASNTGGAWDNAKKYIEAGGNDHARTLGPKGSDCHKAAVIGDTVGDPLKDTSGPSLNILIKLMAVESLVFAPFFKTYGGVLFVLWDKFVAGKY

SEQ ID NO: 3540 - protein, 310 aa, Selenomonas ruminantium
MAKIYNSVTELIGNTPLLKANNFIEANDLQANILVKLEYLNPAGSVKDRIAKAMIEQAEKEGKITKDTVIIEPTSGNTGIGLASFAAARGYKAILTMPETMSVERRNLLKAYGAQIVLTDGAKGMKGAIAKAEELAKETPNAFIPSQFTNQANPAIHEATTGPEIWQDAEGKVDVFIAGVGTGGTLTGVGRYLKKQNAAVHIVAVEPESSPVLSQGTAGPHKIQGIGAGFVPETLDTKVYDEVLPISNEDAFKYGRQFAHSEGVLVGISAGAALAAAVQLAKRPEFAGKNIVALLPDTGDRYLSTELFND

SEQ ID NO: 3541 - protein, 321 aa, Bacillus thuringiensis serovar konkukian str. 97-27
MSIVNKKIIFFGDFGIDDAVALIYANKTCKLDILGIVAEYGNVSREIVTENVYFLERYYATEVKIIEGAARPMTAEEPLFFPEIHGEHGLGPIIPPDMRICKRENFCELIKLIEPCPEDIIIVATGRLTTLATLFLLYPNVMDKVCSYYIMGGAFLFPGNVTPVSEANFYGDPIAANIVMKYAKNAHIYPLNVTQEALITPEMVDIINKEGTGQAKLIKPMIDFYYENFYKKEYPGIAGSPIHDLLPFISFINDDIFEYKKSAVWISTTNDVTRGQSVADFRKIAEPTRFDDRPIQRIAVGFNYPAFKEEFMRTILKPDCP

SEQ ID NO: 3542 - protein, 308 aa, Geobacter sulfurreducens PCA
MEHPPFSLAGSIGATPLVELRHLNPNPRVRILAKLEGNNVGGSVKDRPALYMLAKAEESGELVPEKTILEPTSGNTGIALAMLGTVKGYRVKLVMPACVSLERRAVLEAYGAELVLSPHDEATDGAIRLAHRILEEEPDRYYMPNQYANPNNPLAHYETTAPEIFRDTGGAVDFFVAGMGTGGTLMGTSRYFREKKPSVRIVGVEPRLGHKVQGLKNMQEAIVPPIYHPEALDLKLTVHDEPAFDTARELAAREGLFVGMSSGAAVAGAVQVARDAPAGSTIVVLLPDRGDRYLSTVLFRSVCGKCPP

SEQ ID NO: 3543 - protein, 356 aa, Clostridium perfringens str. 13
MLYSLILAGGKGTRLYPLSRSSNPKQFLSIHNNGKSFLSNTVDRIRPIIHKDNIYVVTNQEYEDKTRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADVILREIEKYIPKMYKCLMEIYQHIGEDDEEEIIKEQYSLIDGISIDFGVMQKTRRSFVIKCDFSWDDIGTFSALSRFLGHNGNNRTSDNVFLEECENCSVFGKEKLIIGFGIKDLVLVDAGDVILVMDKGRDQEIKHLLNSISGKKEFKEYL

SEQ ID NO: 3544 - protein, 284 aa, Francisella tularensis subsp. tularensis SCHU S4
MLKTKSLTPHEYDIIINKATEKPFTGRYNDLDQKGVYICRNCGTPLFRADSKFISACGWPSYDIHIDNNVKQLPDADGRRTEILCNNCDGHLGHIFHGEGYTKLNTRYCVNSACVDFIPIEDFGTTEEIIVAAGCFWGVEYYMKKLPGVLFAESGYCGGDQPYPDYKKVCQGDTGYLEVVRVIFDTSKVSLQQVLKYFFEIHDFEQVDGQGPDIGEQYKSAIFYYDDKQKQIAEDLKHILAQKGYKVATEIRAMKPYYVAEDYHLDYYMKKGTLPYCHSHKKIF

SEQ ID NO: 3545 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 3546 - protein, 490 aa, Ralstonia eutropha JMP134
MVPNTAQEKDLQRWLGKQRAAFMASPFPSLGERRDTLRCLRTAIRGHAHRLAAAAQRDFSARAEAETLMVDVLPSVMHINHLLRGLRRWMKPSRRHTELLFFGNSARVMYQPKGVVGIVVPWNFPVYLALGPLATALAAGNRCMVKTSEYAPHTSAALRALLREVFDEDRVAIVEGDAEIARAFTSLPFDHIVFTGSPEIGRHVMRAAAANLTPVTLELGGKSPAIVSRSANLRTAATRIAHGKTVNGGQICVAPDYALVPAEDAEPFAQAVLDAASQMHPQGSDDYTAVIHDGALARQRALLDDARALGARVFSAAMPSGGRRLPLHVVLGVTPQMRLAQEEIFGPILPVFTYRSFDEAIAHVQSGTRPLALYYFGHDKAETGPLLERTHAGGVTLNDWGWHVVNHDLPFGGSGTSGMGNYHGAEGFRELSHAKSVFAERRWFPIELFHPPYGSWVQRLAMRLFLGAPAQGESQRGTPAGTQPAHRSTD

SEQ ID NO: 3547 - protein, 458 aa, Clostridium perfringens str. 13
METLREKINKQREYFSTGETKDINFRIEKLKKLRDVLKSEEEKIFEALKKDLMKSSFESYVTEVAMVYDEINMHIKNIKKWSKKRRVKTPLVQLPAKSFIQLEPYGVVLIIGPFNYPFMLTMDPLIGAIAAGNTAVIKPSESAPETSKILKEILEKVFDEKYVLHVNPERGKEVVEELLKEKFDYIFFTGSATVGKIVMKAASQYLTPVTLELGGKSPCIIDKDCKLELAARRIVWGKLLNSGQTCVAPDYLYVHKDIEEEFIKKLEEEIKNQFGDNPLESEDYSKMVNEREFNRVLSYIDKEKLVFGGNYNIKTFQIEPTILKNVTWNDPVMEREIFGPIFPILPFENLDEVIRLVNSKDKPLAIYYFSEDKNKIEKVLNSTSSGGVTINDTLVHVSSSYLPFGGVGNSGMGEYHGKYSFDLFSNKKGVMNRKTFLDLKIRYAPFQNKLTIVKKIMK

SEQ ID NO: 3548 - protein, 316 aa, Synechococcus sp. RS9917
MGAGSMGACWQQWRPVRVQAELEQLLDRQPQLAAGARLQRFQPVGGGCSQQAYQLQLSDGRLLFAKAGDPSMLKAEQRGLQALHRHLDPTDLWVPEPLVFDAGTSARGWLLLSWHGFTQGDQARLGRGLARLHRRSAQQGSLENGAGWFGWAWDGYIGLGHQPGGWCQSWGEAFVELRLRPQLEQAQSWGLALADLDPWLDELRDRLDRHGPDAALVHGDLWGGNAAVLADGRGLIFDPASWWADREVDLAMTRCFGGFSQAFYSGYHQEWPLPPGADQRVEIYNLYHWLNHANLFGGGYRQQCLRFLHHRPALSW

SEQ ID NO: 3549 - protein, 368 aa, Candida glabrata CBS 138
MLGIRSFRLNARRFLATAQPSIGRFTGKPNPSTGKFTVSFIEGDGIGPEISSSVKRIFQAADVPVEWETCDVTPIFVNGLTTIPDPAVQSINKNLVALKGPLATPIGKGHRSLNLTLRKTFNLFANVRPAKSIEGFKTTYENVDLVLIRENTEGEYSGIEHLVSPGVVQSIKLITRDASERVIRYAYEYARAIGRPRLIVVHKSTIQRLADGLFVNVAKELAAEYPDIQLETELIDNTCLNVVSNPSSYTDAVSVCPNLYGDILSDLNSGLSAGSLGLTPSANIGHKVSIFEAVHGSAPDIAGQNKANPTALLLSSVMMLNHMGMTEHADRIEKAVLGTIAGGSEYRTGDLGGSASTTSFTDAIIKKL

SEQ ID NO: 3550 - protein, 339 aa, Triticum aestivum
PDLVQFVSGFADVGEEIVKCGVKHVTFIGSPGVGKLVQKNAADHLVPCVLELGGKDCAILLKDTDLVQAIPVLMRGVFQNCGQNCIGIERIIVAEEIYDKVVDEMDSRISKLRQGSVLVDGEGVDCGAMTMGNQFEKLEGLVQEAVSRGARLLRGGKRYHHPSHKHGQYFEPTLLVDVTPDMAIANNEAFAPIMVIMKHQGPDDAVRIANECPYGLGSSVFSADKSLAESICLRLKVGMANVNDFAVNYLCQSLPFGGVGISGYGRFAGQEGLRGLCVPKAITIDRIPGVKTPIPPILDYPITSAANGWTFVESLVNLVYHPEIPAKIKAMIGLAKAHL

SEQ ID NO: 3551 - protein, 482 aa, Synechococcus sp. RS9917
MLEARAHQQLKTLLQHDRVAWPHHLTLSRLIARSVRRGDRALIQLTPGSEEQWWLGLLVPLCLQRHRCVLVLEADQRRRLLQVERPRLREAGLHLPCWQGLEPPDGEQLWLLTTQELVQAHRQGQLHNDHLLLIPDADQLSHRLRQALALTLQSQDWERLRQAHPNADASLLDLHDRLSRQVFRQATRRDATVRLESGQLQALRDLLTVLHPLPAPWDRVLKADPSHWACWADLDHRLLQWRWQLQMLEPLRQHQGLLNQRAAILISSAGESAPLQTELNDAGFDAEVVVRLREPTLLEPLPLFAPRRQPLPNTEVFAQHLLEQSRRLILGRAGLTVILLDDNRLRQRLTSELASEFGSRVIEAATAPEANGVICCRWSWWLQHQTQLPPPEQLIIALLPIASLEAPLTAARVEALKRQGRDWFRDLLLPEALSLLAPAVAPLRRSGGRLAVLDGRLRGRSWGEQVFSALQPWTPLHRLLPD

SEQ ID NO: 3552 - protein, 156 aa, Clostridium perfringens str. 13
MRIGMGYDVHKLVENRDLILGGVKIPYEKGLLGHSDADVLLHAIMDSLLGAAALGDIGKHFPDTDPKYKGADSIKLLEFVGELLNKNNYKISNIDATIIAQRPKMAPHIPTMRENIAKALNIDLDQINVKATTEEGLGFTGSGEGISSQSICLLVK

SEQ ID NO: 3553 - protein, 451 aa, Arabidopsis thaliana
  misc_feature (439)..(439): Xaa can be any naturally occurring amino acid
MGKENAVSRPFTRSLASALRASEVTSTTQNQQRVNTKRPALEDTRATGPNKRKKRAVLGEITNVNSNTAILEVVKTIAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKXQICGGSHVSKAT

SEQ ID NO: 3554 - protein, 499 aa, Glycine max
MVLTSTATHPDEQDQSLNYTFASRYVREPIPKFKMPEKSIPKDAAYQIINDELMLDGAPRLNLASFVTTWMEPECDKLIMASLNKNYVDMDEYPVTTELQNRCVNIIANLFHAPISDDETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLDELLTKKNNETGWDTPIHVDAASGGFIAPFLYPDLEWDFRLPLVKSINVSGHKYGLVYPGVGWVVWRSKDDLPDELVFHINYLGSDQPTFTLNFSKGSSQIIAQYYQLIRLGFEGYKNIMENCWENARVLKEGIERTGRFNIISKDIGVPLVAFSLKDSSQHTVFEIADHLRKFGWIVPAYTMPPDAQHIAVLRVVIREDFSRGLAERLAADIEKVVKLLDTLPSPLTTKAVHITAITSETGEKIKKAAIETQKEIAFYWKRLVDGKRLGAC

SEQ ID NO: 3555 - protein, 554 aa, Pseudomonas putida KT2440
MAYYRTPHDVTALPAWQALQKHRDAMQSFSMREAFAADAKRFDQFSLSACGLFLDYSKNLITEQSRDLLVNLANEVGLQDAIKSMFSGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWDANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRAKGLNEADIEKLAPHKVIPGNRPSNTLVVERISPRRLGALVAMYEHKVFVQSVIWGINAFDQWGVELGKELGKGVYQRLVGSLEDSAEDGSTQGLINYFRGRHRG

SEQ ID NO: 3556 - protein, 437 aa, Coprinopsis cinerea okayama7#130
MTDLFVQASGPLRTKRNFKGLALSAEPPSPPPPGGKKRPPPLGAAMALGGGPAPLGGLPLLDDLPGESPATGRHSAMQATLSDKLAKLELKKRIKDLKNDDLKKLSDLGQGNGGSVEKVEHLPTGTIMAKKSVLIDAKSSVRKQILRELDIMHECQSDYIISCFGSFLAEPNICICMEFMDKGSFDGIYKKLGPLQVEVVGMVALSVLEGLTYLYDVHRIMHRDIKPSNILFNSQGQIKLCDFGVSGEVINSIANTFVGTSVYMSPERIQSHGDGYSVKSDVWSLGMSLVELALGAFPFTDPPDDDDDDLSDLEGDSSSPSPSDAQHQRTPTHRDSFLLSKKTAKRASKRRSKLTYNPDGQLSTMSIFELIHQIVQEPSPRLPSDKFPADAVDLVDICLLKNPEERQTPKALLVRNHPWIVAIRESDFDIQAFAATV

SEQ ID NO: 3557 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 3558 - protein, 462 aa, Roseovarius nubinhibens ISM
MPEKRDAETRNRDFDEIYAEYAAEKAAEQAGRCSQCGVPYCQSHCPLHNNIPDWLRLTAEGRLREAYEISQATNTFPEICGRICPQDRLCEGNCVIEQSGHGTVTIGSVEKYITDRAWEEGWVGVPTPREERAESVGIIGAGPGGLAAADMLRQAGVQVTVYDRYDRAGGLLTYGIPGFKLEKPVVMRRIEQLEKGGVTFVLNCTVGEDMSFAEIRGKHDAVLIATGVYKSRDLGGPGAGAKGIVKALDYLTASNRASFGDTVPEIESGELNAQGKRVVVIGGGDTAMDCVRTAIRQGAESVKCLYRRDRANMPGSQREVQNAEEEGAVFEWLSAPKGFAGDSVSAVKVQKMRLGAPDATGRQVPEEIEGAIEDMEAELVIKALGFEPEELPTLWGEPGLDVTRWGTIRAEYQTGRTSLEGVYAVGDIVRGASLVVWAIRDGRDAAQAILEDLSAARAVAAE

SEQ ID NO: 3559 - protein, 452 aa, Oryza sativa Japonica Group
MRRGAPPPAPAAEGCWPSPPASPRRSRRPLREAAVYGGVGGGGCCLEFLDCVLRAMGVATPAEIMPPADFRWAARPMRRRRRGGSSSSSSSPRDREPRDGRIAANGASAAASLYTMRGNKGVNQDAMLVWENFCSKEDTIFCGVFDGHGPYGHLVSKRVRDLLPIKLSANLGRDGHKETSTNIVTSSMTEGGGTERMDRDTETPLGTEENGDYPEMFAALRTSLLRAFYVMDRDLKFHKTIDSVFSGTTAVTVIKQGHDLLIGNLGDSRAVLGTRDEYDQFFAVQLTVDLKPTIPSEAARIRERSGRIFSLPDEPDVARVWLPKYNMPGLAMARAFGDFCLKDYGLISMPDVSYHRITEKDEFVVLATDGVWDVLSNSEVVSIVSQAKSEASAARFVVESAQRAWRTRFPTSKIDDCAVVCLFLNTDARNKPPGSGIKDLANAIELGGGNLS

SEQ ID NO: 3560 - protein, 324 aa, Dechloromonas aromatica RCB
MPHAIRFHQTGGPEVLSWEDVDLPAPAPGEATVRHHAVGLNYIDTYHRTGLYPLTLPSGIGMEGAGVVEAVGEGVGEVKVGDRVAYAGGPLGAYAEVRNIPAHRLLKLPDSISFATGAAMMLQGLTAAYLLRKTYRVQPGDAVLIHAAAGGVGLIACQWAKALGATVIGTVGSSAKAELAKAHGCDHVINYSSENFTQRVREITAGEGVAVVYDGVGKDTFIGSLDSLRPLGMMVSYGNASGPVPPLDLLLLSQKGSLFITRPTIATYTAKRADLEALGAELFDAVVSGKVRIEVNQTYALKDAAQAHRDLEARKTTGSTILLP

SEQ ID NO: 3561 - protein, 595 aa, Glycine max
MGICLWKWQWPWLLYVLLIHVVIYKSGAITPDGEVLLSFRTSVVSSDGILLQWRPEDPDPCKWKGVKCDPKTKRVTHLSLSHHKLSGSISPDLGKLENLRVLALHNNNFYGSIPPELGNCTELEGIFLQGNYLSGAIPSEIGNLSQLQNLDISSNSLSGNIPASLGKLYNLKNFNVSTNFLVGPIPSDGVLANFTGSSFVGNRGLCGVKINSTCRDDGWPDTNGQSTNSDQNQIGKKKYSGRLLISASATVGALLLVALMCFWGCFLYKKFGKNDRISLAMDVGAGASIVMFHGDLPYSSKDIIKKLETLNEEHIIGIGGFGTVYKLAMDDGNVFALKRIVKLNEGFDRFFERELEILGSIKHRYLVNLRGYCNSPTSKLLIYDYLPGGSLDEALHERADQLDWDSRLNIIMGAAKGLAYLHHDCSPRIIHRDIKSSNILLDGNLEARVSDFGLAKLLEDEESHITTIVAGTFGYLAPEYMQSGRATEKSDVYSFGVLTLEVLSGKRPTDAAFIEKGLNIVGWLNFLITENRPREIVDPLCEGVQMESLDALLSVAIQCVSSSPEDRPTMHRVVQLLESEVVTPCPSDFYDSNSD

SEQ ID NO: 3562 - protein, 252 aa, Hordeum vulgare subsp. vulgare
MAGATSATAAAGAFAAAKARGPAAACPWLVAAGGRRRSGVVRCDAGGDAQAASKAASITALEQFKISADRYMKEKSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKL

SEQ ID NO: 3563 - protein, 373 aa, Myxococcus xanthus DK 1622
MSHDSEISSIDDAIRDIQEGKFVIVADDEDRENEGDLIMAAEKVTPEHLAFMVRHTSGIVCMPMLAERLDELRLPQMVSDNTESHRTAFTVSVDYRHDTHTGVSAADRAKTIRALVDPSSKADDFLRPGHIFPLRYREGGVLRRAGHTEATVDLSRLAGLSASGILCELVKDDGTMMRMPDLKVFAREHKLSLITIADLIEYRRRKDRLVRREPGQQTVNTRYGEFTALTYSWLPDGVKSLVLVKGDPASRPSTLVRLHAACALGDVFGSPSCNCNVLLDQALARIAREGSGVLVYLPGMHGDDFGIHHKRNNDGSSGPTRGPQESRDLGMGCQILTDLGIHTLQVMTNSDVTYRGLAGFGLTIEKRVPLQPD

SEQ ID NO: 3564 - protein, 339 aa, Hordeum vulgare subsp. vulgare
MAGATSAAAAFAAAAAAASAKAAACPWAAAGGRRRSGVVRCDAGGDAKAASKAASITALEQFKISADRYIKEKSSIAVIGLSVHTAPVDMREKLAVAEELWPRAISELTSLNHIEEAAVLSTCNRMEIYVVALSWNRGIREVVDWMSKKSGIPASELREHLFMLRDSGATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAADADVVFTSTASESLLFTKEH

SEQ ID NO: 3565 - protein, 424 aa, Xylella fastidiosa Temecula1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 3566 - protein, 245 aa, Euglena gracilis
TMKAAVVEQFGKPLAIREVPVPEPGYGQVLIKIIASGVCHTDLHVRDGDWYVKPNLPIIPGHEGAGVVVKVGEGVSTLKVGDRVGSAWLHDSCGHCHYCRAGWETVCGHQAQTGFASNGCFAEYSIAEAEYIGVIPDGLSYSQAAPVLCAGVTTYKALKETEVKPGQWVAILGACGGLGHVGVQYAKAMGMKVCAVDFGEERGNYAMNTLGCRSYVDVKGRSSEEIVAAVKKACDGEGSHGSVVL

SEQ ID NO: 3567 - protein, 263 aa, Physcomitrella patens subsp. patens
MIEEARWDSNKEPALASYLYSTILSHRTLERSLAFHLGNKLSSSTLLSTQLFNLLHDTFMEDADIRRAIRDDIEAVKERDPACVSYIHCLLNFKGFLSCQAQRVAHRLWNQGRHSLALAIQSRVSEVFQVDIHPAARIGSGVLFDHATGLVVGETAVIGNNVSILHHVTLGGTGAVGGDRHPKIGDGVLIGAGATILGNISIGAGAKIGAGSIVLIDVPPHTTAVGNPARLIGGKQKPAKLSETPGETMDHTFIMKDWSDYVI

SEQ ID NO: 3568 - protein, 301 aa, Corynebacterium glutamicum ATCC 13032
MIPVLIDCDTGIDDALALIYLVALHKRGEIQLFGATTTAGNVDVKQTAINTRWVLDQCGLADIPVLAGQPEPKHVPLVTTPETHGDHGLGYINPGHVEIPEGDWKQLWKEHLSNPETKLIVTGPATNLAEFGPVENVTLMGGTYLYPGNTTPTAEWNTWVDPHGAKEAFAAAQKPITVCSLGVTEQFTLNPDILSTLINTLGSQPIAEHLPEMLRFYFEFHEVQGEGYLAQIHDLLTCMIALDKIPFSGREVTVDVEADSPLMRGTTVADIRGHWGKPANAFLVETADIEAAHAELLRAVE

SEQ ID NO: 3569 - protein, 1112 aa, Arabidopsis thaliana
MTMMSDLSLDLVEEILCRVPITSLKAVRSSCKLWNVLSKNRILCKTEARNQFLGFTIMNHRLYSMRFNLHGIGLNENSEEFIDPSIKPIGNLLNQVEISKVFYCEGLLLCVTRNHSSKLVVWNPYLGEIRWIKTRNDYHIGVTYALGYDNNKNHMILRFFSEQGYYEIYDMNSSDSWDCFYGIPNKGLKCYQPGASLNGNAYFLTEGREVMEGYDCLLGFDFTTKKFGPLLSLSFSHDFIETGRLSCVKGEKLAVLYQRCYTYEMEVWVTTKIEPNAVSWSKFLAVEMEPLTSLKFNDDSGSFFIDEEKKIVVVFDIDESERNNTAYIIGDYGCLKEVDLDEVVNPQESVEVGDRIYSFSPFVCSCSYVPSLVKFKEDAEHERKDKKRKSKRKRTNKDGYDFILCFDFTTERFGQILPLPFKHSFRDTWTLSSVKEEKLAVAVLYWKNTCVMIEIWMTIKIDPNVESWSKFLRVDRKPCIDLRFDDRNDSFFIDEEKKVVVFFSSDKVKTSTAYVIGDNRYLRTVDLEKAANSQESVEVGERVYCFSPLVCSCSYYVPSLVKINHNAGRKRKEKKTKRKSKDKQMKLSNKVPGFCFPQCYVLISSNTWYRDVDGEPIVDFDDFGNDREPSTEPLQDFDEDLADDIGDWDGEGSQTPVYDNDKVAKPRKRLVKKSSSERVTIDVPELIDEDVDDAEFDEFMGGRGGGSTDYDDKVGRKRKKEKERSSSGSGKEKRHKFPNRGERKSEEIDEMWKSIAHNPENDEEGVRTMDDDNFIDDTGLDPSERYGGDAGDRSPTHYPQAEEGEDEDEVNNLFKMGKKKKKTERNPAEIALLVENVMAELEVTAEEDAELNRQGKPAINKLKKLSLLTDVLGKKQLQTEFLDHGVLTLLKNWLEPLPDGSLPNINIRAAILRVLTDFPIDLDQYDRREQLKKSGLGKVIMFLSKSDEETNSNRRLAKDLVDKWSRPIFNKSTRFEDMRNLDEDRVPYRRPPVKNFSSCSTGDRPSNKATMESRDGDFDLEIRERKTGLTSGQSSRGDRQMTMRPEATPLDFLIRPQSKIDPDEIIARAKQVSQDQRRVKMNKKLQQLKGTKKKRLQATKVSVEGRGMIKYL

SEQ ID NO: 3570 - protein, 190 aa, Glycine max
  misc_feature (117)..(117): Xaa can be any naturally occurring amino acid
  misc_feature (150)..(150): Xaa can be any naturally occurring amino acid
KNPSFESFPLSPLFPLSDSIPKQIPLSEDFASIFINLDCKLDLKTIVLQARNAEYNPKRFAAVIMRIRDPKTTALIFASGKMVCTGAKSEQQSKLAARKDFKIQIIVGSCDVKFPIXLEGLAYSHGAFSSYDTELCCRLIYRMKQPKMVXLLIFVSGKIVLTGAKVIFLLIIPPPPLVHWIFFSVFISIF

SEQ ID NO: 3571 - protein, 182 aa, Mycobacterium tuberculosis H37Rv
MADCDSVTNSPLATATATLHTNRGDIKIALFGNHAPKTVANFVGLAQGTKDYSTQNASGGPSGPFYDGAVFHRVIQGFMIQGGDPTGTGRGGPGYKFADEFHPELQFDKPYLLAMANAGPGTNGSQFFITVGKTPHLNRRHTIFGEVIDAESQRVVEAISKTATDGNDRPTDPVVIESITIS

SEQ ID NO: 3572 - protein, 457 aa, Pseudomonas putida KT2440
MPWTAQMRLERTSFGKRLGTYAEAIELPAQPIVEGRLLRMVGLTLEAEGLRAAVGSRCLVINDDSYHPVQVEAEVMGFAGPKVFLMPVGSIVGIAPGARVVPLDDGGRLPMGMSMLGRVLDGAGRALDGKGGMKAEDWVPMDGPVINPLNRDPISKPLDVGIRSINGLLTVGRGQRLGLFAGTGVGKSVLLGMMTRFTEAEIIVVGLIGERGREVKEFIEHILGEEGLKRSVVVASPADDAPLMRLRAAMYCTRIAEYFRDKGKNVLLLMDSLTRFAQAQREIALAIGEPPATRGYPPSVFAKLPKLVERAGNGEPGGGSITAFYTVLSEGDDQQDPIADSARGVLDGHFVLSRRLAEEGHYPAIDIEASISRVMPQVVDADHLRQAQKFKQLWSRLSQSRDLISVGAYVAGGDPETDLAIALQSKLVEFLRQGLRENVGMAQSREQLGAIFTPPAG

SEQ ID NO: 3573 - protein, 214 aa, Burkholderia mallei ATCC 23344
MTDETADDRPRRFATPGRVSRPLRMREAGLGRVVCRERPYRYEGPGMIQVGDTLPDAQLFEYLDDARAGCTLGPNAFGVREQTAGKRVVIFGLPGAFTPTCSAQHVPGYVAHAEPLRSAGIDEIWCVAVNDAFVMGAWGRDLHTAGKVRMMADGSAAFTHALGLTQDLSARGMGIRSRRYAMVVDDGVVKTLFVEAPGKFEVSDAASVLAGLTR

SEQ ID NO: 3574 - protein, 199 aa, Zea mays
MGKAKSKGPKFAAVKKIITKKTINKYKEDVLNHKKKDVDKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 3575 - protein, 693 aa, Zea mays
MAAGRHGGYRDYEERERELDAEASRRSKEQHHHLGGRHRDVDRRRDGGRSRGGRDFANGHGRRRSPPPRSRLAGRLGDREPGEVLSGSASDDSGGRSDRGRENGVRSSSREGDMVAGTGISSPIKKRKFSPIIWDRDSPKPPHSGAARDKKSVESVPSELPPPPPLPQDHIPLSLSVEKSPMDVETTVGTESAEQLPEHEVNKVIEQEEDYPSPTMRNISTSRWAGANDDEEGGAAPMKKRSVSPADSSVPGQWKRASPEPGEVSGGRAMSRSSDSGKIGNDEKEDSEADEDDYMDVDKGHASDSDTENRMSDTDSDNEIHRPETPEREKAPHRCINMLQDCRSVDEFERLNKINEGTYGVVYRARDKKTSEIVALKKVKMEKEREGFPLTSLREINILLSFHNPSIVDVKEVVVGSSLDSIFMVMEYMEHDLKGVMETMKQPYTQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPSEKIWPGYAKLPGVKVNFVKQPYNRLRDKFPAASFSGRPILSEAGFDLLNRLLTYDPDKRISADDALKHKWFSEVPLPKSKDFMPTFPALNELDRRTKRYLKSPDPLEEQRLKELQGNIGNRGLFG

SEQ ID NO: 3576 - protein, 453 aa, Zea mays
MASPAAASPARRLSVIFSSTKPRARPPKPAPAPKAPAGQAVAKPDERCESRNLTKILQVIFRERDPDKLVSQFIAESTASERFRNKHRVYDVAVARLASFGRHDGIAAIIDSQKPFIAASSVGFAARLIRLCGRASMPSHAAAIFHDLPPKHKSSMTFNALLAAYLDASDFDALATALQEIPATHPTIAPTIYSHNILISALCKKPDLSAAVDVITLMEKRGITPDIISFNILLNGFYSNDRFDDVEKVWEMMKERNVEPDARSYNAKLRGLVSQGRVEDAAALIERMQKEGPKPDSVSYNELIRGYCNEGRLNEAKKVYDNMIKNGYAPNRGTFHTLVPHFVEAGELDHALSCCHEIFTRKCRVQCSLLQGVVTALFAASRVEEAKRIVHLGRENYYPRKGLRMPPRTRKDEGLKMPQPGGEGNDVEAGTDSEDSVSYEDGCEQEEESKNGQ

SEQ ID NO: 3577 - protein, 325 aa, Listeria monocytogenes EGD-e
MSDLFTTIKGQVTGKNVRIVLPEGTDERIVGAAARLQKENIVKPILLGNKAEIEAKAKEIGVSVEGIAIHEPATDPLFDELVAAFVERRKGKATEEAARKMLVDPNYFGTMLVYTGKAEGLVSGAAHSTGDTVRPALQIIKTKPGVSKVAGAMIMVRGEERYLFSDVAINIAPVAADLAENAIVSAETAEIFGIDPRVAMLSFSTKGSAKSDETEKVVEATALAKEKAPELTLDGEFQFDAAFVPTVAEKKAPGSVIKGDANVFIFPSLEAGNIGYKIAQRLGNFEAVGPILQGLNAPVNDLSRGCNTDDVYNLTLITAAQAVNK

SEQ ID NO: 3578 - protein, 172 aa, Vitis vinifera
MESHDETGCQAPEGPILCINNCGFFGSAATMNMCSKCHKDLALKQEQAKLAASSIGSIVNGSSSGNGKEPIVAGTVDVQAGPVEVKAISAEASNDSSSNQIIESKVKEGPNRCTACRKRVGLTGFNCKCGNLFCAVHRYSDKHDCPFDYRTAARDAIAKANPVVKAEKLDKI

SEQ ID NO: 3579 - protein, 228 aa, Oryza sativa Japonica Group
MASMAPSAMVLIVLLVLVVLPSSTLCSRAGPSSKHGHGGGHAKRVPPPASVPPPPPPPPAPAALVRATCNSTSYYDLCVAELSADPSSATADVRGLSSIAVSAAAANASGAAQAASALANATDAGTTAGVAGDGGGAVVQRLLATCAAKYGDARDALAAAKGSIAQQDYDMASVHVSAAAEYPQVCRTLFGRQSPGDYPPELAATEVALRQLCSVALDIIALLSSSSN

SEQ ID NO: 3580 - protein, 296 aa, Haemophilus influenzae R2846
MGHFSEELQQVQNRINHFLEAQFEGIESHNAPLLDAMKYALLLGGKRVRPFLVYATGQMLGAEKQSLDYVAAAIEAIHAYSLIHDDLPAMDDDNLRRGHPTCHIQFDEATAILAGDALQSFAFEILTKTPNISAEQKLALVQILAQGSGVQGMCLGQSLDLISEHKQISLSELELIHRNKTGALLIAALKLGFICSPHFTDKKLEQSLTQYAEAIGLAFQVQDDILDIEGDSAEIGKQVGADLDLDKSTYPKLLGLSGAKQKAQDLYQSALSELEKIPFNTTALRALAEFVITRKS

SEQ ID NO: 3581 - protein, 144 aa, Clostridium perfringens SM101
MIYSEKVMDHFKNPRNVGEIKDANGIGEVGNAKCGDIMRIYLKIENNIVEDVKFETYGCGSAIASSSMATELIKGKTVEEAWELSNKAVAEALDGLPPVKMHCSVLAEEAIHKAINDYRQRQGLEPWDMKEHSHDIHEHVHGQE

SEQ ID NO: 3582 - protein, 251 aa, Pseudomonas putida KT2440
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 3583 - protein, 267 aa, Burkholderia xenovorans LB400
MSITQRNNIRISGSGKRTMVLAHGFGCDQSMWRYLAPSFHGEYRTVLFDHVGSGSSDLSAYDTDKYDSLQGYADDLIEIIREVAEGPVVFVGHSVSAMIGLIASLDEPALFRAHIMVGPSPCYVNDGDYTGGFSREDIDDLLRTLESNYLGWSSTMAPAIMGAPEQPELGVELTNSFCRTDPEIARQFARVTFLSDHRAILSRATTPTLILQCSDDIIAPRVVGEYMHRMMPGSTLHLIENVGHCPHLSSPGASAAAMSAFLGPMSP

SEQ ID NO: 3584 - protein, 498 aa, Zea mays
MAWARLASRSRLRPAASAAGRSRHASTPAPPPPPSPPTTRTVPAATSAPPLRRLLLLPRHRFADATPSASTAWLLGARWRQGHGRRCFASAAYPAQATPGEASELVDVPLAQTGEGIAECELLRWFVAEGDQVDEFQPLCEVQSDKATIEITSRFKGKVHKIHFVPGDIVKVGETLLKMVVGDSQIVSPANIVPSAAVRHLAKQYGISINEIVGTGKDGRVLKEDVLNYAVSKGVCKQQSLASEGNIGQVELLEEGKALLDEDFYEDKKILLRGYQRSMVKSMSLAAKVPHFHYLEEINCDSLVQLKTTFQNENKDQTIKHTFLPFLIKSLSMALSKYPMLNSSFIEETNEVVFKGPHNIGVAMATTHGLVVPNIKKVQSLSILEITKELARLHEMASQNRVSAADIEGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 3585 - protein, 463 aa, Vitis vinifera
MASVLKFPSFKFLNPNPISPTSASVQVGFRRFSCSAPSSAAVEGDSSIGSVSLGHLTRPDFPILHQEVNGSKLVYLDNAATSQKPTAVLKALQNYYEAYNSNVHRGIHFLSAKATDEYESARRKVAAFINASEPGEIIFTRNATEAINLVAYSWGLSNLKPEDEIVLTVAEHHSAIVPWQLVAQKTGAILKFVNLTEDEVPDVEKLKEMISRKTKLLVVHHISNVLASALPIYDIVHWAHAVGAKVLVDACQSVPHMAVDVQRLDADFLVASSHKMCGPTGIGFLYGKSDLLFAMPPFLGGGEMISDVFLDHSTFAEPPSRFEAGTPAIGEAIGLGAAIDYLSAIGMQKIHDYEVDLANYLYESLRSVPGVHVYGPAPSQTVFRAALCSFNVENIHPTDIATFLDQQHGVAIRSGHHCAQPLHRHLGVSASARASLHFYNTKEDVDAFIHALVDTINFFSSFK

SEQ ID NO: 3586 - protein, 71 aa, Glycine max
MIIPVRCFTCGKVIGNKWDTYLDLLQSDYSEGDALDALGLVRYCCRRMLMTHVDLIEKLLNYNTLDKSDPS

SEQ ID NO: 3587 - protein, 329 aa, Physcomitrella patens subsp. patens
MVVWTNGPASAYSLTLCEECKGGDSAEQMLLCDQCDRGFHMFCLSPILVSIPPGDWICPHCSKSTIAHEFLMVQKKIVDYFRIQNLLPSKSVTEAIERKKRKKQSAFSFCPPKRGRRLLPYVPTIDPQRRLKQMASLATALTSIGVQFSDSLSYRYAPRTANRAAHEKGGMREMPRDDKEAFDKCKAMCKSGLWQPLTVAYDMRQGFVVEADEDIKDMTFIAEYTGEVDYMCCRHYDSGNSIMGLLFSDDPIKELVICPDKRSNIARFLSGINNHTEEGRKKQNVRCVRYSINGEARVILIAMRDILKGERLYYDYNAYYTEYPTQHFV

SEQ ID NO: 3588 - protein, 119 aa, Oryza sativa
  misc_feature (78)..(79): Xaa can be any naturally occurring amino acid
  misc_feature (98)..(98): Xaa can be any naturally occurring amino acid
  misc_feature (108)..(110): Xaa can be any naturally occurring amino acid
AAEIAPYVMASSATSVAPFQGLKSTVAMRVARRSGNFSFGNVSNGGRIRCMQVWLIEGIKKSVTLSYLAALTVEDLLXXIEYLNTSKREPCLEFSKDXFVNRENHISXXXYDSKIWTIW

SEQ ID NO: 3589 - protein, 55 aa, Triticum aestivum
LSLVISQTVGNKCFAKCVTKPGSSLSGSESSCVSRCVDRYIEATGIVGRALFSHR

SEQ ID NO: 3590 - protein, 570 aa, Candida glabrata CBS 138
MAGEKVELSSMDSAIEIRHVNQHAKEISSENKSESYDDNKEFEGSNRVVIKPVNDEDDVSVMINFNQGVSHFIIMLTFVASLSGFLFGYDTGYISSALISIGTDLDNKELTYGEKEITTAATSLGALIFALVAGFSVDIFGRKPCLMFSNIMFLIGAILQVTAHKFWQMTAGRFIMGFGVGIGSLIAPLYISEIAPKMIRGRLTVINSLWLTGGQLIAYGCGAGLNHVHNGWRILVGLSLIPTVLQFVFFIFLPDTPRYYVMKGDYEKAKSVLKRSYNGVSDELIDRKIEELLALNQSIPGKNHVERTWNAVKELHTKPANFRALIIACGLQGIQQFTGWNSLVYFSGTIFESVGFKNSSAVSIIVSGTNFIFTLVAFFCIDKIGRRNILIIGIPGMTVAHVMSAIAFHFIGIKFVGNTAIVEHSGFSSWGIVIIVFIIMFAAFYALGIGTVPWQQSELFPQNVRGVGTAFATATNWAGSLVIASTFLTMLQNITPTGTFGFFAGLCVVSFFFCYFCYPELSGLELEEVQTILQDGFNVQASKELAKKRKRQIAVLKKAKHQPTEEIIEE

SEQ ID NO: 3591 - protein, 437 aa, Corynebacterium glutamicum ATCC 13032
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 3592 - protein, 344 aa, Gloeobacter violaceus PCC 7421
MHSAMLYGVEDVRLEEVPCPEPGPGEVLVRVAVAPTCGTDLKVWLRGGHARMLVPPTPFGHEFAGEIAALGEGVSGWRSGERVVANNSAPCFDCFYCRRERFSLCENLLFNNGTFAEYLRIPAAIVRHNLLAVPPGLPLELAAMSEPLACVLHGVEEAGVRAGDTVVVMGDGAIGLMLVAVCAVRGAAVILAGGQSARLAVAEQLGAQVTLNYRQAGDPVGRLRALTEGGRGADIVIEATGKPAAWEAAIATARPGATVLLFGGCPRGTAVSVDTENLHYNELTLKGVFHNTPRHVREALALIACRRIAFELLVSDSLPLGKLDEALARMRDRTAIKVAMLPGS

SEQ ID NO: 3593 - protein, 230 aa, Candida glabrata CBS 138
MSSKRDIQISKALSYLLRHGAVKENLPFDVNGYIEVERVLNHQRLKSHKCTLEDLHRVVDTNDKKRFNIKLSDDGQTELICAVQGHSIDRIKPDEEVLEVIDTAEKLPKNIIHGTSVRNAIQILKSGSIKRMNRNHIHLSIGITEKDKEVISGMRKSSRVHIYILSEPKILEHLKLYRSMNSVILTPDDINKSLFLLVKIRAASGSDESKDERELINLLDENGIKHEYFN

SEQ ID NO: 3594 - protein, 248 aa, Desulfovibrio desulfuricans G20
MNTVLEQEEKALCGRLESVRRRLDDAVRASGRKQEDVTLVAVSKFHPAAAVEALARLAGHAVFGESYVQEAQEKQQALAGLALSWHFIGHVQSRKARDVAGRFALVHTVDSEKLACKLHQAVQPPDGEQPEGARTVQDVLVQVNIGCEPQKSGVAAGDGLLRLADAVAGMSGLRLRGLMCMPPLTCQGEEARPYFAQLRGLRDSLEQRLGMRLPHLSMGMSHDFEQAVAEGATLVRVGTDIFGERSPR

SEQ ID NO: 3595 - protein, 501 aa, Coccidioides immitis RS
MAEFFPSLTQCALVAAAFKVLLFPAYKSTDFEVHRNWLAITHSLPVQDWYYEKTSEWTLDYPPFFAGLEWLLSKVAFFVDPAMLQLGNLNYDSWQTIYFQRSSVIFLELMLVYALNRYIKSVPAPSKHLAHAASLSILLSPGLLIIDHIHFQYNGFLYGILILSIVLARKQSTLLYSGVTFAILLCLKHIYLYLSLAYFVYLLRAYCLDPNSVFRPRFGNIIKLGIGVTSVFAAAFGPFVYWGQLNQIKERLFPFSRGLCHAYWAPNIWAMYSFVDRVLIPVAPRLGLPIKADALTSVTRGLVGDTSFAILPEVKKEHTFALTLFFQLLPLLKLWLQPNWDNFVGSITLCAYAAFLFGWHVHEKAILLIILPFSLLALKDLRYLGAFRPLAVAGHVSLFPLLFTAAEFPVKTVYTVLWLVLFLFTFERLAPVPARPRVFLLDRFSLLYDTVSIPLIVYCSLVHGWLFGGRMEFLPLMFTSSYAALGVVGSWVGFMVVYFTS

SEQ ID NO: 3596 - protein, 532 aa, Herminiimonas arsenicoxydans
MSSFDWNNPYPSIRQPLFARNTVATSQPLAAQAGLRMLLKGGNAVDAAIAAAAALTIVEPVSCGLGSDAFALVWDGNQLHGLNSSGPSPAGWTTDYFKQKHNGVFPERGWDTVTVPGAVASWVALSDKFGKLPFADLMEPAIELAARGHMVAPVVQKKWVNAIPILQNQPGFAETFMPHGRAPDVGENFVFKDAAESLRKIAETKGEAFYRGELAEAVVKYAKEHGAQMTLADLAGFTPEWVTPIQKNYAGHTVHEIPPNGQGIAALIALGILDKLDITRFPIDSIEAQQMQIEAMKLAFADTYKWVADEKYMTQVTVKDLLDDGYLSERAKLIDLNSASRFSHGTPPKGGTVYLTAADESGMMVSFIQSNYMGFGSGVVVPGTGISLQNRGFSFNLSPNHPNCVAPNKRPFHTIIPGFLSKNGQPLMSFGVMGGNMQPQGHVQTLVRMLSYNQQPQAACDAPRWKVNVGLSLNVESSMPAEIHAGLLARGHKIEKVADYYMDFGSGQFIWKIENGYIAASDPRRDGQAVGY

SEQ ID NO: 3597 - protein, 307 aa, Brassica napus
ASFTFGVSAGYTADTMSSIMTDLDLSLAQFSLFGSLMTFGGMIGAIFSAKAASALGNKMTLWLVDLFCITGWVAIALAKEIVLLDLGRFFVGIGVGLISYVVPVYVAEITPKHIRGAFTFSNQLLQNCGVAIAYYFGNFLSWRSLALIGIIPCGIQVIGLFFIPESPRWLAKEGRDEEVEVVLQKLRGKGHDIMLEARAIKISVEVSKQNSNTSIRSLFRKRYAHQLTIGIGLMLLQQLCGMSGIGSYGSTLFELGGFPARIGMTVLSLIVVPKSLLGLILVDRWGRRPLLMASAFGLCLSCITLAV

SEQ ID NO: 3598 - protein, 340 aa, Pseudomonas putida
MSRMIRFHKFGAADVLRCEEQAEPSPAADEVQIRVEAVGVSWYDVLWRQNLAPSQARLPAGIGHEMAGVVTAVGEGVDDIAVGDRVASFPATSANDHPVYGDVIVLPRTAITRYPNVLTPIEASVHYTPLLIAYFAYVDLARAKAGQTALVTDASHCAGPAFVQLGRALGLKVFAATKDAAQRDYLLGLGADKVIVTEEQDLLLQIGKYTDGRGVDMVLDGMGGPQMSLLGDVLAPRGSLVLYGLQGGNQTPFPACAAFQKNIQFYVHCIGNFTGKPELGISQDQVALQRALRDINQFTADQLLTPQIIKVYPFEQVVEAHRYMDQCPCGGRVVLDMAQH

SEQ ID NO: 3599 - protein, 295 aa, Panax ginseng
MTYMFKYDTVHGQWKHHELKVKDNNTLLFGEKPVKVFGIGNPEEIPWGEAGADFVVESTGVFTDKDKAAAHLKGGAKKVVISAPSKDAPMFVVGVNEKEYTPDLHIVSSASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLAKKASYDEIKAAIKEESEGKLKGILGYTEDDVVSTDFLGDSRSSIFDAKAGIALNENFVKLVTWYDNEWGYSSRVVDLVVHMASVQ

SEQ ID NO: 3600 - protein, 243 aa, Haemophilus influenzae R2846
MIELSHEEELRYNRQIILKSVDFDGQEKLKASKMLIVGLGGLGCAASQYLAAAGVGNLTLLDFDTVSLSNLQRQVLHCDARLNMPKVESAKIALEQINPHIKIETINAKLDEEKLAEIIPHFNIVLDCTDNVEIRNQLDRQCNNAKIPLISGAAIRMEGQVSVFTYEPNTPTYRDLSKLFGQNVLSCVEAGVLAPIVGIVGSIQALEAIKVRLKIGKNLSGRLLMIDGFSMNIREIKLLTNVE

SEQ ID NO: 3601 - protein, 214 aa, Synechococcus sp. RS9917
MTESTPQTNPNDIPAASDVPAAAEGQQEQRRGGGRGDRDRRGGGRRGDRRNQERDSEWQERVVQIRRVSKTVKGGKKMSFRAIVVVGNERGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALEALRTHKETAKERGISLEQIYS

SEQ ID NO: 3602 - protein, 481 aa, Myxococcus xanthus DK 1622
MSAQVPTAGRIIQVLGPVVDVEFPPGGLPEVYTALKVTNANLSAAADNLTLEVAQHLGENTVRTIAMDSTEGLGRGMAVTNTGAPIQVPVGKATLGRILNVTGEPVDEMGPVKAQEYWSIHRAPPPFTEQDVRVQMFETGIKVIDLLAPYTRGGKIGLFGGAGVGKTVLLQELIRNVAVERGGFSVFAGVGERTREGNDLYHEMQDTKVIQTDNLEASQAVLVYGQMNEPPGARARVALSALTMAEYFRDVEGRDVLLFVDNIFRFTQAGSEVSALLGRIPSAVGYQPTLATEMGGLQERITSTTKGSITSVQAIYVPADDLTDPAPATAFAHLDATTVLNRSIAELAIFPAVDPLDSTSRILDPAVIGAEHYGVARKVQGILQRYKELQDIIAILGMDELSEDDKLVVARARKIQRFLSQPFFVAKVFTGKDGRYVKLQDTIQGFKEIAEGKHDDIPEGAFYMTGSIDEVVENARKLAAS

SEQ ID NO: 3603 - protein, 602 aa, Myxococcus xanthus DK 1622
MKTCKHGPNCSGSGLPPFWERTKPLLVVQARAVKAPQPPAPVEATFDSLGLKPALVEALSALGYEEPTPIQAAALPPLLAGKDLLGIAATGTGKTAAFALPLLNHVEPGACRPNTTSALVLVPTRELAMQVSEAIHRYGQKLGISVLPLYGGQVIGQQLRVLKRGVDVVVATPGRALDHLRRGTLQLDDVRVVVLDEADEMLDMGFAEDLEAILSGTPEDRQTALFSATLPPRIASIAERHLHEPVRVKIAREKVEQGEIPRVRQTAYVVPRAFKIATLGRLLDVESPTAAIIFCRTRTEVDDLTVSLNGRGWRAHALHGGMTQEQRDRVIKQLKSQGTDLLVATDVAARGLDIPRLSHVVNFDVPNAPEAYVHRIGRTGRAGREGVAITLVEPREHRLLRNIERVTGQRIEVATVPTVADMREKRQEMLRASLRETLVTGEYDSLRNVVESLASEFDAMDIAAAAVKLLHEAQDEGRDTEETEIPVVAPPQERRERTGKFGAPTGRPGRPERGPKARGGPPTWDVTRLWIGAGRHAGVRPADLVGAIAGEAGVESSKIGAIQIGDAFSLVEVPESDANRIIAALKNATLRGKKVLVRKDRS

SEQ ID NO: 3604 - protein, 423 aa, Vitis vinifera
MQIEGIAEPIYFILLIKLRGKQKNAPEKARNRQALREIGNLMNDTIPAGEGTFNPQISRPLTRSFCAQLPENGRAQKPIAEVVSVHGFAPGKARKKPKPQTVVTISPDENDKSKPSTQGSLTKKVKTLSSILTTQSKMAACRLTDRPRVPIINIDADDVDNELAAVEYVDDIYQFYKMTEDENRTIHYMDLQTDINSKMRAILIDWLVEVHRKLELMPETLYLTINIIDRYLSTKIVSRSELQLVGITSMLIACKYEEIWAPEVNDFVCISDNAYAREQILQMEKSILTKLEWYLTVPTPYVFLVRYIKASVAPDQEMEEMVFFLTELGLMNYSTILYSPSMLAASAVYAARCTLRRIPLWSATLKHYTGYTQDQLMDCAKLLVSFHLGAAENKLKAVYQKFSELERGAVAHVSPAKNLSAGA

SEQ ID NO: 3605 - protein, 77 aa, Arabidopsis thaliana
  misc_feature (32)..(34): Xaa can be any naturally occurring amino acid
  misc_feature (38)..(38): Xaa can be any naturally occurring amino acid
  misc_feature (40)..(43): Xaa can be any naturally occurring amino acid
  misc_feature (46)..(46): Xaa can be any naturally occurring amino acid
  misc_feature (48)..(49): Xaa can be any naturally occurring amino acid
  misc_feature (51)..(52): Xaa can be any naturally occurring amino acid
  misc_feature (54)..(54): Xaa can be any naturally occurring amino acid
MASSMLSSATMVASPAQATMVAPFNGLKSSAXXXATRXAXXXXTFXTXXVXXIXLPCLSPFFYVFFFPPPSFFFLSL

SEQ ID NO: 3606 - protein, 333 aa, Physcomitrella patens subsp. patens
MSLGARTLTDVGVRELRSDTNRLKIFSGSANPLLSQEIACYMGLNLGQIKIKRFADGEIYVQLEESVRGCDVFLVQPTCPPANENLMELLVMIDACRRASAKTITAVIPYFGYARADRKTQGRESIAAKLAANLITEAGAHRVLTCDLHSGQAMGYFDIPVDHVYGQPVILDYLASKMISAEDLVVVSPDVGGVARARAFAKKLSDAPLAIVDKRRQGHNVSEVMNLIGDVHGKVAVMVDDMIDTAGTITNSAALLHAEGAREVYACCTHAVFSPPAIERLSGGLFQEVICTNTIPVKESNYFPQLTILSVANLLGETIWRVYDDCSVSSIFR

SEQ ID NO: 3607 - protein, 134 aa, Brassica napus
MAGRGKTIGSGVAKKATSRSSKAGLQFPVGRIARFLKNGKYAERVGAGAPVYLAAVLEYLAAEVLELAGNAARDNKKTRIVPRHIQLAVRNDEELSKLLGDVTIANGGVMPNIHNLLLPKKAGGASKPSGDDDE

SEQ ID NO: 3608 - protein, 77 aa, Zea mays
TQVAPEAFWRRARLPGRHAFATERGRKARPNLKVGICGEHGGEPSSVAFFAKAGLDYVSCSPFRVPIARLAAAQVLV

SEQ ID NO: 3609 - protein, 390 aa, Desulfovibrio desulfuricans G20
MKISDRLMQVKPSATLAVNAKALELKAQGREIISLSVGEPDVPPPAHIGAAAKKAIDENFTRYTAVPGIPELRDAVAGYFRRFYGVDAAAEHTIVTNGGKQALYNLFQALLNPGDEVLIPAPYWVSYPAMVQLAGGTPVPVASGPETGFKTCVEELQRHMTPRTRVLLLNSPSNPTGACYTRHEIDTIAAWAIENGLFIISDEIYDQLVYAPASPAGLAPWWQSNPEQVCVVNGLAKSFSMTGWRVGYVLAHPDLIKALGKIQGQSTSNVCSIAQKAALAALTGPFDALDTLRESYARRRDIALDIISGWKNVVCPRPDGAFYLFPDVHRLYTDATPDSATLCTRLMESAGVALVPGAAFGDDRCVRISYAVSEQTLRDALSKISNVLFS

SEQ ID NO: 3610 - protein, 212 aa, Candida glabrata CBS 138
MVQFMEIKDAIEHFKQNKFVIVMDDEDRENEGDLICAAANVTPEHIAFLVRHSSGYVCTPMSNKIADRLDLPLMRDNLKCESADDDRHGTAYTITVDVSEGTTTGISAHDRALTCAKLADPSAKPKDFLKPGHICPLRAKDGGVITRQGHTEAAVDLCRLSGLPEVGVICELVNDRDGSMMRLNDCAEFGKKFDIPIITIQSLIKYIKENNL

SEQ ID NO: 3611 - protein, 553 aa, Nierembergia caerulea
MAFDFGTLLGKMNNLTTSDHQSVVSVNLFVALICACIVIGHLLEENRWMNESITALVIGSCTGVIILLISGGKNSHILVFSEDLFFIYLLPPIIFNAGFQVKKKSFFRNFSTIMLFGAVGTLISFIIISAGAIGIFKKMDIGHLEIGDYLAIGAIFAATDSVCTLQVLNQEETPLLYSLVFGEGVVNDATSVVLFNAVQNFDLSHISTGKALQLIGNFLYLFASSTFLGVAVGLLSAFIIKKLYFGRHSTDREVAIMILMAYLSYMLAELFYLSGILTVFFCGIVMSHYTWHNVTESSRVTTKHTFATLSFIAEIFIFLYVGMDALDIEKWKFVSDSPGTSIKVSSILLGLVLVGRGAFVFPLSFLSNLTKKNPEDKISFNQQVTIWWAGLMRGAVSMALAYNQFTRGGHTQLRANAIMITSTITVVLFSTVVFGLMTKPLILLLLPSQKHLIRMISSEPMTPKSFIVPLLDSTQDSEADLGRHVPRPHSLRMLLSTPSHTVHYYWRKFDNAFMRPVFGGRGFVPFVPGSPTEPVEPTEPRPAESRPTEPTDE

SEQ ID NO: 3612 - protein, 593 aa, Zea mays
MAFWWPLLVLAAAYALCRLLLFLIPPTVPSIDVDASDVLAKEDSFIYIPRRGKSTQTDKVQCYEPATMKYLGYFPVVTPDEVKEHVAQSRKAQRIWAKSSFKQRRQFLRILLKYILEHQDLICEVSSRDTGKTMVDASLGEIMTTCEKITWLLDEGEKWLKPEYRSTGRSMLHKRAKVEFYPLGVIGAIVSWNYPFHNVFNPVLAAVFSGNAAVIKVSEHATWSGCFYFRIIQAALSAVGAPENLVHIITGFAETGQALVSSVDKIIFVGSPGVGKMIMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDKGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQYPVSEHGFEFQQLLVETLYGYSVWDRLRSLVNLIKMVTEQNFAPTSNATTKKRR

SEQ ID NO: 3613 - protein, 555 aa, Torenia hybrid cultivar
MGFESVIKLAASETDNLWSSGHGSVVAITLFVTLLCTCIVIGHLLEENRWMNESIIALIIGLATGVIILLISGGKSSHLLVFSEDLFFIYALPPIIFNAGFQVKKKSFFRNFATIMMFGAVGTLISFIIISLGTIAFFPKMNMRLGVGDYLAIGAIFAATDSVCTLQVLSQDETPLLYSLVFGEGVVNDATSVVLFNAVQNFDLPHMSTAKAFELVGNFFYLFATSTVLGVLTGLLSAYIIKKLYFGRHSTDREVAIMILMAYLSYMLAELFDLSGILTVFFCGIVMSHYTWHNVTENSRVTTKHTFATLSFVAEIFIFLYVGMDALDIEKWRFVSGSMTTSAAVSATLLGLVLLSRAAFVFPLSFLSNLAKKSPLEKISLRQQIIIWWAGLMRGAVSMALAYKQFTREGLTVERENAIFITSTITIVLFSTVVFGLMTKPLINLLIPSPKLNRSVSSEPLTPNSITIPLLGESQDSVAELFSIRGQTSQGGEPVARPSSLRMLLTKPTHTVHYYWRKFDNAFMRPVFGGRGFVPYVPGSPTERSVRNWEEETKQ

SEQ ID NO: 3614 - protein, 214 aa, Sulfolobus solfataricus
MAEEVPSLNIEEWKPRTSIGSLVKEGKISSIKELFDRNLPITEPEIVDVLLPKLKYEVVDIKVVQKQTDAGEISRYKVLVIMGNMDGYVSIGTGKAKQLRVAIQKAIRDAKMNIIPVRRGCGSWQCTCGEPHSLPFKVVGKAGSVEVDLLPAPKGTGLVVGSVLKTLLTYAGIKDAWSTTKGETRTTENFVRAGYSALYNTYKFVTLQDWVRKR

SEQ ID NO: 3615 - protein, 156 aa, Clostridium perfringens SM101
MRIGMGYDVHKLVENRDLILGGVKIPYEKGLLGHSDADVLLHAIMDSLLGAAALGDIGKYFPDTDPKYKGADSIKLLEFVGELLNKNNYKISNIDATIIAQRPKMAPHIPTMRENIAKALNIDLDKINVKATTEEGLGFTGTGEGISSQSICLLIK

SEQ ID NO: 3616 - protein, 756 aa, Nocardia farcinica IFM 10152
MSQAEAPESADDLHTSPSSPSRDRLRGILRHDLPSSVVVFLVALPLSLGIAIASDAPIMAGLIAAVIGGIVAGAVGGSPMLASGPAAGLTVVVAELVAKFGWQVTCAITVAAGALQILFGLSRIARAALAISPVVVHAMLAGIGITIALQQVHVLLGGTSRSSVWQNLSQLPAQLTRLHWGDLTIGLIVIVTLLSWKKVPGALGRIPGALVAVVAATAVSLVVPLGVERIVMNGSLFDAIALPALPDGKWLAVATGVLTVALIASVESLLSAVAVDKMHSGARTDLNRELIGQGTANIASGMLGGLPITGVIVRSATNVAAGAKSKASTILHGVWILLFSVLLAGVVQQIPKAALAGLLIVIGIQLVKLAHIRLAHRTGDLWVYLITVAGVMFLNLLEGVLIGLIVAIALFVWRAARADIHAEPVGDLDSLRWRVVIEGSCSFLSLPKLSSTLDSVPEGADVTIELTVDFIDHAATEVLHEWQRRHRDAGGTVLIDELGSHALSATTQGPPQRASSAQARGVEPWKAWQDTNAQAVPHFDALRPMLDGISRYHRRHAPLMRAHLSELRDRQDPTTFFLTCGDSRVVPNLITHSGPGDLFTIRNIGNLIPSDGLDTSVDAALAFAVEELGVSTIVVCGHSGCGAMGALLGKPTKNSPAVRDWLAHAEPSLRAYHDNHPVAAAAEAAGFDAYDQLAIVNVAVQIATATQHPSLVSAVAQGQVQIVGLFFDIATATVWHVSPTTVTAHHNQLATSTVHA

SEQ ID NO: 3617 - protein, 368 aa, Glycine max
MAVKSKKEKEHLNLLLGSHLTTIHETLQVLDQTPPSSSSAKVTWDDVIKMAEQVSKQATTVGMLWTGEKPDAKAVEENMASYFNTLQGFLLLSHGSTVGAGPTLSSAVHASVKQVVDSSFRLMKETVSLYGYHSKDLKISVPQLVGAVWEACSALKKTPSTNITAIGRGMTQVAVSVKDVLREMKELKPVSCDDQVDEAAGESCAEAASEPHDDNSSEGDLGNDLSPEEMKVAERAIEVVSNTLSFIKILIHSIIGLLKLEKPNDNSSFVNSLEKLLQLCHELGRQIDEIGACLYPPQEIPAINAALEKIHSIIDAVQVEVGELLGASDVFLEPCNDLRSSLRQLASELSNSSTADIEARVENITLNQ

SEQ ID NO: 3618 - protein, 594 aa, Coprinopsis cinerea okayama7#130
MAILPPGVRFVGRGVAYMTVFVGGLVGATKIAESRGFAIPLWLVLTGAAVAIPTLAGLRIAAGEFKKRRRARALGARTVPKLQGKKFGNLDVLTTTLSNIAVGYPGDGLDEVIEARGPVFNFWLLWSDSIFTICPEHLKTILATDFSSHVKGPQFIRNMGSVLGSGVFNSDGEMWKFHRSITRPVFTRDRISDFDIFDHHTDIALQKLKERLREGYAVDFQDLMARFTLDTATQFLFGNCVNSLDAGLPYPAKFGLTVHQTLSGKKADDFARAFMEAQEAIANRERVGWIWPLFEFWKDKTEEPMKTVRAFIDPIVKEAIANRATQSLEEKTSGEKEIQDGQTLLDYLVNVTQDPTILRDEILNIMIAGRDTTAATLTFCIYLLSQHPDVFQRLRTEVLEKVGPSRRPNFDDLRDMRYLRAVLNETLRLFPIVPFNVRETANETVWPSPDPNEQALYIPPGTKITYSVFMMQRRTDLWGLDAEEFDPDRFIDERLKKYLIKNSFIFLPFNAGPRICLGQQYAYNEMSFMLIRLAQQFSSISLDLDSAPPEALAPKIWAESQGRKATEKVFPKFHLTMYAAGGLWVKMEEATGTD

SEQ ID NO: 3619 - protein, 446 aa, Bordetella petrii
MPHHAPTSKTAEWRTRSLRHVWHPCTQMKRQASMPLLALSHGEGPWLVDMDGRRYLDGISSWWVNLFGHANARINAALNDQLARLPHAMLAGCTHAPAVELAERLSALTGAALDHCFYASDGASAVEIALKMSFHAWRNQGHPAKREFVCLRHGYHGETLGALGVTDVAVFRDAYGPLLRQAHVVASPDARAALPGEDADAVARRAAAELQTLLDARHAHIAAVIIEPLVQCAAGMAMHAPSYLRQVRELCDRYQAHLIADEIAVGCGRTGTFFASEQAGIWPDLLTLSKGITGGYLPLSLVLATDAIHATFYDDDVARGFLHSHSYTGNPLACRAALATLDIFEADDVLARNRRRAARLDAALAPLQAHHAVRHFRRTGMIWAFDVEAGPGFGQRYAAAALARGLLLRPIGHTVYLMPPYVLDNDTATWLARETLAALDDALEEH

SEQ ID NO: 3620 - protein, 69 aa, Fagopyrum tataricum
RGSKAAKKNPHVVFFKVDVDDCNDVAEEYKVEAMPTFLVLKEGKEVERVVGAKKEELSKKIGDHAPITA

SEQ ID NO: 3621 - protein, 525 aa, Yersinia pestis CO92
MTKNIHKHRILILDFGSQYTQLLARRVREIGVYCELWAWDVTEAQIREFNPSGIILSGSPESTIENGSPRAPDYVFTAGVPVLGVCYGMQTMAIQLGGKVESSNQREFGYAQVEIKADSALIRDIKDAINPAGEAVLDVWMSHGDKVAEIPADFVTVASTDTCPFAIMANEEKRFYGVQFHPEVTHTKQGLRLLERFVLGICGCEALWTSATIIEDAIVRLREQIGDDHVILGLSGGVDSSVTAMLLHRAIGKRLTCVFVDNGLLRLNEADQVLEMFGDKFGLNIVHVAAEDRFLSALTGVDEPEAKRKIIGRVFVELFDEEACKQEQVKWLAQGTIYPDVIESAASATGKAHVIKSHHNVGGLPKEMKLGLVEPLKELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 3622 - protein, 137 aa, Triticum monococcum subsp. aegilopoides
FGLFLARKVSLIRALLYIIAQCLGAICGVGLVKGFRSSYYVRYGGGADELSAGYSKGTGLAAEIIGTFVLVYTVFSATDPKRNARDSHIPVLAPLPIGFAVFMVHLATIPITGTGINPARSLGAAVIYNKDRAWNDQ

SEQ ID NO: 3623 - protein, 180 aa, Halobacterium salinarum
MPVDATVHTSEGEFDIELYDERAPRTVENFLNLARHEPAADADPAPDTVTWEDPESGEIRGDSLYAGVSFHRIIEGFMIQGGDPTGTGRGGPGYEFADEFHDDLTHDGPGVLSMANSGPDTNGSQFFITLDAQPHLDGRHAVFGAVTDGMDVVETIGDVETDANDAPASEITIDRVEIHE

SEQ ID NO: 3624 - protein, 255 aa, Mannheimia succiniciproducens MBEL55E
MERVDNYEQRFGGIGRLYTPQGLERLRQAHVCVIGIGGVGSWCVEALARSGVGKLTLIDMDDICVTNINRQIHALTGNIGKLKTEVMKERVELINPECKVEIIDDFISPENLAEYLHSDYDYVIDAIDSVKTKAALIAYCKRNKIKVIMVGGAGGQTDPTQIQIADLSKTVQDPLASKVRSLLRKNYHFSQNPKRKFGVDCVFSTQPLIFPQMSEGCGISASMNCENGFGAATMITATFGFFAVSRVVDKLLTKQ

SEQ ID NO: 3625 - protein, 112 aa, Zea mays
  misc_feature (49)..(49): Xaa can be any naturally occurring amino acid
  misc_feature (83)..(83): Xaa can be any naturally occurring amino acid
  misc_feature (85)..(85): Xaa can be any naturally occurring amino acid
SSCLGLGCPTKLIRSEAELFAQNRDLASIDMSTGKLLRCYIAKCSGSIXRSIVRHAELPLIASCGLDSYLTYLDTYTRQLLSXCXLKQHLTTVVLDSHISVEEPEEMKFKQL

SEQ ID NO: 3626 - protein, 345 aa, Pyrococcus horikoshii
MYKVAVIKGDGIGPEVIDAAIRVVKSVTDKIKFYEFEGGLSVFKKYGVPIREEDLEEIRKMDAILFGATTTPFDVPRYKSLIITLRKELDLYANLRIIPNFKLRKEIIIVRENSEGLYSGEGAYDSNKVVDFRIITRKGAERIAKFAVKLAKDRSTFLTFVHKANILESDRFFRKIVLDIARKEDVKVREEIVDSFTIKLVKDPWNLGIILSENMFGDILSDLATIHAGSIGIVPSGNYGEDIALFEPIHGSAPDIAGKGIANPIGAILSAAMMLDYLGLDGSIIWKAVGRYVRRGNLTPDMEGRATTLEVTNGIISEIYRLDEYEIDEVWRDEVRLGRILLEIS

SEQ ID NO: 3627 - protein, 136 aa, Populus tremula x Populus alba
MPPEGELRYPPPPPTESTTTIDEEAGWVWAQIKAEARLDAEAEPALASYLYSTILSHSSLERSLAFHLGNKLCSSTLLSTLLYDLFLNTFTSDPGLRVAAVADLRAARARDPACVSFSHCLLNYKGFLACQAHRVA

SEQ ID NO: 3628 - protein, 236 aa, Brassica napus
  misc_feature (174)..(174): Xaa can be any naturally occurring amino acid
MARIKPQALLNQSKKKKGPSRISISTIVVCNLVVAVVVLSLVTTYRHWSQRSRNTLETQSQRFEDTNAASEQKSYDLPGYADISTSKGLITVELFKDASPEAVDRFLDLCQKDHFKGMPFHRVIKNYLVQAGHSQSSIPVEEWTSKGKLRGRLNTSPKHEAFMLGTPKTKGNNXNKDFELLITTAPIPDLNDQLIVFGRVLKGEDVVQEIEEVDTDEHYQPKAQIGIISVILKREL

SEQ ID NO: 3629 - protein, 292 aa, Populus tremula x Populus alba
RIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYDTTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 3630 - protein, 143 aa, Glycine max
MATTLTPIQTLKFCSPNPKPLFTPKPLFSPKPPSISTPHTFRADKLSLSVSAATSSSNGPPSPPSPARSKVRRHTISVFVGDESGMINRIAGVFARRGYNIESLAVGLNEDRALFTIVVSGTDKVLRQVMEQLQKLVNVLKVE

SEQ ID NO: 3631 - protein, 364 aa, Zea mays
MEEGDEMLDVYQGTEFKWCLVCKDNSKDSLNNGGQNESQLFELAFNKRHKDKALKSYLPFILATAKAIKAQERTLMIYMTEYDDWSAIDLNHPSMFDTLSMDHKLKQSIIDDLNMFIKRNDYYKKIGKAWKRGYLLYGPPGTGKSSLIAAMANHLRFDIYDLELTVVTSNSDLRRLLVGMGNRSILVIEDINCTIEMKQREEGEGHGKSNSTEQNRREEKVTLSGLLNFVDGLWSTSGEERIIVFTTNYKEWLDPALLRPRRMDMHIHMGYCTLESFQILANNYHSIEYHDTYLEIEKLIKEMTVTPAEVAEILMRNDDTDVVLHDLIGFLKSRMKGVNEVKIEHKKVNNKMDEKKEDKDNDKD

SEQ ID NO: 3632 - protein, 610 aa, Coprinopsis cinerea okayama7#130
MAILSPGIKFVGRGVAYVTVFVGGLVGATKVAESRGYFVPIWMVLTGAVVAGPALAGLYITAGELKKKRRARALGARVVPKCRGSKIGNLDVLSMTLKNLAVGYPGDGLDEIIKARGPVFNIWLLWSDTLLTTCPEHIKLILATDFHNYVKGPRFIHNMGSVLGSGVFNSDGEMWKFHRSITRPVFTRDRIGDFDIFDHHTDVVLQKLKERLREGHAVDFQARLSFIHSAIHLTTLQDLMARFTLDTATQFLFGHCVNSLDAGLPYPPKAAPYVSVQQTPAGKMADDFARAFMEAQEVIAIRERVGWIWPLLEFWKDKTVEPMKVVNAYIEPIVKDAIERKKNALPEEKSGDEKEIQEGQTLLDYLVNVTQDPTILRDEILNIMIAGRDTTAATLTFCIYLLSQHPDVFQRLRTEVLEKVGPSRRPNFDDLKDMKYLRAVLNETLRLFPIVPFNVRETIEETIWPSPDPNEKPLYIPPGTKTSYSVFMMHRRTDLWGPDAEEFDPDRFIDERLKKYLIKNSFIFLPFNAGPRICLGQQYAYNEMSFMLIRLMQQFSSVTLDLDSAPPEAIPPKVWAEAPGRKATEKVFPKLHLTMYAGGGLWVKMQEATD

SEQ ID NO: 3633 - protein, 141 aa, Populus tremula x Populus alba
YVGGGMGRTHRLETTFPRLAEPLGYVPKEDILYAVKAIVVTQRENGRRDDRKYSRMKYLISEWGIEKFRSVVEQYYGRKFEPSRELPEWEFKSYLGWHEQGDGGLFCGLHVDSGRIGGKMKATLRETIEKYNLDVRLTPNQ

SEQ ID NO: 3634 - protein, 503 aa, Treponema denticola ATCC 35405
MENINKECHKHVTHEDLSDRAKQLWADLKGKTLTPKERAQIPIQEMPTLDPHKRASLMNEVAMGYTDEQARIEAERCLNCKNKPCVKGCPVGIPIPEFIAEIQKGDYKKAVDIIKTTNLLPAICGRVCPQEKQCQAFCTVGKMLKSTEQAVAIGRLERFVADWERNNNKITIPPVAPETGKKVAIIGSGPAGLTVAADVRREGHSVTVFEAFHKTGGVMVYGIPEFRLPKEIVAKEVENLEKMGVEFKTNFLVGRTETLEQLLKEDGYDAAFIGTGAGLPKFMGIEGENLIGVFSANEYLTRANLMKAYDAEHSDTPLYEAETLAVIGGGNVAMDAARMGYRLGCKKVYCIYRRTRAEMPARIEEVAHAEEEGVEFCFLQNPTRIIGDKEGKVCAIEVLDYELGEPDESGRRKPVAKPGTEHQIKVDAVIVALGNDSNPLMAQTSHGLEVTKKGNIVVDENQKTSIEGVWAGGDIVLGAATVILAMGEGRKAAAAINEYLKTK

SEQ ID NO: 3635 - protein, 664 aa, Arabidopsis thaliana
MNSRSCICVSAMKPCCRFLISFRSSSLFGFSPPNSGKFINSSKLHCTKIDSRSIRSGIHCRRIVLDRNAFCDSDSISWGGGGSRVLRARGSSRGRGRGVLVIPHVASDFRNYSTSSLDSHVNDKSFESMFVKPLVFKEVEKTEGIPKRERGNVGGGKDANFGNVGVRKETERCLSQTEVEKEAWKLLRGAVVNYCGFPVGTVAANDPGDTQTLNYDQVFIRDFVPSAYAFMLDGEGEIVRNFLLHTLQLQSWEKTVDCHSPGPGLMPASFKVKSAPLEGNDGSFEEFLDPDFGGSAIGRVSPVDSGLWWIILLRAYGKLTGDYTLQERIDVQTGIKLILKLCLADGFDMFPTLLVTDGSCMVDRRMGIHGHPLEIQALFYSALRCAREMLIVNDGTKSLVTAVNNRLSALSFHIREYYWVDIKKINEIYRYNTEEYSADATNKFNIYPEQIPTWLVDWIPDKGGYFIGNLQPAHMDFRFFTLGNLWAVISSLGNQEQNEGVMTLIEEKWDDLVANMPLKICFPALEKDEWRIITGSDPKNTPWSYHNGGSWPTLLWQFTLACIKMGKLELAKKAVAVAEKRLKEDEWPEYYDTKSGRFVGKQSRLYQTWTIAGFLAAKKLIEQPEKASLLFWEEDYQLLETCVCGLSKSSGRKNKCSRFTPPRS

SEQ ID NO: 3636 - protein, 309 aa, Burkholderia sp. 383
MTAPAAHTGRVTVVGSLNMDLVVRAPRLPLPGETLAGHAFAQAAGGKGGNQAVAAARLGAQVAMIGCVGADAHGAALRASLEAEGIDCAGLATSASASTGVALIVVDDASQNAIVIVAGGNGEVTTETVARHEAALASADVLICQLETPPEAVFAALSAGRRLGRTVVLNPAPAVAPLPDGWLPLVDYLIPNEVEAAALTALPVRDPAEAEAAARVLQAGGACNVLVTLGARGVLALTADGAARHYPAPAVQAVDTTAAGDTFIGGFSARLAAGADVDTAIRFAQRAAALSVTRAGAQPSIPTLAELTE

SEQ ID NO: 3637 - protein, 349 aa, Physcomitrella patens subsp. patens
MKSQRRTVTYMPRPGDGSPRAVTLLPGDGIGPLVTGAAVQVMKAMHAPVYFEEYEVSGKMDKVPTEVMDSIRRNKVCLKGGLATPVGGGVSSLNVQLRKELDLFASLVHCFNLPGLKTRHDNVNIVVIRENTEGEYSGLEHEVVPGVVESLKVITKFCSERIAKYAFEYAYLNNRKTVTAVHKANIMKLADGLFLESCREVAKNYPGIKYNEVIVDNCCMQLVSKPQQFDVMVTPNLYGTLVANTAAGIAGGTGVMPGGNVGADHAIFEQGASAGNVGNERLVAGKTANPTALLLSSAMMLRHLQFPSFADRLEQAVMSVIAEGTYRTKDLGGTSTTQDVVDAVIEKLN

SEQ ID NO: 3638 - protein, 466 aa, Physcomitrella patens subsp. patens
MISPRDSKCITREYKSGGLSENLSSIFTNSEVESGENDETLSITIGSTLKEEQYIIQKKLGSGAFSTVWLAWDKQHDKHVALKVQNCSRDCLKVAQEEIKIHQEVAACRKKDGEVAVVTLLDHFDYNVSQNRKHVCMVFEYLGDNLLTLIKANKHKGLPLYVVKGITKYILVGLNYLHNDLKIIHTDLKPENILLTSPLDPHHDPRIFFTRKSDNISTKNIKKNFKKNMPKREKKLNDFYHKTIDSDPDIARNDNTNIEFKTPSPNHKVEYPQTSTYLYGESPHELGLLDLRCKIIDLGSACWTHKILTSDIQTRPYRCPEVVLGCNYSTSADMWSFGCLVFELATGNTLFDPQTGGSEYNRDEDHLAQMMEILGPIPKSLKEKGANAHHYFTKNGKLKHTKPSGHFPIHKLLVNEYGFDEINAKEFAKFILPLLELNPNKRPNAACCLEHPWLKYSTMDSPQHLV

SEQ ID NO: 3639 - protein, 233 aa, Bordetella petrii
MSSVISSVPYLPPDLTAQPFEARLARALHHMRLGRPVILMDDFDRENEADLIVAADKLTVPVMAQLIRDCSGIVCLCLTDDTLEQLQLPPMVARNESRYSTAFTVSIEARHGVSTGVSAADRVTTIRAAIAPGAQAADIVSPGHVFPLRAQPGGVLARRGHTEGSVDLAVLAGLRPAAVLCELMNADGTMARGPSIARYAAEHGLVALTIAELAMHRQRLAAQAPAQPALAEA

SEQ ID NO: 3640 - protein, 513 aa, Geobacter sulfurreducens PCA
MPRPLVLMILDGWGINPDPSNNAVAIGRTPAMDRLMAEYPSVEMETSGMAVGLPDGQMGNSEVGHLNIGAGRVVYQDLTRITKSIDDGDFFTNPVLLDCMARVKAAGGRLHLGGLLSDGGVHSHNTHLYALIELARRQGVKDVFVHAFLDGRDTPPSSGAGYLAELEAEIGRIGFGRVATVMGRYWAMDRDNRWERVERAYNTIVKGEGAHRPDSAAAIEASYSAGVTDEFVEPAVIAPNGSPLGLLADGDGFICFNFRSDRAREITRALTDPAFAGFDRSPWPRLASYVCLTEYDATFPLPVAYPPESLANILGQVVSRAGLRQLRIAETEKYAHVTFFFNGGVEEPFPGEERILIPSPKEVATYDQKPEMSAPLVTDALLKRIDEGVDDVVVVNFANADMVGHTGILDAAVRAIETVDECVGRVAATVLEKGGALIITADHGNAEMMVDETGGPHTAHTNERVPLILVDDSRKGARLRPGTLADIAPTMLGLLGIPQPPEMTGKSLLVATE

SEQ ID NO: 3641 - protein, 246 aa, Physcomitrella patens subsp. patens
MQVELGDHKTLRSKEQWRAAAAEFIGTMLFVYLGCGSVIASGMFVLLYITLPKNLTGDMTCARLVVIAVAHGLAICCLAAATGAISGGHLNPAVTLAFVVAGKETLIRAGLYIGAQLFGAIIGAWLIQSSTPGYLQRGLGSHDIDKNVFDSQGLLMEIVLTFMLIFVVFGVAVDRRGPGVIAPIPIGFAVLVDHLVGVPYTGASMNPARSFGPALVSGHWGRSHIIYWFGPCFGASLASAIYRYPD

SEQ ID NO: 3642 - protein, 153 aa, Geobacter sulfurreducens PCA
MKLRVLWVGKTQEEWVRRGIDEYAGRVRRYAPLEIGEARDEKGAAAEAMRARECERLDKLVPRTSRLILLDERGDQLTSPEFAAYISRCRDTAVPELAFAIGGAYGFADEFRRRADRVIALSRMTFTHQMVRVVLLEQIYRAFTIIGNEPYHH

SEQ ID NO: 3643 - protein, 607 aa, Gaeumannomyces graminis var. graminis
MKFLIVSLFALVCGSAALATPVNSSVSAWSGQHHPKPHHPHQPPHSGCKNGPKSRNCWGKHSIDTNYYETAPDTGVTREYWLSVEEGICNNDGYKRYCQTFNGSFPGPLIWANWGDNLVIHVTNNMKTNGTSIHWHGLHQRGSVEYDGVPGVTQCPIAPGKSLTYKFRVTQYGTTWYHSHFSLQYAEGLFGPMIFYGPTTANYDEDLGTLFLQDWDHGTAWHGWDNVASKGAGPLPANGLINGTNTFDCKNSTDTNCVGGGKKFSANFKKGKKHLIRIINNSADAHFQFSIDGHDLTVVANDLVPIKPFKTKSVRVSIGQRYDVIVEANAKPGNYWLRSGMSCVPGDTGALRKRVTGIIRYDKKSKADPKTTSDVVVDETCSDEDPKKLVPHLALDVTHTGEIVRSDLGFKPNGTPAEGQNWFQWTLNNSSLVLDWHDPTLERIFDGQSIFPTDYNVIKADCQLWPQQAMVHTGDSEQRPPTDPLPSHRLAHPIHLHGHDFWVLSQSKAKWDGTPRGFDTKNPARRDTAMLPEKGHLAIAFQLDNPGAWLVHCHIAWHAGQGLSLEFVESQDRIALGMPNHDVFRQTCREWDAVRTKMPFPQHDSGI

SEQ ID NO: 3644 - protein, 142 aa, Yersinia pestis CO92
MALERTFSIIKPNAVANNDIGAIYARFERAGFKIIAAKMLHLTKEQAEGFYAEHKGRPFFDGLVEFMTSGPIMVQVLEGENAVQRHRDIMGATNPDNALAGTLRADFSDSFTANAVHGSDAVESAQREIAYFFAADEIFPRS

SEQ ID NO: 3645 - protein, 257 aa, Sinorhizobium meliloti 1021
MSSLFSNKVVTVTGAGSGIGRAIALGLARDGATVHLADRDADGLTQTAELIRAEDGRAFTTELDVASELQVVGWIEQIGSTSGRLDAAFNNAGITGPAKRIEDYPLEDFQRVIAVNLQSVFLGMKYQIPLIKRNGGGSIVNTASIAALTGPGGMSAYAASKHGVQGLTRVVAMENAAHGIRVNAIAPGWTETPMVAANSQQNPAFAALAQNAIPAKRGGKPEEIAAAAIWLASDAASYVTGHMLTVDGGMTIGGFEL

SEQ ID NO: 3646 - protein, 312 aa, Zea mays
  misc_feature (267)..(267): Xaa can be any naturally occurring amino acid
  misc_feature (287)..(287): Xaa can be any naturally occurring amino acid
  misc_feature (294)..(294): Xaa can be any naturally occurring amino acid
MGSLPVPSVQALVVATGGDDVPPRYLRPDAAAEAVTGDGDGEAQIPIIDHRRLLLELDHGGEESARLHRACQDWGFFQLVNHSVPDDVVESMKANIQQFFQLPAETKKRFAQEEGQLEGYGQLFVVSDDQKLDWADMLFLYAQPPERRKTRFWPDQPATFRSTLDRYSGALKDVSDSLLATMAKNLGLKRETIAEKCTRGMQSFRMNYYPPCAQAEKVIGLSPHSDANLLTLVLQVNHVQGLQIKRNGSWLPVKPVPGAFIVNIGDXVEVFTNGRYRSIEHRAVVDXRKSRLSXAAFHFPDMDAMIGPSGRS

SEQ ID NO: 3647 - protein, 770 aa, Herminiimonas arsenicoxydans
MDSNIDKKEELRLQLRQAALEYHEFPTPGKISVTPTKQVTNQRDLALAYTPGVAVACEEIAANPADSYRYTSRGNLVAVITNGTAVLGLGNIGPLAAKPVMEGKGVLFKKFAGIDVFDIEINETDPDKLCDIIASLEPTFGGINLEDIKAPECFYIERTLRERMKIPVFHDDQHGTAIIVAAAILNGLKVVGKTIQNTKLVVSGAGAAALACLDLLVDLGFPLENIFVTDLAGVVYHGRVELMDPAKERFAQKTDARKLADVIGGADVFLGVSGGGVLKPDMVAAMADRPLILALANPTPEILPEEVRAVRSDAVIATGRSDYPNQVNNVLCFPYIFRGALDCGATTITREMEIAAVHAIAQLAQAEQSDIVATTYGINNLSFGPDYIIPMPFDPRLMIKIAMAVAKAAEECGVAARPIKDMEAYADKLQQFVYRSGTFMKPIFQIAKSTPSDLKRIVYAEAEEERVLRAVQVVVDEKLARPILIGRPAVLLQRIERFGLRIKPDIDFTIINPEHDDRYRDFWQTYLAMTLRKGVTEQYAKLEMRRRHTLIGAMAIHKKYADGMICGTFGTTDLHLKYVEQVLGKRAGVNSYAAMNCVIMSDRQLFLVDTHVNENPSAEQLAEITILAAEEMRRFGMPPRAALLSHSNFGSSNSESAQKMRKVLQLVRERAPDLEIDGEMHGDLAMNAVELKKAMPDSALKGDANLLVFPNIDSANIAYNLLKTTVGNGVAIGPILLGCDKPVHILTPSATVRRIVNMTALCVADAVAER

SEQ ID NO: 3648 - protein, 229 aa, Roseovarius nubinhibens ISM
MSFDRAIKIAPSILSADFANFGQEIQAIEAQGADWVHVDVMDGHFVPNLTFGPQAVKAFRPHVKTVMDVHLMIAPVDPYIDAYADAGADVLTAHVEAGPHIHRTLQAIRGAGMKAGVALNPGTSADAVAHLLDLTDVICVMTVNPGFGGQKFIDMTAKIAELRAMIGDRPVHIEIDGGVTPETAPLVVAAGADVLVAGSGVFKGGSVAKPEVYGENIRAIRSAAEAAQG

SEQ ID NO: 3649 - protein, 232 aa, Gloeobacter violaceus PCC 7421
MAHLILIRHGQSLWNAANKFTGWVDVPLSERGRAEATIASCKLRDYRVNVCFTSMLMRAIETAVITLTECDDICGGKIPIIKHEADDENWHGWDNYDGDPAAELPIYPTATLDERYYGDLQGLDKAETTAKYGKEQVQIWRRSYSVRPPGGESLEDTRKRVYPYFTNRILGHIKQGDNVLVAAHGNSLRSIIMILETLSEEEVPKVELATGVPIVYELDKAAHMLSKAVLTN

SEQ ID NO: 3650 - protein, 526 aa, Triticum aestivum
  misc_feature (520)..(520): Xaa can be any naturally occurring amino acid
MSAIKPPPPDRPPQAARLPSPSSSSSAAAAAKQGGTGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLLPPPSSPSPQEVDGDDSGSESDASVVSCPATSSFEERHRLRGPLPRPASLNAFDIISFSRGFNLSGLFEEKGDEVRFISSEPMSGIITKLEEIANVKSFAVRKKDWRVSLEGTREGVKGPLTICAEIFELTPSLVVVEVKKKAGDKEEYDDFCNKELKPGMQHLVHQMAPVPITPTISEXAERPSR

SEQ ID NO: 3651 - protein, 243 aa, Roseovarius nubinhibens ISM
MSRFAGKVALVTGASSGMGAAIARRLAEGGAQVLTAQRGSADFDPIKADFADPGAAERVIATVAERVGRLDILINNAGLMREGSVEETSDADWAAHLQVNLTAPFQLIRAALPMLRDGGGAIVNVGSIEGLGSNPRHPAYCASKAGLHGLTRAVAVDHGPEGVRCNAVAPGWIDTPLNEDFIDSMPDPKAFRAEIGSIHPVRRTGRPDEVAQLVCWLASEEASFVTGQIYTIDGGRTAQLSLP

SEQ ID NO: 3652 - protein, 375 aa, Nocardia farcinica IFM 10152
MDKLVLDARTDRSSALMVAPAPARFPQSLIGNTPVLWVGAPLAPKGRGFWAKLEGFNPGGMKDRPALHMVLKAEQRGDLTPGARIIESTSGTLGLGLALAGIATHHPVMVVTDPGLEPIVARMLTAYGTQVDVVTEAHPAGGWQQARRDRVAELLAADPDAWCPDQYSNPDNVDGYESLALELVEQLGGVDVLVCAVGTGGHSAGVARVLRQFNPEMKLIGVDTVASTIFGQPAGPRLMRGLGSSIYPVNVDYDAFDEVHWVAPSEAVWACRTLAATHHATGGWSVGAVALVAGWAARTHDTDTRIAAVFPDGPHRYFDTIYNDAYCDEHGLLDADPPVEPDTIAHPAERVVRSWTRTTTVVDPRQFIHDQELAS

SEQ ID NO: 3653 - protein, 1125 aa, Magnaporthe grisea 70-15
MSSRAAIASPVAVAPAGAPEYYQPTSSDRRRHHAPIAPPRTSSSHQTSAPVNGAQTSRRPVSASHQPQNSSSRRAPDHHGSSADQQTDQSSSSRRRDRHHAPATGDYPPQRQGSTRDPRTATTTTMPIRTNTGGSATASSSKQPSREASEILNSMLVSQPEVDIEREKERLALAQPTSSAHDASEVASPPVVPTQRSRQDHSSKREKHTKFGEYILGNTIGEGEFGKVKLGWKSEGGVQVAIKLIKKDALGSNPNRMQKIMREVSILKQLTHPNIVRLHKMEESERHFGIILEYASGGELFDYILNNRYLKDNAARRLFAQLVSGVGYLHKKGIVHRDLKLENLLLDRNRNIIITDFGFANTFDPALELTEEEEAGLSNREFVKRLGLDKIGANGSRKGDLMQTSCGSPCYAAPELVVSDSLYTGRKVDVWSCGVILYAMLAGYLPFDDDPANPEGDNINLLYKYIVSTPLTFPEYVTPHAKDLLRRILVPDPRRRADLFEVARHSWLSEYAHVVEFITSSTTTHTEIQNTTVPAEDSENPNLARSASVREASRRTPVSPTIGGLASKQGGIDQETEYAARQQKDNKRRTVQVEYVAPTTQTQRGEPAQQQATSGKTRARSGSEGPVEVDPRLSSDKPLPRDPPVSKESYSKPSVRGDPRKPPSSHRNQPSISRPPQSGRVPSDSYVTTMAPGSRPGTSGSMNTAGARPVAGASRSSYGQPLPPTVAGTNVHGRIQQPTDQQSEFGRPSAGGVPSKFAHVPGVAGHDQPDSREGSAKGHRRSNTLGEITGKMFGRSGSIFGNKNRKSSKVDQPQTPTEAKNRDSRKYPPVSMSAAPNPNGEYEPRKSVDSKRSRRSFSFGLGPRKKSGSIHNGSQTSVDKQNKRFSFIPGSISLKAIGIGKETPPGSTQGGGNDSQVDLGYQQEHLREPYRPDSQQQHQRQQSHYVDQRVNEQDLEAAGMDGMYAQLHSPSAPTFSTQQPHQQQQQQHYPAHYTSGQYGDRQMATAVPGYMQSGAHLQTSESESSVNMLSPEQQQFQAHGLRSVSVDHHQKLMEAQGGLGPAGRTGSSVGADGRQARVLQKNKRFVDAYDTDHSGGADHAGSSGAARRVMDFFRRRGKARGGDDR

SEQ ID NO: 3654 - protein, 257 aa, Vitis vinifera
MKLILSVCLVEGFGTFPTLLCADGCCVTDRRMGVSGYPMEIQALFFMALRCAVHLLREDDGKEFSKRIEKRLQALTYHMRSYFWLDFQQLNNIYRYKTEEYSHTAVNKFNVMPNSIPDWVFDFMPMKGGYSVANVSPTRMDFRWFVLGNCVAILSSLATYNQSMAILDLIEDRWEELVGKMPLKLSYPALDIHGWSIETGSDPKNTRWSSQNGGSWPGLLWLLTAACIKTGWPEIERKAIELAEHAADVQGRLARIL

SEQ ID NO: 3655 - protein, 437 aa, Geobacillus kaustophilus HTA426
MNYAERLLQKFEKRDAVIGVVGLGYVGLPLAVEKAKAGFHVIGFDIQQSRVDQVNNGINYIGDVVDEDLHEMVKQGRLMATTDYARIAEVDAVAIAVPTPLDEHHQPDTSYVENSANEVAKYAHEGMLVVLESTTYPGTTEEIVKPALEKKGLVVGETVFVAYSPERVDPGNKQFKTKNTPKVVGGVTKTCTKVAAAMYRAVLEGDVHEVSSPAVAEMEKIFENTFRHINIALANEMAILCERMGIDVWEVIEAAKTKPYGFMAFYPGPGLGGHCIPIDPFYLTWKAREYNYHTRLIELAGEINNAMPEYVVNRAMLILNEEGKALRGSKVTVLGVAYKKDIDDVRESPVLKIVELLEQYGAEFAVVDPYVPSFRACNRVIETVELTPELLAQSDLVLITTDHSNIDYEMVARHSRVVFDTRNAMKDVSKPAKYVKL

SEQ ID NO: 3656 - protein, 335 aa, Mycobacterium sp. JLS
MDVRSVADPSPPPGGVVVEVHATGLCRSDWHGWAGHDRGITLPHVPGHELVGVVAEVGAGVEKWRVGDRVTTPFVCGCGRCQWCLEGQAQVCPDQTQPGFTHWGSFADYVALHAADANLVAVPDAVVDAAAAGLGCRFATAYRALSARARIRPGEWVTVVGAGGVGLSSVQIAVAFGARVIAVDREPAALALASRLGAEHTVHADGADVAGRVHELTGGGSHVAVDAVGSAATCADAIHSLRRRGRHLQVGLLPDVTGHPAVPMDRVIAWELDVLGSHGMASGDYPGMMRLIEAGTLRPQAFVERVVGLTEGAALLPSLSVATPAGVTLIDPRLG

SEQ ID NO: 3657 - protein, 561 aa, Salmonella enterica subsp. enterica serovar Typhi str. CT18
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 3658 - protein, 236 aa, Artemisia annua
GKRFAVIHGDNPKPDVSFYSVKGGKVSKLTTLKQRQANALFWSPNGRFVILAGLKGFNGQLEFFNVDELETMATAEHFMATDIEWDPSGRYVATSVTSVHEMENGFNIWSFNGKLLYHIMKDHFFQFLWRPRPPSFLTPEKEEEISKNLKKYSEKYDVEDQDISLLLSKQDLEKRKQLKDDWESWVNKWKSCHEEEKATRQKLRDGEASDVEEECEAKEVEIEELINVYEEVVVEA

SEQ ID NO: 3659 - protein, 504 aa, Vitis vinifera
MAEDQSVVTNENFDSSEANDDKCTRTLDAAKTPHPRPTSFDQNLMFIEAWEHLRRSVVYYKGQAVGTMAALDNASGALNYDQVFVRDFVPSALAHLMKGELEIVKNFLLRTLHLQLSVKGIDRFALGQGLISAQSCEGHFGETAIGRVAGVDSGFWWIILLHAYTRATGDYSLSHRPECQNGMKLILSVCLAEGFDTFPTLLCADGCGMADRRMGVYGYPIEIQALFFMALRCAVHLLQEDDGKEFIMRIEKRLQALTYHMRSYFWLDFQQLNNIYRYKTEEYSHTAVNKFNVIPDSIPDWVFDFMPMKGGYFIANVSPARMDFRWFVLGNCVAILSSLATHNQSMAILDLIEERWGELVGKMPLKLSYPALDIHGWSIETGSDPKNTRWSYHNGGSWPGLLWLVTAACIKTGRPEIARKAIELAEQRLSKDDWQEYYDGKEGCYVGKQSRRLQTCSIAGYLVSKMLLEEPSHLGIIALEEDEKIKPTTITRSTTLPTKFRGYP

SEQ ID NO: 3660 - protein, 790 aa, Oryza sativa Japonica Group
MAPRLSACLVFLLILVLSLQESPLHAADTLTAEQPLSADQKLISQDGKFALGFFQPAAGGSSSRWYIGIWYNKIPVQTVVWVANRDKPITDPTSSNLTILNDGNIVLLVNHSESPVWSTNIVNNTIASSPVAVLLDSGNLVVRHESNTSEVLWQSFDDFTDTWLPGNKLSRNKKTGVIKRMISWKDRADPAPGMFSIQLDPSGATQYILLWNSSSVYWASGNWTGNTYTGVPELSPTNSDPNSAYTFQFVDNDQETYFNYTVKNDAQLTRGVIDVSGHFQAWVWADAAQAWQLFFAQPKAKCSVYGMCGTYSKCSENAELSCSCLKGFSESYPNSWRLGDQTAGCRRNLPLQCGNNGSVKAKQDRFFMISSVKLPDMAHTRDVTNVHNCELTCLKNCSCSAYSYNGTCLVWYNGLINLQDNMGELSNSIFIRLSASELPQSGKMKWWIVGIIIGGLVLSSGVSILYFLGRRRTIGINRDDGKLITFKYNELQFLTRNFSERLGVGSFGSVYKGILPDATTLAVKKLEGLRQGEKQFRAEVSTIGNIQHINLIRLLGFCSEGAKRLLVYEYMPNGSLDHHLFQNNSAISSWKRRYQIAIGIAKGLAYLHDGCRDCIIHCDIKPQNILLDMSFTPKVADFGMAKLLGRDFSRVLTSIRGTIGYLAPEWISGESITTKADVFSYGMMLFEIISRKRNLTQTETRTEIFFPVLVARKLVQGEVLTLLDSELVDDVNLEELERACKVACWCIQDDESSRPTMAEVLQMLEGLVDIEVPPAPRYLQVLAEGAASKT

SEQ ID NO: 3661 - protein, 227 aa, Brassica napus
  misc_feature (219)..(219): Xaa can be any naturally occurring amino acid
GDNISSKPLSFFSESLRVIMINPLLSIQNSPTTFMNPPFSFFNTKLQQQQPEKQNKSNTLFIVETKSRRATTFSCLSISRKRRSNGVSESEETVRYEQMGGGGISVLCGLGYWVQGSRCFPWLALNFHMDNTLGLQPSTLQLVQYSCLLPMVAKPLYGVLSDVLYIGSGRRVPYISIGVSLQVLAWGTMALFQGAREVLPSLIACALLSNLGASITEVXAKDALVAE

SEQ ID NO: 3662 - protein, 828 aa, Zea mays
MEDARRPDAQSPATPRMSLAAAVATALAVLAYSCTAADPDTVSARRPLRGNGTVVSAQGKFELGLFSPGASGRFYLGIWYKNVPVQTVIWVANRASPLSSAASAELRVSPDDGNLELVGLIQNSASPAVAWSSNMSLSPSTSPSPSPGSNIAVMRDDGNLVLLGGDDSSTVLWQSFDHPTDTLVPYAWLGENKVTGEYQTLTSWRDAEDPAPGMFTDTVDRNGSSEFFLLWNGSRAYWRSGVWTGSVFANLPEAVNNVLFNQTYVDTPAYRRVTSVLYDNATITRMVLDLTGQTKQYIWVPGSQSWQFFWAAPTVQCDVYSLCGAFGVCSRRSQPPCQCPRGFAPAAERDWGLSDWSAGCQRSAPLLCGGNGRPTDDGFLELPDMKLPDDPLAVSVRTRAECESACLNNCSCQAYAFSGDGSCAVWNDGFRNLEQLYADAGNSSAATLYLRLPESELHGAKRKSRRLWLVLGIILACLAALGASALVAWVLLSRRKRRRSEMADQLKGSSLQVYSCGDLRAATKNFSEMLGGGGFGTVYRGVLNGGTEVAVKKLEGLRQGDKQFRTEVSTLGLIKHVNLVQLLGFCSSGDEKMLVYEYMRNGSLDAYLFGGSGRQRPSWRDRCGIMVGIARGLAYLHEGCRECIIHCDVKPENILLDGDLCPKIADFGMAKLVGRDFSRVLTTMRGTIGYLAPEWISGLPISAKADVYSFGMLLFELISGRRNADAGHGSDADEGDAGGQQRPPSTFFPVWAASRVVAGDMAAVADPRLRGDVVEGELERACRVACWCIQDQEAHRPAMAQVVQALEGVVDVQMPPVPRVLQHLATMT

SEQ ID NO: 3663 - protein, 315 aa, Roseovarius nubinhibens ISM
MADTQFGPHGWTPERLGSLAGRCYVITGANAGTGYEAARLFLSKGASVVMLNRSAEKSAAAIATLKAEHGAEADVRFIEMDLADLTSVRRAAEEIRETVPRIDALICNAAIAQVPKQRLTVDGFESQLGTNHYGHFALCGLLFERIEESEGRIVVVASLGYNMGIKTIQFDDLNWDNNYSANAVYSQSKLAQMMFAYELQDRIRAAGKSVEVLVCHPGSSKTSLIKTSGSPVMRAIWWLMTKSPMVQTAQQGAYPEVMCATEEGLEERALYGPTGRMEFVGPVGRGTLHPHAYDKPVMTRLWEVSEAATGVVWPL

SEQ ID NO: 3664 - protein, 398 aa, Vitis vinifera
MDHDLTGLADRPGMRFSVPQIKCYMRQLLTGLHYCHVNQVLHRDIKGSNLLIDNEGNLKLADFGLARSFSNDHNGNLTNRVITLWYRPPELLLGTTRYGPAVDMWSVGCIFAELLHGKPIFPGKDEPEQLNKIFELCGAPDEVNWPGVSKIPWYSNFKPTRPMKRRLREVFRHFDRHALELLERMLTLDPSQRISAKDALDAEYFWTDPLPCDPKSLPKYESSHEFQTKKKRQQQRQHDETAKRQKLQHPQQHARLPPIQQSGQVHAQMRAGPNQPMHGGSQPPVAAGPSHHYGKPRGPSGGPSRYPQSGNPSGGYNHPNRGGQGGGGGYGNGPFPPQGRGPPYASSGMPGAGPRGGGSGYGVGAPNYPQGGPYSGSGAGRGSNMMGGNRNQNYGWQQ

SEQ ID NO: 3665 - protein, 453 aa, Mycobacterium sp. JLS
MTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAEVNLDEECRRLTMRSLGRSILGLDLDAKADVIAGPLPVAAGYAADRALKPVRAPRWLPTPQRRRANAAVATMKAVTNDILQACRADPTRDAPLVHALINASDPETGRSLSDDDICNELLVFMLAGHDTTATLLTYALWALGHHPDIQDRVAAEAYALGDRLPTPDDVGRLGYTVQVLNESLRLCPPAAGVGRLALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 3666 - protein, 493 aa, Arabidopsis thaliana
MVLSKTVSESDVSIHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVNLREDYYVMDPVKAVEMVDENTICVAAILGSTLTGEFEDVKLLNDLLVEKNKQTGWDTPIHVDAASGGFIAPFLYPELEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFKIVSKENGVPLVAFSLKDSSRHNEFEVAHTLRRFGWIVPAYTMPADAQHVTVLRVVIREDFSRTLAERLVADFEKVLHELDTLPARVHAKMANGKVNGVKKTPEETQREVTAYWKKLLETKKTNKNTIC

SEQ ID NO: 3667 - protein, 345 aa, Burkholderia sp. 383
MGRFDARQRGYRMPAEWESMDATWLGWPVLHDREDLWGSHYAQVCREFALVARTIARYQRCVVAAHHSQADAARELVGASVDVVPVAAEDNWLRDCGPIFLVSEQHGLGAAVFRFNCWGEKYQPYDGCQQAGQDIARAAGAEIFNSHMVLEGGSFYVDGQGTLVTTESCLLHPNRNPHLSRAEIEAELRRMLGVEKIIWLPGNPDEVETNGHVDGIASFIAPGRMLCQTALPEQGDYFHVMRENRRALELATDAAGRRFELLDLPSPIVTERFGSERYCDCYANYILVNGAVIVSAFGVEQDQAAREAFSRAFPGRNVEMLPIPTLSIGGGSIHCSTQQQPSVAN

SEQ ID NO: 3668 - protein, 61 aa, Zea mays
  misc_feature (15)..(15): Xaa can be any naturally occurring amino acid
CVIPMGVLVADYIAXHAEFFSFGTNDLTQMIFGYSMDDVGKFNPVYHAQWIRRMEPFQVLV

SEQ ID NO: 3669 - protein, 370 aa, Burkholderia sp. 383
MTTRRQLLKRGLSVSGAALAASALGGLLGRAAHAQQGATWHMPDEGAPHTATWMAFGPSEDIWGARLLPVARANLAAIAKAIAAHEPLKMLVREQDYAIASRLCGSSVELVQHPVDDLWMRDTGPVFVKNASGQLGGVSFNFNGWGNKQEHDQDAEVAPFVAERAGARLLDTRLVLEGGGIEVDGEGTAIITRSCVLNSNRNPGVGQAQCEAELSRLLGLKKIIWLPGIAGKDITDGHTDFYARFTSPGVVVAGLDTDPSSYDHAVTRQHLEILRKSTDAKGRPLKVVVLPGPKSVRHQYENEEFAAGYINFYVCNRAVIAPQFGDSRADRNTRDTLVDLFPGREVIQLNIDGIAAGGGGIHCTTQQQPA

SEQ ID NO: 3670 - protein, 478 aa, Bordetella petrii
MKQHFIDNRAVPGSSGESIPVLDPSTGQQYDSIARGNATDIDLAVQAARRAYDEGAWGRLTAAERGRLMLKLSVKILDCADELTDIESRDCGKPTKQARADVTAVARYFEYYGGAADKLHGETLPYQNGYTVLTLREPHGVTGHVVPWNYPLQIFGRSVGGALAAGNACVVKPAEDACLSLLRLAELAAEVGFPPGAINIVTGYGHEAGDALTRHPGIDHISFTGSPRIGVLVTQVAAERHVPVTLELGGKSPQIVFGDADLDALVPVAVNAIVQNAGQTCSAGSRLLVERSAYDRVLERLSQAFSALRAGPATMDLDCGPLIRKTQQERVQNFLKAAAQDGIATAAQGKIADGAPAEGYYQAPTLLDNVPVDHRLAQEEVFGPVLAAIPFDDEADAVRIANATEYGLAASVWTRDGARQLRIARKVRSGQVFINNYGAGGGIELPFGGVKASGHGREKGFEALYGFTVLKTISIKHD

SEQ ID NO: 3671 - protein, 578 aa, Gaeumannomyces graminis var. graminis
MVAHHSFTLLSLAALALGSPLGELQQRAEPRIQQRATCAGNTATTRSQWCDFDIKSDYYTGQHPNTGVTREFWLELTDSVKLAPDGVPRYVQAFNGTVPGPTLVMDWGDDVVIHVTNKLTQSINGTSVHWHGLHQKDTVLSDGVVSVTQCPSVPGTTQTYKFKATNYGSSWYHSHFALQAWQGVFGGIIINGPASANYDEDVGMVVLSDWGHKTPDELWHQAESQGPPTLENALINGMNVYGAEGNQTGKRWETSFEAGKSYRFRIVNTAIDTHFKFGIDNHTLTVIALDFIPVEPYETTMVNIGMGQRVDVIVKADQAAVASDFWLRAIPQSACGTIEMAKNTRAIVHYGNSQGVPSTTGHTYVDACEDEPLEKLKPIIRIDAEQSTYEQLKIATAGVNGNGVFRWYLNSTTMELDWSNPTVSQLASNATVAFSNSNAVMELPEADKWAYVIIQTDFGVAHPIHLHGHDYSVLAQGSGAYQPGVTKLITTNPMRRDTAILPAAGHLVLAFKTDNPGAWLMHCHIGWHTAQGFAMQFVERRSEMFSKNIINNNDIEGLCEPWRTHVGKHNIKLEDSGI

SEQ ID NO: 3672 - protein, 263 aa, Bordetella petrii
MTAVPPTQAYLQQFSLAGQVALVTGSARGLGLCIARALAGCGAHVLINGRNAESVQSTVAMLRNDGLAASALAFDVSDDEAMSRAYARIDAEHGRLDVLVNNVGARNRKTLQAISPAEIRALIDTDLVAGMLLAKLAAERMVRQGSGRLIAITSVAGELARAGDAVYPAAKQGLTGMMRALAAEFGPLGITSNAIAPGTFATETNAAYVADPAVHDPMAARNPMGRWGRPEEIAGAAVFLASPAASYVNGQVLAVDGGLSILF

SEQ ID NO: 3673 - protein, 196 aa, Saccharomyces cerevisiae
MVAQVQKQAPTFKKTAVVDGVFDEVSLDKYKGKYVVLAFIPLAFTFVCPTEIIAFSEAAKKFEEQGAQVLFASTDSEYSLLAWTNIPRKEGGLGPINIPLLADTNHSLSRDYGVLIEEEGVALRGLFIIDPKGVIRHITINDLPVGRNVDEALRLVEAFQWTDKNGTVLPCNWTPGAATIKPTVEDSKEYFEAANK

SEQ ID NO: 3674 - protein, 188 aa, Haemophilus somnus 129PT
MVVEQTSRGERSYDIYSRLLKERVIFLTGEVEDRMANLIVAQLLFLEAEDPAKDINIYINSPGGSVTAGMAIYDTMQFIKPDVRTLCIGQACSMGAFLLAGGTAGKRAALPHARVMIHQPLGGFRGQASDIQIHAQEILKIKQTLNERLAFHTGQSIEQIEQDTDRDNFMSAEQAKLYGLVDEVLIKR

SEQ ID NO: 3675 - protein, 187 aa, Saccharomyces cerevisiae; identical to SEQ ID NO: 927

SEQ ID NO: 3676 - protein, 454 aa, Oryza sativa Japonica Group
MNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 3677 - protein, 128 aa, Yersinia pestis CO92
MAYSEKVIDHYENPRNVGSFDSQDPTIGSGMVGAPACGDVMKLQIKVNEAGIIEDARFKTYGCGSAIASSSLVTEWMKGKSLDQAEAIKNTQIAEELELPPVKIHCSILAEDAIKAAIADYKSKHTAK

SEQ ID NO: 3678 - protein, 181 aa, Arabidopsis thaliana
MVNYVLKITADLENLTNLQPSGGCDDSNFPYLFKVTRYPPFSHQFYALLKCERCGEVTPKETCVTLNETFTPPGGRGTCHLVQKCKFCGREGNVTMIPGKGRPLTLEDSEAGEHAPLMVFDCRGYEPIDFGFGGYWKAQAESGTKFDEIDLSSGEEFTEYDEKGECPVMISNFRASFSVTK

SEQ ID NO: 3679 - protein, 545 aa, Shewanella sp. MR-4
MTILTQSTTWQALAAHSHQIPHMRELFAGDPARFSNMSLSTCGLFLDYSKNRATPETLNLLQTLAQEAKLDAKIKAMFAGDIINTTEKRAVLHTALRSTAEQSIVAEGQDIVPEVQQTLNKMQQFVTSVTSGQWKGFTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSSLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 3680 - protein, 181 aa, Vibrio fischeri ES114
MISSLRRYKSNFPSIGSNTYIDTSSVLIGEITIGQDSSVWPLVVARGDVNSISIGDRTNIQDGSVLHVTHKNPENPKGAPLVIGNDVTIGHKVMLHGCVIEDRVLVGMGSIILDNAYIEADVMIGAGSLVPPNKRLESGYLYIGSPVKQVRPLSIEEIASLKKSALNYVNFKNDYIEEEIN

SEQ ID NO: 3681 - protein, 111 aa, Glycine max
MAGNQDQFEIKFRLTDGSDIGPKSFPAATSIATLKESVLAQWPKDKENGPKTIKDVKLINAGKILENNRTVGECQSPLCDTPDTVTTMHVVVQHPATEKEKKAANKATQNK

SEQ ID NO: 3682 - protein, 632 aa, Gloeobacter violaceus PCC 7421
MAYEPLHHKYRPQRFGDVVGQGPIVTTLTNALKAGRIAHAYLFTGSRGTGKTTTARLIAKALNCIHGPTPDPCGRCEQCLAIATGSALDVIEIDAASNTGVDNIRELIERAQFAPVQSRQKVYILDEVHMLSSAAFNCLLKTLEEPPAHVTFVLATTDPQKVLPTVISRCQRFDFRRIPLTDMVKHLEEIAWKEDIDIEHEAVELVAQIAQGGLRDAESLLDQLALLEGTIGAERIWQLVGAVPERELLVIGECIQAGDSTRLIEQVRRLLDSGKEPLQVLQDLLGFYRDLLIAHTAPDRRDLVAVTAASWQQMCERAKTLSIPQLLALQERLRQAEPQIKTSTQPRLWLEVGLLGLLASPSQNQPVALAPAAARPAAPVPVPPPRPAEERPTPPPPAAPRGVEERPNSVPQPPVEPTPPQRPQVPPPSIEPAAAIHRPARPSGSTPDGTGLRERWPEWIRLIPQPTQSLMSSSFWLEETPKRLVIGFTTEPLVKRASEPRRLKQIQEVLQQFLGRPIEVQFHIGKAPAAAPAVAVASSQSAAYTPPPVSFSPPAPPEVTPVSPTTVAPPSAAKPPLSDEEPDELDRAARGLAEFFNGEVISFDGEAEELPGATQPGAAEVSDIDDDEDIPF

SEQ ID NO: 3683 - protein, 314 aa, Fulvimarina pelagi HTCC2506
MPHETLDTVVSEIAEEMRARPDRGKVASYIPELGRVDPNQFAITVVTQDGHVASGGQCDIPFSIQSVSKVFTLTLALGLAGNRLWNRVGREPSGSPFNSIVQLEHERGIPRNPFINAGAIVVTDHVLAGHQPREAIGEILRFMQFLADDESIYIDHDVAASEEAHGFNNRALANFMKGFGALDNPVEYTLGVYFHHCAIAMTCRQLATAGRFLANNGIRPETGYSVVTPERARRINAIMLTCGHYDGSGEFAYRVGLPGKSGVGGAILAIVPGRASICVWSPGLDTTGNSHLGRIALEMLTTRLGWTVFGPGAV

SEQ ID NO: 3684 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 3685 - protein, 509 aa, Burkholderia sp. 383
MTKRRTHARAGKRAQHAPDTGRRGFIRYSAAFLGLPLLGSLAACGGGGSDGASGAASTSPGTTPGTKPSTRPVTYRLPAEDAPHASTYMAFASGADGIWLPVTPQSTDAGIDRVRADLMDVAKAIGATEPVDMLVLPADLDAARALLATASVANPDLHARYAARAAGAGGINLVPLADGFNDFWVRDTGCLFVRDTTNDNALNAVGFNFNGWGNANTDGAGMSPGATVPPEVAAASNRSKAGKFFQPFGRDNTVAGWMAQRKGASLIRSTLTLEGGAIEFDGDATAILTESSVLHVNRNPQLFDIPNGVIANATLLPTAKDTVLAELQRTLGVRKIIWLPGTATYPRSSGVGGAGGAATPAGETDITNGHVDFYARFLAPGVVACCYDASNSTGERALTDANRQRLAGETDANGRPLQIVELVPPVNFGTSAGTSLNDRQMTNFAAGYINFYACNGAIVMPKFNDAAADAAAIAAIRPYAGNRAIVQVDILGIASGGGGIHCSTREVPA

SEQ ID NO: 3686 - protein, 590 aa, Shewanella sp. MR-4
MDPHVSHSAHLFSLRIAHALSEACVKDKYSVKRFGQDLLAGLTVGIIAIPLAMALAIASGVAPQYGLYTAIVGGFIIAMTGGSRYSVSGPTAAFVVLLYPIAQQFGLAGLLIATVMSGMMLVAMAMLRLGRLILYIPESVTLGFTAGIGVVIATLQLKDFFGLHIEHMPEQYFAKLMALGQALPSLHLPSLLVAAATLATMLLWPKLKMPVPAHLPAIALGSILALVLNTMGADIETIGTRFHYQLSDGSVGTGIPAVLPHFEWPWLQTGANGQAFEFNLATFQALLPAAFAIAMLGAIESLLCAVVLDGMTGKRHSANSELLGQGIGNIITPFFGGIPATAAIARSAANVKAGAQSPIASMIHAIVVLIGLVALAGILAYLPMSAMAALLLVVAWNMSEAPKAVHLLKTAPTSDILVFLTCFSLTVIFDMVIAISVGIILAALLFMKEIAEMTKLYDISTNKRYVDQPLPADWAVIKINGPLFFAAADRIFAEIASLTQDKQVIVLYLDGVSILDAGGLAALNKLIDKCKLNHTKLIVADLQFQPIRTLARAKVQPIEGVLKFYPTLREALAEAPAPELAVEASAATHS

SEQ ID NO: 3687 - protein, 342 aa, Fulvimarina pelagi HTCC2506
MDDISQNRSARTHGRGKIYDSIVDTIGDTPLVRLKKLAAEKGVKANLLAKLEFFNPIASVKDRIGVAMLEKLEADGRIEPGKTTLVEPTSGNTGIALAFAAAAKGYNLILTMPETMSIERRKMLRLLGAQLVLTEGAKGMKGAIARAGELVEEIPNAVIPQQFENPANPEIHRVTTAEEIWNDTGGNVDVLVAGIGTGGTITGAGQILKSRKPDVHVVAVEPEASPVLSGGQPGPHKLQGIGAGFAPQILDQGVYDEVLTVSNEESFELARLVARLEGVPVGISSGSALAAAIKVGQREEMADKNIVVIIPSFAERYLSTPLFEGLTDEDEPKEPRRGAPSI

SEQ ID NO: 3688 - protein, 162 aa, Physcomitrella patens subsp. patens
MSSSGYGQKEKVLSRIAANRLQKELTEWQVNAPCGFKHKVTDNLQRWVIEVQGAADTLYEGETFQLQVDFPEHYPMEAPQVIFMHVPPLHPHIYSNGHICLDILYDSWSPAMTVSSICISILSMLSSSTVKARPPDDDRYVRKCRNGRSPKETRWWFHDDKV

SEQ ID NO: 3689 - protein, 220 aa, Zea mays
MGQQRTLVYSFVARGTIVLADHAEVSGNFASVAAQCLQKLPANNNRFNYNCDGHTFNYHIYDGFTYCVVATESAGRQLPVGFIERVKEDFSKKYSGGKAKNASANGLKREYGPKLKEHMRYCDQHPEEIDKLAKVKAQVTEVKGVMMQNIEKVLDRGEKIELLVDKTEDLRSQAQDFRQQGTKIRRKMWWENMKMKLIVFGIVVALILLIVLTVCKDLNC

SEQ ID NO: 3690 - protein, 322 aa, Triticum monococcum
MDTSTRAAKIPSLPQQTEINWDNLDMTKLYVVGAGMFSCVTVALYPVSVIKTRMQVASGEAMRRNALATFKNILKVDGVPGLYRGFGTVITGAIPARIIFLTALEKTKATSLKLVEPLQLSESMEAALANGLGGLTASLCSQAVFVPIDVVSQKLMVQGYSGHVRYKGGIDVVQKIMKSDGPRGLYRGFGLSVMTYAPSSAVWWASYGFSQRMIWSALGHLNDKEDAPSQLKIVGVQATGGMIAGAVTSCVSTPLDTIKTRLQVNQNKPKASEVVRRLIAEDGWKGFYRGLGPRFFSSSAWGTSMIVCYEYLKRVCAKVEEA

SEQ ID NO: 3691 - protein, 325 aa, Zea mays
MASNGDKGLIVSFGEMLIDFVPTESGVSLAEAPGFLKAPSGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFIGALLNQIVDDRSVLEDEERLRKVLRFANACGAITTTKKGAIPALPSDAEVRSFLEKK

SEQ ID NO: 3692 - protein, 591 aa, Neisseria meningitidis FAM18
MSIVLHGVAAGKGIAVGCAHLIARGTEEVPQYDVAEADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIIAPDESVLNEYRRRAREYRSHKRDLNKLKKTAAATADGVCIELVGNIESAEDVKPLHNLGADGIGLFRSEFLYLNRDTMPSEDEQYEVYNAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGKVGIGCMIEIPSAALTVGSILKLVDFISVGTNDLIQYILSVDRGDDSVSHLYQPGHPAVLKMLQHVIRTANRMDKDVSVCGEMAGDTAFTRILLGMGLRRFSMNPNNILPVKNIILHSNIAQLENEIAKIVRCEDEEKAEKLIKQMNSVSVEEEADFKGRK

SEQ ID NO: 3693 - protein, 255 aa, Gloeobacter violaceus PCC 7421
MALLEIKSTREIAKMREAGRIVATVLKEIMALAEPGLTTGDLDAHAERRCADFGVIPAFKGYHGFPACICTSINHEVVHGIPSAKRRLKPGDVLKVDFGAIYDGWHGDSCVTIGLEPLAEEARTLIRVAEEALLKGIREVRQGVHLQQVSGAIQDYVEGYGFSVVRQYVGHGVGRNLHEEPQVPNFRTREIPDPKLKSGMTLAIEPMVNLGHHATRTLADRWTVVTLDNSLSAQFEHTVLVTRDGYEILTDRSKV

SEQ ID NO: 3694 - protein, 825 aa, Triticum monococcum
MAFSPRSPWSRSKKPDIYSTVVVHDDEDNARGGGAARAEDDDDDDPSALPPLLQRLPKDFGGASFDDDDDPYSSDLDDASLSATVVIKRGAPASTSSSSRSPFLDLRRSSPRAAEADPFSTFVVHGTARSGGASSPRESVSGTFIRHSGGPPSPRESVSGTFIRHTRGSSSPHESFSGTFIHHTSSASSPRDSASGAGAGFGSSFITPSSGQAEEDRQPSLLMQQQQSRRKASMSSLPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPPAIEMLKHKFIEKCNTGASKMLAKIKEAKIIRETAVQNQLPDSDDAMDATVRINEDYGETVPTNSQSTHETKNDGSGGDFGTMIVHPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 3695 - protein, 397 aa, Vitis vinifera
MGSVVLFMNGMDVGSPHARGMVDFETLVMAMEGAWVAMHVWKMGMNKMDENGDGYDRWWVLQMVSWVKLEMVSMDDVESDGYEDKKKWSVKALEVVPQDDLEAALSKASMPNKTVIITIVNKAYVEGDDTSMLDLFLESFWIGEGTREMAEHLLVVALDQTAFDRCIFRRLHCYKMVSEDGDMDGEKLYMSKDFIKMMWRRTLLLLRVLERGYSFIFTDTDVSWLRNPFPRLTTNQTADLQISTDLFLSRRRPEDSLINTGFYFVRSNNKTIALFQTWYAMRNNATGKKEQDVLSDLMRKGIFRELGLELRVLHTLYFSGFCQNSKDFRAVTTVHANCCRSISAKVADLKAVHRDWRRFKAATATNKTVTDIDATTFRWSVHEACVRSWNTSRNPVG

SEQ ID NO: 3696 - protein, 476 aa, Desulfovibrio desulfuricans G20
MKASKKPVLPRVPMPNQPPAERVRNFDEVALGYTPEMARQEAGRCLQCKKPRCVKGCPVEVPIPQFIAALAQGDVEHAYRIIKTTNSLPAVCGRVCPQESQCEGACILQAKGQPVAIGRLERFVADEYMHRDACGLITGKPECPYIDPEKKVACIGSGPASLTAAGYLAAHGCKVTVFEALHELGGVLVYGIPEFRLPKEKIVAKEVNALRELQVEFVRNRVGGKTFSISDLFAQGYKAVFIGVGAGLPRFLGVPGENLNGVFSANEYLTRVNLGRAYSFPEYDTPIIRGRRVTVFGGGNVAMDAARTAMRLGAESVHIVYRRTQAEMPARHEEVEHAIEEGVQVAELCGPLEFRAGENGSLAAVVLQKMELGEPDESGRRRPVAVQGATVELPTDLAVIAVGTRSNPVLLENEPELKLTGRGYVSVDEETGETSMPGVYAGGDIVTGAATVILAMGAGRRAAKHIARSLGCAVED

SEQ ID NO: 3697 - protein, 267 aa, Yersinia pestis CO92
MHPMLTIAIRAARKAGNLIAKNYETPDAVEASQKGSNDFVTNVDRDAEHLIIDVIRKSYPKHTIISEECGELVGEDDDVQWVIDPLDGTTNFIKRLPHFAVSIAVRIKGRTEVAVVYDPMRNELFTASRGQGAQLNGYRLRGTNAKDLDGTILATGFPFKVKQHAPAYIRVVGKLFEQCADFRRTGSAALDLAYVAAGRVDGFFEIGLKPWDFAGGELLVRESGGIVTDFAGGHNHFSSGNIVAGNPRIVKSIVQAMSNEISDALKR

SEQ ID NO: 3698 - protein, 295 aa, Gloeobacter violaceus PCC 7421
MSQFDLDAYLRQCRSQVEAALDRYLPQQYPDKLYEAMRYSLLAGGKRLRPILCLTSCRMSGGSADLAMPTACALEMVHTMSLIHDDLPAMDDDDYRRGKLTNHKVYGEDMAILAGDALLAYAFQLIAEKTVGAQPERVVEVLGRLGKAASGAGLVGGQVVDLESEGRTITLETLEYIHTHKTGALLEVSVISGAILAGADGGVVERLTRYSRCIGLAFQIRDDLLDITATQAELGKTAGKDLRDRKATYPSLLGYDGARDRAEQLREQAVAELADFGASARPLTALAEFIVQRRH

SEQ ID NO: 3699 - protein, 331 aa, Glycine max
MGSGPPLESQLRRPPPPSMKMEFFLTDHTLSNIKVNDTGVALTAFGPFSKLRATDVDGDVYEFEALQFHFHAPAEHTINEGRYELELHIVHKMTEESEKRAKTHRNLAVVAVFFELDKDPRTTPNAFIDALKLDRCGCDLDLNMYELLSQDLTEMTSFFAYKGGLTTPPCSETVNWYLFEKPVKITQAQLNHFNLRWKDNMNFACGEGNNRPIQALNNRTVLKSNNCCVMGKSQEYMREMMAEVKPREEVSLTLNREMMIGELSVKSHHTRVDTQSFIDSPTFKKKASYSEQVGEKSFPGETPSSMKKSAYSKTSIHNPVTTFTNVVESKN

SEQ ID NO: 3700 - protein, 439 aa, Desulfovibrio desulfuricans G20
MALFTKEEALKYHEAPRPGKLEVVPAKPCRNQKDLSMAYSPGVAEACKAIREDPAKAALYTGRSNLVGVVSDGSAVLGLGNIGPLAGKPVMEGKGVLFKTFADIDVFDINLDVRSADQLIEVVKTLEPTFGGINLEDIKAPECFYIEETLKREMNIPVFHDDQHGTAVISGAGLLNALDITNRRAEDMKVVIVGAGAAGIACATFYVALGVDPANIYMFDSRGLIHAGRSDLNSYKKRFAQKKDAGSLEDVMKGADMFLGLSTKDLVSKDMVRAMAKDPVLFAMANPDPEIAYPDAKEACPGCIMGTGRSDFPNQVNNVSGFPYIFRGALDVGATEINEAMKIAAARSLAALAREPVPAEICALYGVDSLEFGVDYVIPKPLDPRVLEWETPAVAQAAMDSGVATVPVADMKAYAASLRVRVDAAARRAAAVVDSYSGV

SEQ ID NO: 3701 - protein, 315 aa, Corynebacterium glutamicum ATCC 13032
MSDAPTVVAYLGPAGTFTEEALYKFADAGVFGDGEIEQLPAKSPQEAVDAVRHGTAQFAVVAIENFVDGPVTPTFDALDQGSNVQIIAEEELDIAFSIMVRPGTSLADVKTLATHPVGYQQVKNWMATTIPDAMYLSASSNGAGAQMVAEGTADAAAAPSRAAELFGLERLVDDVADVRGARTRFVAVQAQAAVSEPTGHDRTSVIFSLPNVPGSLVRALNEFAIRGVDLTRIESRPTRKVFGTYRFHLDISGHIRDIPVAEALRALHLQAEELVFVGSWPSNRAEDSTPQTDQLAKLHKADEWVRAASEGRKLN

SEQ ID NO: 3702 - protein, 326 aa, Clostridium perfringens SM101
MDKRKVIIDCDPGIDDALAIILALKSKEIEVVGITTVSGNVESVQGAKNALKALKLLGRLDIPVYLGESKPVKRELVTAQDTHGEDGLGETFLEEVSSEYIRENGVDFILNTLKNQENVSIIALGPLTNLYRAIEKDSETFHRVKEIVSMGGAYKSHGNCSPVAEFNYWVDPHGAREFLKKFNGEFTMVGLDVTRKIVLTPNLREMIHQFNDEIGNFIYDITRFYVDFHWEQERTLGCVINDPLAVEFFINRDICEGFKAYVDIACEDISMGQSVVDVADFYKRRKNVFVLDKVNSKKFMVSFLNKIFPSYKEDIENILNNPKYGI

SEQ ID NO: 3703 - protein, 154 aa, Triticum aestivum
  misc_feature (111)..(111): Xaa can be any naturally occurring amino acid
  misc_feature (143)..(143): Xaa can be any naturally occurring amino acid
  misc_feature (153)..(153): Xaa can be any naturally occurring amino acid
MDPVSHKMCVGPDYRHPLQKPTATVSIPMHFENVHTLPQTPQLIALLTIIRDQSTARADFIFYSNRIIRLLVEEGLNHLPVIEHSVTTPVGQTYEGVKFQGKICGVSIMRXAGEAMEQGLRDCCRSVRIGKILIQRDEETSLXRLFYDKLPKXI

SEQ ID NO: 3704 - protein, 223 aa, Houttuynia cordata
  misc_feature (95)..(95): Xaa can be any naturally occurring amino acid
  misc_feature (212)..(212): Xaa can be any naturally occurring amino acid
IQAGAKKVVISAPSKDAPMFVVGVNEKEYKPDINIVSNASCTTNCLAPLAKVLNDRFGIIEGLMTTVHSITATQKTVDGPSMKDWRGGRAASFNXIPSSTGAAKAVGKVLPQLNGKLTGMAFRVPTVDVSVVDLTVRLEKKASYEQIKAAIKEESEGKMKGILGYTEDDVVSTDFIGDKRSSIFDAKAGIALNDNFVKVVSWYDNEWGYSSXVIDLIRHIASV

SEQ ID NO: 3705 - protein, 436 aa, Mycobacterium sp. MCS
MTTFCEPTVSDHLRSDVAQPLHGVGIVGLGYVGLPTALAIAESGVAVLGCDISESRIAAIKAQRVDLLAGDLMSLNRLLDTDLLTLTTEVAGLAAVDTVLICVPTPVDTHLVPDLTALRAACATVVDAARPGQTIVLTSTTYVGCTRELLVEPLARRGLVAGRDVFVAFSPERIDPGSPAHVPERTPRVVGGVTDACAVQATRTLVRSAASVHQVSSPEAAELTKLLENTFRAVNIALANEFSDVAKNFGVDVMEVISAAATKPYGFMPFRPGPGVGGHCIPCDPHYLLWQLKATRLPSPVTEAAMASIASRPQAVVNRAQELLAEEGRPLAGSRILVVGVAYKPAVADVRESPALHILEELHRRGAEVAFTDAMVESVWTESGHLARETDPAQGDWDLVIAHTLHPAADHTWLSTVPLLLDAAYGLPDLPQRRVL

SEQ ID NO: 3706 - protein, 201 aa, Triticum aestivum
  misc_feature (181)..(181): Xaa can be any naturally occurring amino acid
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADFXAPHETSAANSIFCSWKALGN

SEQ ID NO: 3707 - protein, 333 aa, Clostridium perfringens SM101
MELMKQIWESAKNNRKKIVLPEGDEERTLVASQRIKEEGLADVYLVGSEQVIREKAEALGVNLEGVNIVDPETSDKLDTYINEFYELRKAKGMTVEKAGKIVRDPLYFGTMMVKMGDADGMVSGAVHTTGDLLRPGLQIIKTAPGVSVVSSFFIMMVPGSQYGEGGMLLFSDCAVNPNPNADQLAAIAIATADTAKNLCKMDPKVAMLSFSTMGSADHDLVTKVRVATEKAKELRPDLDIDGELQLDAAIVEKVASQKAPNSKVAGNANVLVFPDLQAGNIGYKLVQRFANAEAIGPVCQGFAKPINDLSRGCSSEDIVNVVAITAVQAQATK

SEQ ID NO: 3708 - protein, 406 aa, Oryza sativa Japonica Group
MARPRTRSVARMEATAAAAAAAEEEEAGNPDGAEGAAVVAVAPEAAAEGPNEPNAGEASREPDAGQASREPDVAGPSRQPGAAGPSREPGAAGGPRQPGAAGGPWQLVPNAAGPAVAPYVEDIDRYLRSLEGREMAKCLDAVQFCTAEESRRPIVNYDQEIQGGHINMRGKLVNWMEELVYGFNLWDNILYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKFTLNPNTRPWNLSVQRITGYKVSDIEDCIRSIHDLQAGRKWSNLRAIRSKYEDDAFERVSTIPSPNTIKPSFLRDLKYVNG

SEQ ID NO: 3709 - protein, 490 aa, Solanum lycopersicum
MMTTQNRRSSAVAKRQAMAANSSGLEHNQTGKLNAKKRPALSNISNNTTVSARNSVSHSSKLAPCTSKIVNIKKNTSACNSNAVSSGTAVLPASSSVRPSSKPVSIQRSDAVVPKITVIPVPATCSMDISPSHSDGSLVSMDESMSNSDTVRSPEVEYIDDHELAAVDSIEKKACSTLYISEHVKAAAADICKRDVLVDLESGDKIMNIDNNLVDPQLCATMACDIYKHLRASEAKKRPSTDFMAKVQKDINPSMRAILIDWLVEVAEEYRLVPDTLHLTINYIDRYLSGNLMDRQRLQLLGVACMMIASKYEEICAPQVEEFCYITDNTYFKEEVLQMESAVLNYLKFEMTAPTAKCFLRRFVRAAQGLNEVLSLQLEHLASYIAELSLLEYNMLCYAPSLIAASAIFLAKYILLPSVKPWNSTLRHYTLYQPSDLRDCVLALHSLCCNNNNSSLPAVREKYSQHKYKFVAKKYCPPTVPVEFFQNISS

SEQ ID NO: 3710 - protein, 259 aa, Fulvimarina pelagi HTCC2506
MSNSRATDADGMETSYGYSTVSGREEKQSRVNDVFHRVAKRYDLMNDLMSGGLHRAWKDTMVSWLAPPHRKGWRFLDVAGGTGDVAFRIVERTGRRVEGTVLDINASMLGVGAERAARKGISDNLRFVEANAEDLGLPDSQFDAYTIAFGIRNVPRIDRALAEAYRVLKPGGRFLCLEFSEVDVPGLDALYETWSFKGIPAIGQRVANDRESYEYLVESIRRFPNQENFAGLIRKAGFERVTYRNLTGGIAALHSGWKI

SEQ ID NO: 3711 - protein, 475 aa, Solanum lycopersicum
MRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKFKSVATLSSPKPVQSLF

SEQ ID NO: 3712 - protein, 378 aa, Solanum lycopersicum
MVDEENKVPATAAASRGSNKRAFDSIAITNENDPLQISERPYPANKKRVVLGELNNLGNVIVSTQNSDLTETHESKRKIKLRKTRNVVKETVELKTSANSSPKDNLQKCSYGPLIYQHLHSLEVEERRRPLSNYMEKVQNNVIPSMRTVLVDWLVEVTEEYKLVSDTLYLAVSYIDRFLSSHVLAMEKLQLLGVSCMLVASKYEEISPPHVEDFCYITDNTYTREEVVNMERDLLSFLNFEISSPTTITFLRIFLKAAQDNLSFLTLQFEFLSCYLAELSLLDYSCVRFLPSMTAASAIFLSRFTVLPEVCPWTLALQQCTGYKPSELKDCVLVIHELQSSLMEATGRALREKYMNHKYKCVAALHPPDIPSCFFDDA

SEQ ID NO: 3713 - protein, 499 aa, Glycine max
  misc_feature (151)..(151): Xaa can be any naturally occurring amino acid
MNSNGYPASSFKIPTVKFTKLFINGQFVDSLSGGEFETIDPRTGEVIARIAEGTKEDIDLAVKASRLAFDHGPWPRMPAVERARIMMKWADLIDQHVEEIAALDAIDAGKLYHMLKAIEIPATANTIRYYAGAADKIHGEVLKPAREFHAXTLLEPVGVVGHIIPWNFPSIMFVSKVSPCLAAGCTMVLKPAEQTPLSALFYAHLAKLAGIPDGVLNVVPGFGATAGAAICSDMDIDKVSFTGSTEVGREVMRAAANSNLKPVSLELGGKSPFIIFDDADLDKAVELALMAVVYNKGEVCAAGSRVFVQEGIYDEFEKRLVEKAKAWVVGDPFDPNVQQGPQVDKKQFEKILSYIEHGKREGATLLTGGKRVGNKGYYIEPTIFSNVKEDMLIAQDEIFGPVIALMKFKTIEEAIKSANNSRYGLVAGVVTKSLDTANTMSRSIRAGVVWINCYFAFENDIPYGGCKMSGFGKDSGLEALHKYLHVKSVVTPIYNSPWL

SEQ ID NO: 3714 - protein, 751 aa, Silicibacter pomeroyi DSS-3
MPKAKITNEEALAFHLEPTPGKWEVQATVPMTTQRDLSLAYSPGVAVPCEAIAADPGLAYDYTNKGNLVAVISNGTAVLGLGNLGALGGKPVMEGKAVLFKRFADVNSIDIELDTEDPDEFCRAVRLMGPTFGGINLEDIKAPECFIIEQRLKEEMDIPVFHDDQHGTAVICAAGLINALHISGKKIEDVKIVLNGAGAAGIACIELLKTMGARHENCIVCDTKGVIFQGRTEGMNQWKSAHAIKTELRSLEEAMKGADVFLGVSVKGAVTQEMVQSMADNPVIFAMANPDPEITPEEAHEVRPDAIVATGRSDYPNQVNNVLGFPYLFRGALDIHARAINDEMKIACAHALAALAREDVPDEVAMAYGKSLAFGRDYIIPTPFDPRLIHRIPPAVARAGMDTGAARRPIIDMDAYELGLKSRMDPTASILRGINARARKAQSRMIFAEGDDPRVLRAAVTYQRSGYGKALVVGRHDDVKAKLEAAGLGDAVRELEVVNAANTTHLETYKEFLYSRLQRKGFDNKDVHRLAARDRHVFSALMLAHGHGDGLVTGATRKSAHVLHQISHVFDADAAHGAAGITALLHKGKIVLIGDTLVHEWPDEHDLATIAERAADVARHMGLEPRVAFVSFSTFGYPISERTEKLTKAPKVLEARGVSFEFEGEMTVDVALNPRSKEAYPFSRLTGPANILIVPARHSASISTKLMQEMAGATVIGPILTGVDKPIQICSTVSTANDILNMAVLASAEIG

SEQ ID NO: 3715 - protein, 253 aa, Bordetella petrii
MFEDLKSKTALVTGAYSGLGRHFAGLLAGAGARVALCGRRTELGHEVAEAIRQQGGQACVVPMDVTRPDSVQAAIDAAASELGPLDIVINNAGVALSEPALDISEQAWTGLIDVNLNGAWRVAQASARHFRAQGRPGSIVNIASILGQRVASHVAPYAAAKAGLLHLTRALALEWARHGIRVNALAPGYIATDLNREFFASPAGEALIKRVPQRRLGQPQDLDGPLLLLASDASAFMTGSVIDVDGGHLASSL

SEQ ID NO: 3716 - protein, 290 aa, Silicibacter pomeroyi DSS-3
MAIWNLGSINADMVYAVPHLPGPGETLAASGLERFLGGKGANMSVAAARAGSQVRHIGAVGPEGRWAIDRLTEYGVDTRHIATLEAPTGHAIIAVEPGGENLIVLLPGANRAISPERVGSVLLDAAPGDLLVMQNETSAQVEAARLGRERGLTVCYAAAPFDAQAVRDVLPWLDFLILNAVEAEQLQEATGLTPDQLPVSHVIVTLGSKGARHFDTDKGISTEYPAYRVKAVDTTGAGDTFTGYVLSGMDRGLPMPQAITQAMRAAALMVMRHGTADVIPDLKEVLAARF

SEQ ID NO: 3717 - protein, 371 aa, Robiginitalea biformata HTCC2501
MLCKIEPMKAGIVGLPNVGKSTLFNCLSNAKAQSANFPFCTIEPNIGVVNVPDPRLKKLESLVQPQRVVPATVEIVDIAGLVKGASKGEGLGNQFLGNIRETDAILHVLRCFDNDNVVHVDASVDPIRDKETIDMELQLKDLETVEKRLEKVGRSARTGNKEAQKEASALERLKKGLESGTSVRAIGFEEDDYREFVAPLQLITDKPVLYVCNVDEQAATTGNAYVDRVREAVAGEQAEVLVLAVATEADINELETFEERQLFLEDLGLDEPGSSKLIRSAYSLLNLQTYFTAGEKEVRAWTIPVGSSAPQAAGVIHTDFEKGFIRAEVISYDDYIRYGSEAKVREAGKMRVEGKEYIVQDGDVMHFRFNV

SEQ ID NO: 3718 - protein, 463 aa, Rickettsiella grylli
MMKSIKPIGSIVEIIGAVIDVEFPRGEIPKVFDALTVDGHDLVLEVQQQLGDGIVRTIAMGTSDGLKRGTKVMNTKAPISVPVGKQTLGRIMDVLGKPIDEAGPIHEEIRLPIHRKPPTFSEQAVNEQLLETGIKVIDLLCPFAKGGKVGLFGGAGVGKTVNMMELIRNIAIEHSGYSVFAGVGERTREGNDFYHEMKESNVLDKVSLVYGQMNEPPGNRLRVALTGLTVAEYFRDEGRDILLFIDNIYRYTLAGVEVSALLGRMPSAVGYQPTLAAEMGALQERITSTKTGSITSIQAVYVPADDLTDPSPATTFAHLDATVVLSRQIAELGIYPAIDPLDSNSRQLDPLIVGQEHYDVARAVQKTLQRFKELKDIIAILGMDELSEHDKLTVMRARKIQRFLSQPFFVAEIFTGSPGKYVSLRETIRGFKAILNGEFDDYPELAFYMVGSIDEVEIKAKAL

SEQ ID NO: 3719 - protein, 364 aa, Zea mays
MAQARVRLTPAGRTPAATFLSGSNPRPAHLTFFPKLTPTSLSAAAAANAPPPHIVVVGSANADIYVEVDRLPLIGETVAARAGRSLAGGKGANQAACGGRLALGPTYLVARVGDDANGRLLEGALADAGGVRTDRVARAADAPSGHAVVMLMPDGQNSIIIVGGANMEGWAAGIGSEDLELIRKAGVLLLQREIPDWVNAQAAQAAKSAGVPVIMDAGGMDTPLPRELLSLVDIFSPNETELARLTGMPTETFEQISMAAGKCHKMGVQEVLVKLGSQGSALFVEGEEPIRQPIVPATEVIDTTGAGDTFTSAFAVALVEGKPKRECMRFAAAAASLCVRVKGAIPSMPDRKSVMKLLESVGVE

SEQ ID NO: 3720 - protein, 708 aa, Desulfovibrio desulfuricans G20
MLTRVFPFLGWFKGYTGESLRADLISGLTVALVLIPQSMAYAQLAGLPPYYGLYASFLPPLVAALFGSSRQLATGPVAVVSLMTSASLAPLATQGSEAYIAYAIMLALMVGLFQLALGVLRLGLVVNFLSHPVVNGFTNAAAIIIATSQLSKLFGVYVDKAEHHYETIIRVIESAMNFTHWPTLVMGVLAFAIMYLLKRYMPKVPNVLVAVALTTTISWGIGFQHDAKAPVTALKAPAASELIAAFNQKVNAIPAQGEKRAELGRKLEEAKGMADDNAHLELEYRIKEVGLAMDRLKGGIHNDRAALRDMLFDGVVMADGSMLFYQQGQTPDGMQTDGRVWRLKVGNRPLDVNALPMMGGGAVVGTVPSGLPTLSIPTLDISVMLQLLPYAAIISLLGFMEAISIAKAMAAKTGQRLDPNQELVGQGLANILGAVGKSYPASGSFSRSAVNLASGAVSGLSSVFTSMAVVIVLLFFTPLLYHLPQSVLAAVIMMAVIGLINAQGFRHAWKAQWYDGAISIVSFLCTLAFAPHLDKGIFVGVVLSLGVFLYKSMRPRVANLSRDENLDMRDAEARGLRQCEYMAVVRFDGPLFFANASFLEDQIMERMEAMPRLRHILIVCNGINDIDASGEEALGLLIDRVRSAGIDLSFSGMNEAVTAVLKRTHVWERIGEDHIYATMDAALCEIHEKAHKNGAEDNCPLTTYCALT

SEQ ID NO: 3721 - protein, 408 aa, Silicibacter pomeroyi DSS-3
MSDFMTRARAAEQAMREVFPATPLQRNDHLSARYGADIWLKREDLSPVRSYKIRGAFNAMRKQPGQGLFVCASAGNHAQGVAFMCRHMGVRGVIFMPVTTPQQKIQKTRMFGGDQVEIHLTGDYFDQTLAAAQAWCAQEGGHFLSPFDDADVIEGQASLAVEIEEQLGGVPDHVVLPVGGGGMSAGVATWFGDRSHCIFVEPEGGACLRAALAAGHPVKLDHVDNFVDGAAVGRIGEKTFELLKSRHMSDVLVMPEDRICTTIIEMLNVEGIVLEPAGALSVEAVADVQSFVRGKTVVCVTSGGNFDFERLPEVKERAQRYLGVKKYFLLRLPQRPGALKEFLNILGPDDDIARFEYMKKSARNFGSVLIGIETARPENFERLYARLDEAGFTYTDITRNETLAQFVI

SEQ ID NO: 3722 - protein, 330 aa, Listeria monocytogenes str. 4b H7858
MELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 3723 - protein, 350 aa, Listeria monocytogenes str. 4b H7858
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 3724 - protein, 375 aa, Desulfovibrio desulfuricans G20
MRALLALEDGFVLEGRSFTGPGETGGEVIFNTGMTGYQEVLTDPSYAGQMVCMTYPLIGNYGVTREDVESGKVHVEAFIVKECCKVPSNWRSVASLPDYLKRNGIMGIEGIDTRALTRHLRMHGAMRGIISTAETDPAALVQRAKDLPSMEGQNLVVRVAPESPYRWDGERPQKVTLQDGVYAWPGKGPRVVVYDFGIKWNILRLLAAEGLDLLVVPPSFTAQDVQRCGAEAVFLSNGPGDPATLKAEIAEIAKLTDMMPVAGICLGHQLLGHALGGTTRKLKFGHHGCNSPVKDLTTGRIEVSSQNHGFCVELDAVPDVRVTHVNLNDNTLEGFEHTVKPVISVQHHPEASPGPNDSHYFFGRFRKLLREHLGK

SEQ ID NO: 3725 - protein, 144 aa, Zea mays
MGYLPSLSSKAAHFVSDLTTVILNPVSERETSHLPMRHRIRAPFLCPLAKNLDSILQFVLNRMARLHVHFSSGLPLDGEVISGVRQNVNILIHLDVSKALKGGMKLYISNNKVILTEGFDGVVPVKYFERVETWPGRASIPFQR

SEQ ID NO: 3726 - protein, 165 aa, Zea mays
PVGAETFKEALRWGVQVFAVLGKVLKERKLLSGGVGDEGGYAPNLTSNQQALDILIEAIEQAGYKPGSQIALAMDIAASEFFKNGQYEYDGGSHSPQEFIDYQAKLVSQYPIVSIEDGLHEDDWESWKGLTTSLGTKTQLVGDDLMVTNPVRLQKSIDLGVANAI

SEQ ID NO: 3727 - protein, 498 aa, Vitis vinifera
MTVLLFVILAFPLLLLFLHRKHRKNGGLLHLPPGPPGLPFIGNLHQMDNSARHRYLWQLSKQYGSLMSLRLGFIPTIVVSSARIAKEVMKTHDLEFASRPSLIGPQRLSYNCLDLAFSPYNDYWREMRKICVLHLFTLKRVQSYTPIREYEVSQMIEKISKLASASKLINLSETLMFLTSTIICRVAFGKRYEDEGFERSRFHGLLNDAQAMLGSFFFSDHFPLIGWLDKLTGLTARLEKTFRDMDLFYQEIIEDHLKPDRKKQEQEDITDVLIGLQKDNSFAIDITWDHIKGVLMNIFVGGTDTGAATVIWAMTALMKNPRVMKKAQEEVRNTFGKKGFIGEDDVEKLPYLKAVVKETMRLLPAVPLLIPRETLQKCSIDGYEIPPKTLVFVNAWAIGRDPEAWENPEEFIPERFLGSSVDFRGQNYKLIPFGAGRRVCPGIHIGAVTVELTLANLLYSFDWEMPAGMNKEDIDFDVIPGLTMHKKNALCLMAKKYN

SEQ ID NO: 3728 - protein, 619 aa, Corynebacterium glutamicum ATCC 13032
MNEFDQDILQEIKTELDELILELDEVTQTHSEAIGQVSPTHYVGARNLMHYAHLRTKDLRGLQQRLSSVGATRLTTTEPAVQARLKAARNVIGAFAGEGPLYPPSDVVDAFEDADEILDEHAEILLGEPLPDTPSCIMVTLPTEAATDIELVRGFAKSGMNLARINCAHDDETVWKQMIDNVHTVAEEVGREIRVSMDLAGPKVRTGEIAPGAEVGRARVTRDETGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKTSTADGHNDVELEVTHARPQGVNLAAYKGINLPDSELPLPSLTEEDLQHLRFVVKYADIAAISFIRNVADVEYLLQALADIGDPVAVERLGLVLKIETIPGYEGLAQILLTGMRHENFGIMIARGDLAVELGFDRMAEVPQLIMALAEAAHVPTILATQVLENMAKNGLPSRAEITDAAMALRAECVMLNKGPHINDAIKVLTEMSRKLGASQRKSRLLLRKVKSWEE

SEQ ID NO: 3729 - protein, 323 aa, Triticum aestivum
MMAATNGLVHASAHKPLFTFGVIADVQYADIPDGRSFTGIPRYYRHSIDVLQRAVSAWNKQGAVKFSINFGDIVDGKCPKDKSLWAVQKVLGEFEKFPGPTYHMFGNHCLYNLPRSELVALLKMPTGSDRAYYDFSPCPEYRFVVLDAYDFSTLGWPRDHPVTAAATRLLEEKNPNADKNSPEGLVGVDQRFVMFNGAVGEEQLSWLSDVLRDASERRQNVVLCSHLPLDPVAASQVGLMWNYDEVMAVVRQYNCVKACFAGHDHKGGYSVDSHGVHHRTLEAALECPPGTSAFGHIEAYPDKLLLVGSDGMADTEMCFESSQ

SEQ ID NO: 3730 - protein, 507 aa, Mycobacterium sp. MCS
MTGLPHYRMYVDGEWRDAAESIEVRSPATGAPVATVAYGDLTAVDDAVAAARAAHEAGVWRSMPPQQRADLLDAIADKLAARSDELTALQVRENGATVRGAGAFLIGYAIANLRYFASLARSYAFQTSGPLIEAPTLASGLILREPVGVCAGIIPWNFPLLLAVWKLGPALAAGNTVVLKPDDQTPLTLLELARAADEVGLPAGVLNVVTGPGPVAGARLAEHPDVRKIAFTGSTEVGKGVMRAAADNVKKVTLELGGKGANIVLEDADLDLAVDGSLFAFLMMSGQACESGTRLLVHESVHDEFVRRLVARAETLVMGDPMSPATDLGPLVSAKQKARVEKYIALGQEEGCRMAFQGTVPSDPALAEGHWVPPVILTGATNQMRIAREEIFGPVLVVIPFRDDDDAVAIANDSEYGLSAGVWSADNGRALGIARRLESGTVWVNDWHMVNAMYPFGGVKQSGLGRELGPDALDEYTEPKFVHIDLTNDRRKRAFAVVVSAAAAESD

SEQ ID NO: 3731 - protein, 368 aa, Mycobacterium sp. MCS
MKTKAAVLWGLHQKWEVTELDLDAPKAQEVLVKLTASGLCHSDDHLVTGDMPMNLPVVGGHEGAGVVAEVGPGVTEVEVGDHVVLSFIPACGRCTECARGRSNLCVYGAAIVAGPQLDGTYRFHSGGQDVGQMCVLGTFSEYTVVPIASVVKVDKDIPLDKAALVGCGVTTGYGAAVRTGEARDGDTVVVMGVGGLGINAVQGARLAGARYVVALDPVAYKRERSFEFGATHAAATVEEAQALITDLTRGTMADVCVVTTDSAEGAYVAQGLSLVGKRGRVVMTAIPHPTDTTVDMSLFDLTLYEKQVRGCLFGSSNPRLDIPRMLELFGSGRLMLDELITREYTLDEINQGYEDMHDGRNLRGLIRF

SEQ ID NO: 3732 - protein, 109 aa, Triticum aestivum
FLARKLSLTRAVFYMVMQCLGAICGAGVVKGFQTTLPIGFAVFLVHLATIPITGTGINPARSLGAAIIYNKKQSWDDHWIFWVGPFTGAALAAIYHVVVIRAIPFKSRG

SEQ ID NO: 3733 - protein, 182 aa, Triticum aestivum
  misc_feature (51)..(51): Xaa can be any naturally occurring amino acid
  misc_feature (61)..(61): Xaa can be any naturally occurring amino acid
  misc_feature (79)..(79): Xaa can be any naturally occurring amino acid
  misc_feature (99)..(99): Xaa can be any naturally occurring amino acid
MAPTVMASSATSVAPFQGLKSTAGLPVSRRSNGASLGSVSNGGRIRCMQVXWPSKGIKKFXTLSYLPPFTTEALLLQAXYLIRFKWVPCLESSKAGVIXFREHNAVSRGTYDGPLLAQWWERLPYGWEWPPNAHIGWNQTGGGDGRFHERDVSPLNMRYVSREIYSAHVPIQTLGESNGRVH

SEQ ID NO: 3734 - protein, 436 aa, Mannheimia succiniciproducens MBEL55E
MGYIFMNLNSYKVGVIGLGYVGLPLAVEFGKHRFTVGFDISPNRVKELSEGKDRTLEVSSEALKSVTHLSFTSDLEQLKQCNFFIVTVPTPIDDVNRPDLTPLQKASESIGKVLKQGDIVVYESTVYPGATEEVCIPVLEKVSGLKFNQDFFAGYSPERINPGDKVNTLTKIKKITSGSTPEVADIVDQMYASIIEAGTHKASSIKVAEAAKVIENTQRDLNIALVNELSIIFERVGIDTLDVLEAAGSKWNFLPFRPGLVGGHCIGVDPYYLTHKAEEVGYNPQVILAGRRINDNMSQYVAQETIKLMLNNNIDVAHAKVGILGVTFKENCPDIRNSKVVDVVTELKNWGVEVVVADPWADAQEVKHEYGLDLSSVDENNPVDALIVAVGHKEFRDLSAETLRSYLRTSKPVLADVKSLFDRDALAQQGITVFRL

SEQ ID NO: 3735 - protein, 557 aa, Candida albicans SC5314
MLSRVILKNKSSITKNMTNIAASKLATRNKSIISLSSTTTEYPKGHTTANDEPYLTPSFVNNEFIKSESDTWFDIHDPATNNVVSKVPQSTPEELEDAIASAHKAFPKWRDTSIIKRQGIAFKFVQLLRENMDRIASVIVLEQGKTFADAQGDVLRGLQVAEAACNVTNDLKGESLEVATDMETKMIREPLGVIGSICPFNFPAMVPLWSLPLVLVTGNTAVVKPSERVPGAAMIICELAAKAGVPAGVLNIVHGKHDTVNKLIDDPRIKALTFVGGDKAGKYIYERGSQLGKRVQANLGAKNHLVVLPDANKQSFVNAVNGAAFGAAGQRCMAISVLVTVGKTTKEWVKDVVADAKLLKTGSGFDPKSDLGPVINPESLTRAEEIIEDSVQNGAVLELDGRGYKPTNDPEQKFTKGNFLAPTILTNVKPGMRAYDEEIFAPVLAVVNVDTIDEAIELINSNKYGNGVSLFTNSGGSAQYFTKRIDVGQVGINVPIPVPLPMFSFTGSRGSFLGDLNFYGKAGITFLTKPKTITSAWKLNSVDEEILKPSTSMPIQQ

SEQ ID NO: 3736 - protein, 375 aa, Solanum lycopersicum
TRLIAKGQEPVQKNKTKPLVTKGVAARKVGVPAKAEAIKKDYVKAKAGTISGICPEEDVKTIEKIPLKERKVRKSGKTLTSILTARSKAACGLSNKPRSQIVDIDAADIDNHLAGVEYVEDIYKFYKLTEDENRPCDYMDSQPEINDRVRAILVDWLIEAHKRFELRPESLYLTVNIMDRFLSEEPVPRRELQLLCISSMLIASKYEEIWAPEVNDFLTITDNAYVRDQILLMEKVILGKLEWYLTVPTPYVFLVRYIKAAVPSDQEMENMTFFLAELGLMNYTTVISYCPSKIAASAGYAARSTLNRSPRWTDTLKHHTGYTEDQLRECAKQLVSFHFGAAENKLKAVYRKFSSPDRCAVALLPPARDVHIGSS

SEQ ID NO: 3737 - protein, 457 aa, Oceanobacillus iheyensis HTE831
MHILKVGFNYKTTPVDIREKFTFSEDSLQDAMVELKNQKSILEDVIISTCNRTEIYAVVDQLHTGRYYIKQFLSNWFGIEKEEFSTYLRITEDDGAMEHLFRVSTGLDSMVLGETQILGQVKQAFLNSQQVNTTGTIFNELFKQAITFGKRAHKETAIGEHAVSISYAAVELAKKIFGDLQEKHVAILGAGKMGELAAKNIQGSGATKITVVNRTLENANEMAEKFNADVESIDQLPVILQQADILISSTGADSIVVTKEMMEKVQKQRKGRALFLVDIAVPRDMDPAISELENVFLYDIDNLQHIVDDNLESRKQAAEKIELLIEEEIVTFKEWLKTLGVIPVISALRQKALTIQAETMQSIERKIPNLTDRERKVLNKHTKSIINQLLKEPVTQAKEFAGKDNAEDSLQLFINIFGIEEEVKEELVKHAKKNETLMKIAKEEPSSFPIIEKITTA

SEQ ID NO: 3738 - protein, 434 aa, Solanum lycopersicum
MAITDENKHPLIKESSVRVKDRAEMATRKVVGVETRSNRRVLGAINQNLVGGQGYPCVVNKRGLSDGNGFCDKNLPVHGHRPITRKYAAQIASSQKHSSEENKKPKIAAESFSVWEDDMEAANDKPVPMSLEQTEKVSKGKDQMTYIQEVEMEDIFEEAVIDIDGDDAKNHLAAVEYVGDLFANYRTMEVNSCASPYYMAQQADINERMRSILIDWLIEVHHKFELREETLFLTVNLIDRFLEKQGIVRKKLQLVGLVAMLLACKYEEVCAPLVEDLVLISDKAYTRKEVLEMESMMLNTLQFNMSVPTAYVFMRRYLKAAQCDRKLELLSFMLVELCLVEYEMLKFPPSFIAAAAIYTAQTTLYGVQQWSKTCEVHTTYSEDQLLECSRSIVGYHQKAATGKLTGVHRKYSISKFGYAAKCEPAHFLVQQTQE

SEQ ID NO: 3739 - protein, 164 aa, Pleurotus sp. 'Florida'
RPLANVYFDITINNQPAGRIVFKLFDDVVPKTARNFRELATGQNGFGYAGSGFHRVIPQFMLQGGDFTKGNGTGGKSIYGEKFADENFQLKHTKPGLLSMANAGKNTNGSQFFITTVVTSWLDGAHVVFGEVVEGFDIVKKIEGYGSQSGKPSATIKISASGTV

SEQ ID NO: 3740 - protein, 206 aa, Fulvimarina pelagi HTCC2506
MSGTLVLVRHGQSEWNKQNLFTGWKDPDLTELGVEEAKAGGRRLKAAGYTFDLGFTSKLSRAQRTMKLILEEIGQTDLDVTENLALNERDYGDLAGLNKDDAREKWGKEQVHQWRRSYDVPPPNGESLKDTGARVWPYYLHDIQPSVLRGNTVIVSAHGNSLRALVMAIEGMTPEEILKYEIATGVPIVYKLNADSTVAEKTVLQA

SEQ ID NO: 3741 - protein, 426 aa, Treponema denticola ATCC 35405
MENKGKLGLLSICLLGVNAIVGTGIFLLPGKAAKLVGVSSIGVILFDAVLVILIALCFAEAGGLFKKNGGPYVYAKEAFGEFVGFEVGFMKWAIMVIAWAAMAVGFPTALGSVFPLAATPFWRSVIAVAILLFLGLMNIAGVRISKIVNNVITIGKLVPLIFFILLGIFFIKGDNFQPMQSVGALTTTSFGAAALLIFYAFTGFESIAVAAEDMDKPEKNVPLAIVLVISGVSVFYILIQVVAIGILGDGLTASEAPVADAAAKFLGPVAKAVVTTGTLVSIGGINVASSFLAPRSAVALADDGFLPKFVTKRNKKDVPYISVILTTALTALVCLTGSFSKLAAISVVSRFAQYIPTCLAILVFRKRGMKGSFRIPGVYVVSFLAVGISLWLLYNSSWDKILFGLGGLVVGAVFYVIMKLTQKKAN

SEQ ID NO: 3742 - protein, 458 aa, Geobacillus kaustophilus HTA426
MKVAKFGGSSVASAAQFRKVADIVSSDIERRIVVVSAPGKRYKDDVKVTDMLIQLAEQVVAGEPHEETMEAIVKRYADIANELGLEADGFLAELVDDLQSKISAYRSEPPRLFDAIKASGEDHNARLMALYLQDCGLEASYVSPLEAGIIVTDEPGNAQVLPESYDKLKQLRERRGVLVIPGFFGYSRSGHIVTFPRGGSDITGSIVAAGVKADVYENFTDVDSIYCVNPSIVADARKLKEITYREMRELSYSGFSVFHDEALEPVYRAGIPVCVKNTNNPAAPGTWIVAKRNHIDEPVAGIASDTGFCSINISKYLMNREIGFGRRVLQILEDEGISYEHTPSGIDNMSVILRADQLADGKDERILARIREELAVDEVTIEYGLALIMVVGEGMEKTIGMAAKATTALANANINLEMINQGSSEVSMMFGVKEEVVNEAVRALYNAYFQQATVNHLS

SEQ ID NO: 3743 - protein, 478 aa, Aquifex pyrophilus
MAEVIKGRIVQVIGPVVDVEFEGVKELPRIKDGLKTIRRAIDDRGNWFEEVLFMEVAQHIGEHRVRAIAMGPTDGLVRGQEVEYLGGPIKIPVGKEVLGRIFNVAGQPIDEQGPVEAKEYWPMFRNPPELVEQSTKVEILETGIKVIDLLQPIIKGGKVGLFGGAGVGKTVLMQELIHNIARFHEGYSVVVGVGERTREGNDLWLEMKESGVLPYTVMVYGQMNEPPGVRFRVAHTGLTMAEYFRDVEGQDVLIFIDNIFRFVQAGSEVSTLLGRLPSAVGYQPTLNTDVGEVQERITSTKKGSITAIQAVYVPADDITDPAPWSIFAHLDATTVLTRRLAELGIYPAIDPLESTSKYLAPEYVGEEHYEVAMEVKRILQRYKELQEIIAILGMEELSEEDKAIVNRARRIQKFLSQPFHVAEQFTGMPGKYVKLEDTIRSFKEVLTGKYDHLPENAFYMVGTIEDAIEKAKQMGAKV

SEQ ID NO: 3744 - protein, 103 aa, Brassica napus
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (74)..(74): Xaa can be any naturally occurring amino acid
MASSMLSSAAVXTSXPAQVTMXAPFTGLXKTSAXFPVTXKANNDITSIXSNGGXVSCXKVXPPVGKKKXETPPXPPLTTRSLNCVEAHYLPLIFAISATPLSR

SEQ ID NO: 3745 - protein, 472 aa, Fervidobacterium islandicum
MSKKSVGKIVRIIGPVVDVKFQEGDLPDIYDALVVINPQTGKKLILEVEQLIGDNIVRTVAMDSTDGLVRGLEVENTGEPIKAPVGRGVLGRMFNVIGEPIDEQGELKDIEYWPIHRPAPSMTEQKTEIEILETGLKVIDLLAPFPKGGKIGFFGGAGVGKTVLVMEMIRNIAIEHHGFSIFAGVGERTREGNDLYLEMTEAGVLNNTVLVFGQMNEPPGARFRVALTALTIAEYFRDVEGRDVLLFIDNIFRFVQAGSEVSALLGRMPSAVGYQPTLSTDMGELQERITSTKKGSITSVQAIYVPADDITDPAPATTFTHLDATIVLSRQLAALGLYPAVDPLDSTSKILDPNIVGKEHYEVARGVQEVLQRYKDLQDIIAILGMEELSEEDKLIVQRARKIQRFLTQPTHVAERFSGIPGVYVPIKETIRGFKEILEGRYDDLPEAAFYMVGTIDEAVEKAKKLMKSAVI

SEQ ID NO: 3746 - protein, 510 aa, Vibrio fischeri ES114
MSNSSYQTGAEYLRQILRAPIYEVATVTPLQDMPRLSERINNRVQLKREDRQPVHSFKLRGAYNMVANLTQEQKNAGVIAASAGNHAQGMALSGTKLGIQTTIVMPKTTPDIKVEAVKGFGGNVVLHGSNFDEAKAEAERLSQLHGYTFVPPFDHPLVIAGQGTIGMEMLQQNGHLDYIFVPVGGGGLAAGIAVLIKQLMPEIKVIAVEPEDSSCLKAALDAGEPVILDQVSMFADGVAVKRIGDETFRLCQKYLDGHISVSSDEICAAVKDIFEDTRAIAEPSGALALAGLKKFADQHQLENKQLGTVLSGANTNFHGLRYVSERCELGEKREGLLAVTIPERQGAFFEFCNLIGGRAVTEFNYRYNDDKLANIFVGVRLQEGQEELDNIINDLQKGEYPVVDLSDDEMAKLHIRYMIGGKPSKTIQERLYSFEFPEYPGALVRFLSTLGTHWNISLFNYRNHGADYGRVLCGFELTDSDLASFSKHLEELGYQWKDETDNLAYRFFLS

SEQ ID NO: 3747 - protein, 820 aa, Oryza sativa
MSPLHTHLGFFLLLLLFSLHNPSCSAAANDTLAVGQVLAVGEKLVSRNGKFALGFYKPALPEGIASKYGNITSPGWYLAIWFNKIPVCTTVWVANRERPITDLEIKLTQLKFSQNGSSLAIIINRATEYTVWSRQIANRTAQAKTSMNTSAILLDSGNLVIESIPDVYLWQSFDEPTDLALPGAKFGWNKVTRLHRTGISKKNLIDPGLGPYSVQLNERGIILWRRDPYMEYWTWSSVQLTNMLIPLLNSLLEMNAQTKGFLTPNYTNNNEEEYFMYHSSDESSSSFVSIDMSGQLKLSIWSQANQSWQEVYAQPPDPCTPFATCGPFSVCNGNSDLFCDCMESFSQKSPQDWELKDRTAGCFRNTPLDCPSNKSSTDMFHTITRVALPANPEKIEDATTQSKCAESCLSNCSCNAYAYKDSTCFVWHSELLNVKLHDSIESLSEDTLYLRLAAKDMPATTKNKQKPVVVAVTAASIAGFGLLMLMLFFLIWRNKFKCCGVTLHHNQGNSGIIAFRYTDLSHATKNFSEKLGSGGFGSVFKGVLRDSTTIAVKRLDGSHQGEKQFRAEVSSLGLIQHINLVKLIGFCCEGDKRLLVYEHMVNGSLDAHLFHSNGAVLDWNTRHQIAIGVARGLSYLHESCRECIIHCDIKPENILLEASFAPKIADFGMAAFVGRDFSRVLTTFRGTKGYLAPEWLSGVAITPKVDVYSFGMVLLEIISGRRNLSEAYTSNHYHFDYFPVQAISKLHEGSVQNLLDPELHGDFNLEEAERVCKVACWCIQEDEIDRPTMGEVVRFLEGLQEVDMPPMPRLLAAITERSHI

SEQ ID NO: 3748 - protein, 535 aa, Bordetella petrii
MPTIESRINPRSQDYADNARAMQAQLDDLARQLAQTALGGSESARAKHVARGKLLPRDRVERLIDPGSPFLELSPMAAHGMYDGAAPGAGVITGIGRISGTECVIVCNDATVKGGTYYPMTVKKHLRAQEIAAQNRLPCVYLVDSGGANLPQQDEVFPDRDHFGRIFYNQAVMSAQGIAQIAVVMGSCTAGGAYVPAMSDESIIVRNQGTIFLGGPPLVKAATGEEVSAEDLGGGDVHTRLSGVADHLAANDLHALQLARNAVARLNLRKPAQLALAPVREPRYDPAELNGIIPADTRKPYDVREIIARIVDGSDFDEFKARFGTTLVTGFAHIHGMPVGIVANNGILFSESAQKGAHFIELCAQRKIPLVFLQNITGFMVGRKYENEGIARHGAKMVTAVATANVPKFTVLIGGSFGAGNYGMCGRAYSPRLLFMWPNARISVMGGEQAASVLATVRRDGIQAKGGQWSAEEEEAFKAPIRAQYEHEGHPYYATARLWDDGIIVPADTRRVLGLALSAALNAPIEDTRFGVFRM

SEQ ID NO: 3749 - protein, 149 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 3750 - protein, 257 aa, Pisum sativum
VSEYIDDIYHYYWVTEAHSQALSNYMSIQTEITPHMRGVLVNWLIEVHFKLDLMPETLYLTVTLLDQYLSQVTVKRSDMQLVGLTALLLASKYEDFWHPRVKDLISISAETYTRDQMLGMEKLILRKLKFRLNAPTPYVFMVRFIKAAQSNMKLEHMAFFLIDLCLVEYETLAFKPSLLCASTLYLARCTLQITPSWTPLLQKHARYDVSQIRDCADMMLKFHKAAGKGKLTVAYEKYSRKELSAVAGVKPLDRLPH

SEQ ID NO: 3751 - protein, 261 aa, Oryza sativa
  misc_feature (80)..(80): Xaa can be any naturally occurring amino acid
  misc_feature (232)..(232): Xaa can be any naturally occurring amino acid
  misc_feature (252)..(252): Xaa can be any naturally occurring amino acid
INIITQMFISNLARNVMLTRQLTRNFSVQGEASFLEMVSQYFDRAGTAAGIPKDRLNFLKSPDYSLKFNIPFRTDAGLIXVVEAYRVQHKTHRLPTKGGTRYASSINLQEVEALASLMTIKNTIAGLPYGGAKGGIKIDPRSLSKGEIERVTRNYTTALCKKSSLGPAIDVPGPDIGTGEREMTLIKDQYHHLYGTRDINYAGVTTGKSVSHHGIRGREEATGLGVFYSTKXILNNDEQLAKMGVTKGLKDXRFIVQGFSY

SEQ ID NO: 3752 - protein, 174 aa, Triticum aestivum
  misc_feature (109)..(109): Xaa can be any naturally occurring amino acid
QWGILCVGLVVFSSSIYRAADLYMGFDDADAGGDEVEARGAEAYNCPFCGEDFDFVGLCCHIDDEHAVEAKSGVCPICATRVGVDLIGHLTMQHGSYFKMQRRRRVRKXPVAEPSKDFRSDSSDKTFLLNKFPDEKVVERAETSLSEKDQKERAQRSAFARGLVLSTIFDDDTM

SEQ ID NO: 3753 - protein, 405 aa, Yersinia pseudotuberculosis IP 32953
MTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGRTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHHGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 3754 - protein, 333 aa, Streptomyces hygroscopicus
MSAALTDGTVQGQQQCDTRLVGLYEADEAGSDLTLALSLAHGRAEAAARGIPLHTHLWQLYGGRTAPGLPRLMVNVFSGGIHRTGPPRGFQQVMVLPATGGLHTDIEVADRVFTAAHRNVERRFGPVPLSASSGLMVPLDSAGQLDLLQAAVAETGHTEVCTLGVDVAAEHLLTEPGRYRFGDRVLTAPDFADHLADLAHRFRMSFLEDPFDAADEAGWARLRGALPATTSVVGDDLFATDATRIEPGRADGILLKLSQAGTVTATLAAAAAARRAGMLLSVSHRSGETEDTAMCDLAVAVGAELIKVGGPRRGDRLAKYNQLLRLDESVAAP

SEQ ID NO: 3755 - protein, 224 aa, Zea mays
  misc_feature (212)..(212): Xaa can be any naturally occurring amino acid
MGKSSKKSSVKAAPAAVSVPEVKSAKKGKRNAEDEIEKAVSAKKQKTVPEKAVPVKKQPPPKKVESSSSEEDSSDSEVEVKVQPKKVIQPKKGTQPAKQESSDDSSSESSSDDEPSKKPVAGSKKPPASSSSSDDSSDSDDSSSDEEPAKKPTVLSKKPTVLSKKPVTAVSNGSKQVKPDSSSSDSSSDEDEKPAASLKKAVVASVQRRPKXSDSSDSDSDEDE

SEQ ID NO: 3756 - protein, 464 aa, Saccharomyces cerevisiae
NTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDEIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVGAGPNEKVVGLHIVGDSSAEILQGFGVAIKMGATKADFDNCVAIHPTSAEELVTMR

SEQ ID NO: 3757 - protein, 539 aa, Synechococcus sp. WH 5701
MSGIRRQGRPASPGMAWGPIWRWPEPERHAAADGPPQGAAELRAAIARGRAELASEVAGLEGEAAEILAVQLALLEDDTLAAQAFAALTGPAAPPAEVAWRAALEVEIAGYQASEDATFRARAADLIDLRDRVLRCLLAPGHSVTPARQPGSVLVAPDLTPSRFLAIDWSGGGAVVLEQGSAAAHVALLARGRGVPMVVAVGAVPAEATQVLVEGDSGWVTFDPDPARAAALSAARGGSSTPAHPGGAPGPAFTAGGERVEVLLNVSDPAELEGLDPELCDGIGLVRSEFLLQVTARQEPAAATGPAGLPDEASQQRAYEALLAWSGGRPVTVRTLDLGGDKPLPGITAAEAEPALGLRGLRLTLGRPELLRPQLRALARAAVAGDLRVLLPMVTVPQEFVAAAALLEEVVAELGAAGLPCRRPPLGMMVEVPAAALTSEMFPADFYAIGSNDLAQYTLAASRSDEAFETLRRDGWPAVELLIARTLESAGRKGVPVCLCGEAAADPARLEGLLRLGLRAVSVPAKAVAAVKRTIAAAP

SEQ ID NO: 3758 - protein, 195 aa, Oceanobacillus iheyensis HTE831
MKVNHAEIVISAVSKKQYPEDQLPEIALAGRSNVGKSSFINRLINRKNLARTSSKPGKTQTLNFYRINESFYFVDVPGYGYAKVSKKEREKWGRMMEEYFQTRDTLRAVVLVTDLRHDPTQDDIQMYDFIKYFDLPVIIIGTKLDKITKNKRQKHINRAKQVLEMDETDLFIPFSAEIGEGKDEAWSALSRYIKR

SEQ ID NO: 3759 - protein, 575 aa, Mannheimia succiniciproducens MBEL55E
MISGIPASPGIVFGKALVLKEEKIVLDMQKIAEDQVETEVARFYEGRTAAVEQLSAIRDRAEKTLGEEKAAIFEGHLMILEDEELEEEIIDYLRSNKVNAGVAASKIIDQQVAMLADIDDEYLKERAGDIRDIGNRLIKNILGMKIVDLGEINEESILVAYDLTPSETAQLNLDKVLGFITDIGGRTSHTSIMARSLELPAIVGTNNATAMINSGDYLVLDAINNAVYVNPAQDVIDGLKAQQAKLAEEKAELAKLKDLPAVTLDGHRVEVVANIGTIRDCEGADRNGAEGVGLYRTEFLFMDRDQLPSEEEQFIAYKEVVEAMNGRQVVLRTMDIGGDKELPYMNLPKEMNPFLGWRAVRIALDRREILNAQLRAVLRASAFGKLAVMFPMIISVEEIRELKSVIETLKQELRTEGKAFDENIQIGVMCETPSAAVNAKFLAKEVDFFSIGTNDLTQYTLAVDRGNEMISHLYNPMSPSVLSLIKQVIDASHTEGKWTGMCGELAGDEKATILLLGMGLDEFSMSAISVPRIKKLVRSVNFAEAKALADKALQLPTAAEIEKLVADFLAEKTLN

SEQ ID NO: 3760 - protein, 406 aa, Candida albicans SC5314
MITYHKTSRVNVTRKNKKSYQIPTSHSTHSLTHFTNTPRRLLILFLYLSNILVVFFFFNFSFHYYYYLLKLLDFFMSPSQTQIEKSQLAAPEPEHCPGPESELAGQGDACKGCANQEICSSQTVKGPDPDLPIITERLSAIDHKILVLSGKGGVGKSTFTSMLAWAIAADEEIEVGAMDLDICGPSLPRMLGAEGESVHQSNSGWSPVYVADNLGLMSISFMLPDPDSAIIWRGAKKNGLIKQFLKDVNWGEKLDYLVVDTPPGTSDEHLSVTTYMKEVGIDGALIVTTPQEVALLDVRKEIDFCRKANIKILGLVENMSGFVCPNCKGESQIFKATTGGGKKLCEELGIPFLGSVPLDPRIGKACDMGECFFDSYPDSPAATAILDVVDALRDQVELSLENLAIK

SEQ ID NO: 3761 - protein, 440 aa, Oceanobacillus iheyensis HTE831
MKKTNNTTNTPYVNSKVGVIGMGYVGLPLALLFLKKGYQVTGIDINQSKISQLQNGKSYIPDIKDNELQDALKTDSIIFTSNYDVISQLDIIVICVPTPLTKEQIPDLSYIKNVSEEIYPRLQINQLVILESSTYPGTTRDILLPILEKSDLQIGSEFYLGYSPERIDPGNNTLKVEEIPKVVGGISEGCLQHITDFYQNVFDEIIPTSSVEIAELCKLVENSYRFINVSFINELAMLCDQLNINLWEAIDAASSKPYGFQPFYPGPGIGGHCIPIDPLYLSWIGQQHGFNNQFLALAEQKNKDISQYVINQINNIVHAEKPINEANILICGVSYKKDSNDVRTSPPLDIMKTLVKSYKSLVYFDPAVPTVEINQQTYHSTEITPQLLKKMDIVVILVDHSAIPVQDILNHAKIVYDTKNVTAGLTGSAKLFLLGNGNIS

SEQ ID NO: 3762 - protein, 327 aa, Clostridium perfringens SM101
MKKIAVIFNGGTISMKVDDRIKAAVPSLTGEEIMAMVTGIESFATIESHSFSSLPSPHITPEIMLELSKFINSLVEREDIDGVVVTHGTDTLEETSYFVNLTTKTSKPIVFTGAMRSGSELGYDGPSNLAASICTAASDEAKNRGVLVCFNGELNSASEVTKANSMALNAFRTPNFGPIGIVDNNRVIFDRRVPQEDFIPLEVIDKKVAIIKCAAGMDGDFIYHCIEKKYDGIIIEALGRGNVPPTMVDAIKDALDNGIVIVLTSRCFEGRVSDSYGYLGGGKNLKELGVIFGESMPSQKARIKLLTLLGFNKDYRYIKHSFEKERY

SEQ ID NO: 3763 - protein, 467 aa, Vibrio fischeri ES114
MTTGKIVQIIGAVVDVEFPQGEVPRVYDALNVVDAQERLVLEVQQQIGGGVVRCIVMGSSDGLRRGLTVENTGAPISVPVGTKTLGRIMNVLGDAIDECGDIDAEEHYAIHREAPSYEEQSNSTELLETGVKVIDLVCPFAKGGKIGLFGGAGVGKTVNMMELINNIALQHSGLSVFAGVGERTREGNDFYFEMQEAGVVNIEKPEESKVAMVYGQMNEPPGNRLRVALTGLTMAERFRDEGRDVLLFVDNIYRYTLAGTEVSALLGRMPSAVGYQPTLAEEMGVLQERITSTKQGSITSVQAVYVPADDLTDPSPATTFAHLDATVVLNRNIAAMGLYPAIDPLDSTSRQLDPLVVGQEHYDIARGVQSTLQRYKELKDIIAILGMDELSEEDKQVVSRARKIEKFLTQPYHVAEVFTGDPGIYVPLKDTLAGFKGLLAGDYDDVPEQAFMYCGKIEDALEKAKKL

SEQ ID NO: 3764 - protein, 361 aa, Magnaporthe grisea 70-15
MASATEGKSNLSFVLNKPHDVCFEERPMPKLASEHDVLVAVNYTGICGSDVHYWHHGSIGDFVVKDPMVLGHESAGTVVEVGSAVKTLQVGDRVALEPGYPCRRCRDCLAGRYNLCPEMRFAATPPYDGTLAGFWTAPADFCYKLPESVSLQEGAMIEPLAVGVHIVRQAKVSPGQSVVVMGAGPVGLLCAAVARAFGATTVVSVDIVESKLEVAKQIAATHTYLSQRISPQDNAKALIAAAGLEDNGGADVVIDATGAEPSIQTSIHAVRVGGSYVQGGMGKPDITFPILAFCCKEVTASGSFRYSAGDYRLAIDLVANGKVNLKALITETVPFDKAQEAFTKVSEGQVIKVLIAGPNEK

SEQ ID NO: 3765 - protein, 335 aa, Fulvimarina pelagi HTCC2506
MTMGLLVDGQWQDKWYDTDSTGGKFERPTTDFRGWITPDGSPGPDGQEAQEAEADRYHLYVSLACPWAHRVLITRKLKGLEDVISLSVVGYHMGERGWEFSERDGAIPDTVNGKDKLYEVYLEADPNYTGRVTVPVLWDKKRATIVNNESAELIRILNTGFSEFADNTVDLTPPSLLPAIDEINATVYDNVNNGVYKTGFATSQEAYEEAFDELFETLEMLESRLSSQRYLAGSYLPTEADWRLFTTLIRFDAVYHGHFKCNAKQIADYPNLFGYMLELFQWPGIAETVNFDHIKGHYYTSHSTINPTRIVPKGPRQDLTVPHNRDRLVPAEEAA

SEQ ID NO: 3766 - protein, 164 aa, Zea mays
HKTHPSSLALLATPVLLTATASRSSCSVSQTLLLCCCTCKSATAHKEEMSTTVSRASLDQKLALAKRCSREATLAGAKAAAVATIASAIPTLASVRMLPWAKANINPTGQALIVSTVAGMAYFIAADKKILSLARRHSFDQAPDHLKNTSFQGTGRPHPAFFRP

SEQ ID NO: 3767 - protein, 358 aa, Arabidopsis thaliana
MSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGGRFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYRY

SEQ ID NO: 3768 - protein, 876 aa, Arabidopsis thaliana
MKTHPQAILLCVLFFITFGLLHVVEAGNQEGFISLDCGLSPNEPPYVDAATDLTYTTDNDFVQSGKTGTIDKELESTYNKPILQLRYFPEGVRNCYTLNVTLGTNYLIRASFVYGNYDGLNKELEFDLYLGPNLWANVNTAVYLMNGVTTEEIIHSTKSKVLQVCLIKTGESIPIINSLELRPLINDTYNTQSGSLKYLFRNYFSTSRRIIRYPNDVNDRHWYPFFDEDAWTELTTNLNVNSSNGYDPPKFVMASASTPISKNAPFNFTWSLIPSTAKFYSYMHFADIQTLQANETREFDMMLNGNLALERYRPKTFATGTIYFIKPQICEGGQCIIELLKTSKSTLPPLCSALEVFTVIDFPELETNQDDVIAIKNIQNTYGVSKTSWQGDPCVPKRFMWDGLNCNNSYISTPPTITFLNLSSSHLTGIIASAIQNLTHLQNLDLSNNNLTGGVPEFLAGLKSLLVINLSGNNLSGSVPQTLLQKKGLKLNKDGNGGAKKKNVVVLVVVSIALVVVLGSALALFLVFRKRKTPRNEVSRTSRSLDPTITTKNRRFTYSEVVKMTNNFEKILGKGGFGMVYHGTVNDAEQVAVKMLSPSSSQGYKEFKAEVELLLRVHHKNLVGLVGYCDEGENLSLIYEYMAKGDLKEHMLGNQGVSILDWKTRLKIVAESAQGLEYLHNGCKPPMVHRDVKTTNILLDEHFQAKLADFGLSRSFPLEGETRVDTVVAGTPGYLDPEYYRTNWLNEKSDVYSFGIVLLEIITNQHVINQSREKPHIAEWVGVMLTKGDIKSIIDPKFSGDYDAGSVWRAVELAMSCVNPSSTGRPTMSQVVIELNECLASENSRRGMSQNMESKGSIQYTEVSTNFGTEYTPEAR

SEQ ID NO: 3769 - protein, 135 aa, Triticum aestivum
  misc_feature (5)..(5): Xaa can be any naturally occurring amino acid
  misc_feature (10)..(10): Xaa can be any naturally occurring amino acid
  misc_feature (19)..(19): Xaa can be any naturally occurring amino acid
  misc_feature (25)..(25): Xaa can be any naturally occurring amino acid
  misc_feature (44)..(44): Xaa can be any naturally occurring amino acid
  misc_feature (59)..(59): Xaa can be any naturally occurring amino acid
YAGWXLVNGXIDHATVSSXRLESVXRSISKFNKFVEDNGFKLNXEGGILKVSPDGLLQXQSSTVADSSLFTFADGITESIPRSYIEFAERLPLPQFRDLQYEEVKEHHRRDGFEVGNADKIFESTSKDQLTRRSA

SEQ ID NO: 3770 - protein, 257 aa, Epichloe typhina
MAAIRRNRRLVGLSTKMYFSLSRNRQVTEGFLEHLGKLAPSSLAHVDIFIIPDFVSLAETAERVKTCPVPVWLGAQDCHWEDSGAFTGEVSPAVLSEVGVRIVEVGHAERRRLFGEDDAVVAKKAAAVSRNAMVPLVCIGEQTRGDVALAVGECRAQVEAVLAGVSPAAEVALAYEPVWAIGASEPAGEEHVLGVVEGIRQLGCVTSREGVTRIVYGGSAGPGLYARLKSGLDGLFLGRFGHDPERFVKTIREVAEA

SEQ ID NO: 3771 - protein, 92 aa, Oryza sativa Japonica Group
MASMAKSLLCISLVAILLLVETTAPHGQAYAIDCGAKCGYRCSKSGRPKMCLRACGTCCQRCGCVPPGTSGNENVCPCYANMTTHNGRHKCP

SEQ ID NO: 3772 - protein, 272 aa, Magnetospirillum magnetotacticum MS-1
MHALVTGSAGFIGHALSQRLLAAGHTVTGFDGFSPYYDVALKRARHGQLAHHPGFEEIEGRLETPGALLDVMARTKPDLVFHLAAQAGVRYSLIEPGAYVEANLVGFANLLEAVRAHPVRHLLVASTSSAYGGNASVPFRETDRAVSPLTLYAASKLANEAMAHSYAHLFRVPTTAFRFFTVYGPWGRPDMALFLFTAKILAGEPIEVFGEGAAERDFTYIDDLVDAILALSERPPPLPSEGGPVSAADTLSPVAPYRSSISAADVRCGSMR

SEQ ID NO: 3773 - protein, 411 aa, Streptomyces coelicolor A3(2)
MHSAVLLIEFGSIILGLGLLGRFAGRYRLSPIPLYLLAGLAFGEGGLLPLGASEEFVATGAEIGVILLLLMLGLEYTASDLVTNLKSHYPAGLVDCALNAVPGAVAALLMGWGPVAAVVLAGVTWISSSGVIAKVLGDLGRVGNRETPVILSVLVLEDLAMAVYLPIVTALVAGAGLMTGSITLAVALAAAGLVLFVAVRYGRLISRFVSSDDPEKLLLVVLGLTILVAGVAQQLQVSAAVGAFLVGIALSGEVAEGAHTLLSPLRDLFAAVFFVFFGLHTDPASIPPVLLPALALALLTAVTKIATGYWAARRAGISVKGRWRAGGALVARGEFSIVIAGLAVSAGIEPSLGPLATAYVLILVVLGPLTARFTEPLAMRLFPRRDNPDRPSGLAEGTPRAAATEEASVGD

SEQ ID NO: 3774 - protein, 223 aa, Beta vulgaris
MEEVKVYGAWGSPPSHRVEIALKLKGVKYEFIEEDLKNKSEELLKYNPVHKKIPVLVHNGRPIAESLVILEYIDEIWKQCPLLPTDPYDRAQTRFWAKFIAEKITPAVRDAMLIPGEDAEKKTEELIELLHILEKEIKEKKFVGGNRNKYMDIVSLYVIHWIPILQEYSSKHVLTREKFPGIYDWIDQVLLDCGDIMENLPDKNKMFDVLRVIFGPRNNYKPT

SEQ ID NO: 3775 - protein, 200 aa, Mannheimia succiniciproducens MBEL55E
MVLVTRQAPDFTSAAVLGNGEIVDNFNFKQHIAGKPAVIFFYPLDFTFVCPSELIAFDHRYEEFKKRGVEVVGVSIDSQFTHNAWRNTAVDQGGIGQVQYALAADTKHEIAKAYGIEHPEAGVALRASFLIDANGVVRHQVVNDLPLGRNIDEMLRMVDALQFHEQHGEVCPAQWEKGKEGMKDSPEGVAKYLKQNADKL

SEQ ID NO: 3776 - protein, 849 aa, Brassica napus
MKGVRNIYHHSYTSFLLLFLVMILIHPALSIYINTLSSTESLTISSNRTLVSPGDVFELGFFETNSRWYLGMWYKKLPFRTYVWVANRDNPLSNSIGTLKISGNNLVILGHSNKSVWSTNLTRGIDRSTVVAELLANGNFVMRDSNNNDASQFLWQSFDYPTDTLLPEMKLGNDLKTGLNRFLTSWRSSDDPSSGEFLYELETGRLPEFYLSKGIFPAYRSGPWNGIRFSGIPDDQKLSYLVYNFTENSEEVVYTFRMTNNSIYSKLTVSLSGYFERQTWNASLGMWNVSWSLPLPSQCDTYRRCGPYAYCDVSTSPICNCIQGFNPSNVQQWDQRSWSGGCIRRTRLSCSGDGFTRMENMELPETTMAIVDRSIGVKECKKRCLSDCNCTAFANADVQNGGTGCIIWAGELEDIRNYAADGQDLYVRLAAADLVKRRNANGQIISLTVGVSVLLLLIMFCLWKRKQKRANANATSIANRQRNQNLPMNGMVLSSKREFLEEKKIEELELPLIELETVVKATENFSNCNKLGQGGFGIVYKGRLLDGQEIAVKRLSKTSVQGTDEFMNEVTLIARLQHINLVQIIGCCIEADEKMLVYEYLENLSLDSYLFGKTRRSKLNWKERFDIINGVARGLLYLHQDSRFRIIHRDLKVSNILLDKNMTPKISDFGMARIFARDETEANTVKVVGTYGYMSPEYAMHEIFSEKSDVFSFGVIVLEIVSGKKNSYNLNYKNNLLSYAWSQWEEGRALEIIDPVIVDSLPSTFQPQEVLKCIQIGLLCVQELAEHRPTMSSVVWMLGSEAKEIPQPKQPGHCIGRSPYDLDPSSSSQCDDDESWTVNQYTCSLVDAR

SEQ ID NO: 3777 - protein, 286 aa, Arabidopsis thaliana
MEGKEEDVRVGANKFPERQPIGTSAQTDKDYKEPPPAPFFEPGELSSWSFYRAGIAEFIATFLFLYITVLTVMGVKRAPNMCASVGIQGIAWAFGGMIFALVYCTAGISGGHINPAVTFGLFLARKLSLTRAVFYIVMQCLGAICGAGVVKGFQPNPYQTLGGGANTVAHGYTKGSGLGAEIIGTFVLVYTVFSATDAKRSARDSHVPILAPLPIGFAVFLVHLATIPITGTGINPARSLGAAIIYNKDHAWDDHWIFWVGPFIGAALAALYHQLVIRAIPFKSRS

SEQ ID NO: 3778 - protein, 556 aa, Mesembryanthemum crystallinum
MAFDLSNLVSTKLQMLSTSDHASVVSMNLFVALLCGCIVIGHLLEENRWMNESITALAIGLATGVVILLFSGGKSSHLLVFSEDLFFIYLLPPIIFNAGFQVKKKQFFRNFITIIVFGALGTLVSFTIISLGAMEFFKKLDIGSLELGDYLAIGAIFAATDSVCTLQVLHQDETPLLYSLVFGEGVVNDATSVVLFNAIQNFDLTHIDHRIAFKFAGNFLYLFFTSTLLGAITGLLSAYIIKKLYFGRHSTDREVALMMLMAYLSYMLAELFYLSGILTVFFCGIVMSHYTWHNVTESSRVTTKHAFATLSFVAETFIFLYVGMDALDIEKWRFVSDSPGISVAVSAILLGLLMLGRAAFVFPLSFLMNFSKKSQSEKVSFRQQVIIWWAGLMRGAVSMALAYNQFTRAGHTQLRGNAIMITSTISVVLVSTVVFGLLTKPLILFLLPQPKHFNSTSTVSTDLGSPKSFTLPLLGDHQDSETDLGNHQDSTDRHIGRPTSLRMLLNAPTHTVHYYWRKFDDSFMRPVFGGRGFVPFVPGSPTEQSTNNLNHSTEST

SEQ ID NO: 3779 - protein, 353 aa, Zea mays
  misc_feature (161)..(161): Xaa can be any naturally occurring amino acid
  misc_feature (210)..(210): Xaa can be any naturally occurring amino acid
  misc_feature (218)..(218): Xaa can be any naturally occurring amino acid
  misc_feature (244)..(244): Xaa can be any naturally occurring amino acid
MADRFIPNDFPDFVAEAEASDGEGHRPAGLRGLLSLPYTRLSDHFVRAARRLKDKVVEETWVKAGRKVTDYTLYTGSLGTALLLFKSFQVTGDRGDLALAADIVRACDDASRGLPRRFLTFICGRAGVCALGAVIAKHCDDQLRVTQYLSSFDELSFVTLXITITEKVPNELLYGRAGYLWACLFLNKHLSEKTIPLDHINSVAKDIINXGRGFASKXSSPLMYEWHGKKYWGAAHGLAGIMLXDDYFKQSAAEAAEVVWNRGLLKRVGICHGVSGNAYAFLSLYRLTGNVEHLYRAKAFACFLLEKADQLIAEGAMHGGDRPFSLFEGKAGMSYLLLDMVDPSESRFPAYEL

SEQ ID NO: 3780 - protein, 915 aa, Zea mays
MKLSAAVLFFSILLQYCTSSGQPDSRGFISIDCGIPENSTYQDLTSTILYVSDRGFVTSGENRNISAGYISPSLAQRYYTVRAFASGVRNCYTLPSLVAGNKYLVRAAFYYADYDGLSTPPVFDLYLGASLWHEVRFRDAAAINWMDVVAVAPTDFLQVCLVNKGTGTPFISGLDLRPLRSTLYPEANASQSLVMVNANRCNVGPTDKSVVRPTKAHFSGPTSRYPLDPHDRIWLAYGAVPAWTEASATSVVRNYLADPYDAPSAVMQSAATPSDGSVLSFSWDTSDDRSVDASSATYLLVLYFAELQRVSASGELRRQFDIAVDGTAWNREPYSPPYLFADSFSGTVQGQARHSVSLTATRNATLPPLLNAMEVYLVRPVDEAATDPGDAKAMIAIQEAYVVSKNWMGDPCAPKAFAWEGLDCTTDPPTGTPRITAFLLFPELGHEIKLTNSTTETFELFLTRTVTYTRDLSHNNLSGSIPDCLGQLPFLVFLDLSSNDLRGPVPYTLLQKSHNGTLSLRLSNNPNLSGNGSGPKKLNGAALLSAIIIPTVAATALSVTFIALLLRALKEQARRRAVDPTPRDETALLENREFSYRELKHITKNFSLEIGRGGFGAVFLGYLGNGNPVAVKIRSESSSQGGKEFLAEAQHLTRVHHKNLVSLIGYCKDKDHFALVYEYMPEGNLQDHLRLRGLEYLHVACKPALIHRDVKSRNILLTTGLGAKIADFGLTKAFSDSETHITTEPAGTMGYLDPEYYRSYRASEKSDVYSFGVVLLELVTGQSPVVPVDDSVSVHVGEWVQQSLDRGGGVESVVDPSMGRCERGDYDVNSVWKVADLALRCRREASRERPTMTDVVAQIRESVELEAARRSSASGAAAAGGGGGLRSCAGERDAFEVVEGSVGETAGAAPGPAMI

SEQ ID NO: 3781 - protein, 292 aa, Shewanella sp. MR-4
MSDFPTIEACIGQTPLVRLQRLDCGSSTVLLKLEGNNPAGSVKDRAALNMIIQAELRQEIAPGDTLIEATSGNTGIALAMAAAIKGYKMILIMPSNSTQERKDAMLAYGAELLLVDNMEAARDLALELQAQGKGKVLDQFNNQDNANAHFQTTGPEIWQQSQGKITHFVSSMGTTGTIMGVSKYLKSRNPDVTIVGLQPADGSSIPGIRRWPQEYLPGIFDAARVDAVMDIEEQDAKAMARTLAREEGICAGVSSGGAVFAALEIARQNPGSVVVAIVCDRGDRYLSSGLFS

SEQ ID NO: 3782 - protein, 153 aa, Clostridium perfringens ATCC 13124
MRILEGNLIGQDKKFAIVAGRFNEFIVSKLIDGALDAFKRHGVEEDNIDLAWVPGAFEIPLIAKKLAKSGKYAGVVCLGTVIRGATSHYDYVCGEVSKGIANVSLDTEVPVIFGIVTTENIEQAIERAGTKAGNKGFDAAMAAIEMANLLENI

SEQ ID NO: 3783 - protein, 431 aa, Geobacillus kaustophilus HTA426
MIYEFKLPDIGEGLHEAEIIRWLVREGDVVKADQPIAEIQTDKAMVEMTTPVAGKVVALAGPEGATVKVGEPLIVVETEASVAGEATPIEDSVREPVPVLHGETPRPARKRAIAAPSVRKRAREMGVPIDEVEGTGEGGRVTLADLERYVREREAAVAVAELRERSGAAVLPVGGTAIEQKADKAAWTSIASTELVVPEEERIPLRGLRKKIAEKMVKSAYTAPHVTGMDEVDVTKLVEIRKNLASELAKEQIKLTYLPFIIKAVTRALKQYPMFNASLDEETNEIVLKKRYHIGIATATKAGLVVPVIRDADQKSIRELAIEIAELSEKAHRQALRLEELQGSTFTITSTGAGGGWFATPIINYPEVAIFGAHAIKRRPVVVGDEIVIRDMMGMSLTFDHRVIDGEPAGRFMRTVAHYLENPEVLLLDVR

SEQ ID NO: 3784 - protein, 378 aa, Vibrio fischeri ES114
MKSRLKITTVALLFASFFAVITSFFSTAEDMTQPMKGDNEVATLAGGCFWCTESDLEKLDGVVDVVSGYSGGTLENPTYKQVSSGKSGHIEVIQVTFDPKVVSYEQILDHLFRHIDPTDNKGSFVDRGPQYRPAIFYHNEDQKLIAQNFMKDIDAAGIFPKPLATELIEYKTFWPAEAYHQDYYKRNPIRYKYYRHGSGRDKYLDSVFGEDREENPKTLRQYITEYEMAVNVKPYSKPSESQIKKSLTELQYYVTQEEGTERPFDNAYWDNKAEGIYVDIVSGEPLFSSTDKYKSGTGWPSFTKPINKAYIVEEDDFQLFTKRTEIRSKFADSHLGHVFNDGPKPTGLRYCMNSAAMRFVAKADLEKEGYGEYLYLFN

SEQ ID NO: 3785 - protein, 491 aa, Salmonella enterica subsp. enterica serovar Typhi str. CT18
MAVTQTAQACDLVIFGAKGDLARRKLLPSLYQLEKAGQIHPDTRIIGVGRADWDKEAYTHVVREALETFMKEKIDEGLWDTLSGRLDFCNLDVNDTPAFSRLGDMLDQKNRTTINYFAMPPSTFGAICKGLGEAKLNAKPARVVMEKPLGTSLATSREINDRVGEYFEECQVYRIDHYLGKETVLNLLALRFANSLFVNNWDNRTIDHVEITVAEEVGIEGRWGYFDQAGQMRDMIQNHLLQILCMIAMSPPSDLSADSIRDEKVKVLKSLRRIDRSNVREKTVRGQYTAGFAQGQKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPRLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 3786 - protein, 360 aa, Arabidopsis thaliana
  misc_feature (69)..(69): Xaa can be any naturally occurring amino acid
  misc_feature (124)..(124): Xaa can be any naturally occurring amino acid
MSAFTSKFADELIANAAYIGTPGKGILAADESTGTIGKRLASINVENVETNRRNLRELLFTAPGALPCXLSGVILFEETLYQKSSDGKLFVDILKEGGVLPGIKVDKGTVELAGTDGETTTQGXLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 3787 - protein, 480 aa, Salmonella enterica subsp. enterica serovar Typhi str. CT18
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGNLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 3788 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 3789 - protein, 182 aa, Rickettsiella grylli
MSIPNILTFLRILLIPFFILLFYLPFRGSHIVAALIFIFAAMTDWLDGYLARSWDQVSKLGSFLDPVADKLMVITALILLVSDRALPYLAIPAIVISCREIMVSALREWMAEIGKRKQMAVTMLGKIKTTLQMLAIILLLLYKPGAWMGFAFAGYLLLYLAVFLTLWSMCLYLKAAWHDLSS

SEQ ID NO: 3790 - protein, 558 aa, Bacillus cereus ATCC 14579
MKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSSAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGAEEKSLTFKVENEAELAAVLTNITFNKNQLIFIEVIMSQSDQPELLAKLGKRSGQQNS

SEQ ID NO: 3791 - protein, 245 aa, Bacillus cereus ATCC 14579
MIKLVLIRHGQSLWNLENRFTGWTDVDLSENGLSEAREAGAILKKNGYTFDVAYTSVLKRAIRTLWIVLHEMDLTWVPIHKSWKLNERHYGALQGLNKDETAQKYGEEQVHIWRRSVDVRPPALTEDDPRYEATDPRYKTLKKGEFPLTECLEDTEKRVLAYWHSEIAPTLKSGNKVIISSHGNTIRSLVKYLDNLSSDGVVSLNIPTSIPLVYELDENLRPIRHYYLSMDGEVPEGEIPKHISF

SEQ ID NO: 3792 - protein, 211 aa, Marinobacter sp. ELB17
MMQKPIDGSAMSTSAALVPMVIEQTARGERSFDIYSRLLKERVIFMVGPVEDHMANLVVAQLLFLESENPDKDIHLYINSPGGSVSAGMSIYDTMQFIKPDVATLCVGQAASMGAFLLAGGAAGKRACLPNSRVMIHQPLGGYQGQATDIEIHTREILKIRHTLNSILAHHTGQDLETISRDTDRDNFMDPTQAKAYGLIDSVLDKRVPNK

SEQ ID NO: 3793 - protein, 334 aa, Pseudomonas chlororaphis
MTLRIAINGFGRIGRNVLRALYTQGYRQDLQIVAINDLGDSSINAHLLKYDTVHGTFDADVQHDQESLTVNGDRIAVSAIRNPAELPWAAEKIDVVFECTGLFTDRAKAAAHLSAGARKVIISAPAKGADATVVYGVNHDILRQSHQIISNASCTTNCLAPVAQVLNRELGIESGLMTTIHAYTNDQNLTDVYHSDSVPRPFGHPNMIPSKTGAAEAVGLVLPELAGKLTGMAVRVPVINVSLVDLTVQLKRNTTAEEVNALLKSASQHSKILGYNSLPLVSSDFNHNPLSSIFDANHTKVSGGKLLKVLAWYDNEWGFSNRMLDNCLALCSAE

SEQ ID NO: 3794 - protein, 116 aa, Arabidopsis thaliana
MGESSGSSSSLAAINSSNIGFQLLKKHGWKEGTGLGIAEQGILVPLQAEPKHNKRGVGAKQPAKRKVAQPQAKDEEVSKQSKKLSKKMRKMMEHEKHLQEKEFERAFFREFWPDNV

SEQ ID NO: 3795 - protein, 408 aa, Pseudomonas fluorescens Pf-5
MRAMTYHGAHDVRVETVPDPIIEASDDIILRVTATAICGSDLHLYRGKIPAVEHGDIFGHEFMGIVEDTGSAVTAVQRGDRVVIPFVIACGDCFFCQQELYAACETTNTGTGAAMNKKLIPPPAALFGYSRIYGGIPGGQAELVRVPKANTGPFKVPGTLADERVLFLSDILPTAWQAVINAGVSQGSSLAIYGAGPVGLLSAACARMLGVERIFMVDHHPYRLDYAQRTYGVIPINFNDDDDPADTIISQTSGSRGVDGVIDAVGFEAKGSTTETVLATLKLEGSSGKALRQCIAAVRRGGVVSVPGVYAGFIHGFLFGDAFDKGLTFKMGQTHVHRYLPELLEHIETGRLQPDAIISHRLSLEQAAEGYKIFDKKQEDCRKVILTPGGSNMQLADVDDTTSLAPAV

SEQ ID NO: 3796 - protein, 364 aa, Gluconobacter oxydans 621H
MGFNCGIVGLPNVGKSTLFNALTETAAAQAANYPFCTIEPNTGRVAVPDPRLDELARIGKSIRKVPTSLEFVDIAGLVRGASKGEGLGNQFLANIREVDAIVHVLRCFEDDDITHVEGGVDPVRDADIIETELMLADLESLEKRQVGLQKRARGNDREAQAQLELMEPLLAALRDGKPARTAVPKEQEAEASRLQLLTTKPVLYVCNVEEASAATGNAFSEAVRKRAEAEGAGVVVVSAAIEAEVSQLPQEDRTEFLEGLGLTDSGLDRVIAAGYKLLGLRTYFTVGPKESRAWTITAGTKAPQAAAVIHNDFERGFIACETVAFDDYVACNGEAGAKEAGKLRIEGKEYVVQDGDVLLFRFNV

SEQ ID NO: 3797 - protein, 491 aa, Marinobacter sp. ELB17
MTKLDNTRCDLMIFGALGDLANRKLFPALYQLERAELFAEGSRVLALARHEHSNDDVRQQIADNLRQRVPAEEFEQSVVERLVQRVEYRSLDFSRRESYPELNGWRDSVNNNLIVYMATPPSLYGVIARNLRDSDCCSEHIRVVVEKPIGHDLQSSRVINDALGEVYAESELFRIDHYLGKETVQNLIALRFANNLFASQWDQNHISHVEITVAESLGIEGRWGYFDKAGQLRDMIQNHLLQLLCLIAMDPPSDLSADSIRDEKVKVLKALRKITPAMMEHYAVRGQYTAGSSEGKAVPGYLDEKGADKSSDTETFVALKVEIDNWRWSGVPFYIRTGKRLPEKFSQIVIHFKPAPHYIFDPDQKHLANNKLIIRLQPDEGMALKILTKDQGLDKGMRLRQGPLELTFAETFAKVRIPEAYERLLWEVMKGHQYLFVRRDEVEHAWRWIDQIITNWQDSGEPPKRYAAGGWGPVASVALITRDGRSWYEDV

SEQ ID NO: 3798 - protein, 503 aa, Oryza sativa Japonica Group
MESLLAAGAGGIGVAAAAAVVAATLAVVPPKDRGNNPPPAVPGLPVIGNMHQLKEKKPHHTFTKWSKTYGPIYTIKTGASSVVVLNSTEVAKEAMIEKFSSISTKKLPKALSVISRKNMVSISDYGDFYKMAKRNIMLAILGFNAQKHFCDTRERMVSNVLSSLHKLVAVDPHSPLNFREVYTTELFGLSLIQNLGEDVCSVYVEEFGREISKEEIFHVLVHEILSCVVEPDWRDYFPYLSWLPNKSFETIVSSTEFRRDAVMNALIKRQKERIARGEARISYIDFLLEAKNSTQLTDHQLMLLLAESIAAAVDTVLVTTEWAMYELAKNPDKQEWLYREIREVCGGKAVTEEDLPRLPYLDAVLHETLRLHSPVPVLPTRFVHDDTTLAGYDVPAGTQVMINVFGCHMDEEAWESPGEWSPERFLGEGFKLADRYKTLAFGAGRRTCAGSQQAVSIACVAIARFVQELQWTLREGDGDKEDTMQYTALKLHPLHVHLKPRGS

SEQ ID NO: 3799 - protein, 526 aa, Mesembryanthemum crystallinum
MEDQLISPADSRGSPAKEQQAAGVGILLQIMMLVLSFILGHVLRRHKFFYIPEVSASLLIGLVVGGLANISNTETSIRGWFNFHEEFFFLFLLPPIIFQSGFILSPKPFFSNFGAIVTFSILGTFIASVLTGLLVYLGGITFLMYKLPLIECMMFGALISSTDPVTVLAIFQELGTDVNLYALVFGESVLNDAVAISLYRTMSLLNSHMSTGQNIFTLVVGFLETFVGSLSSGVGVGFIPALLFKYAGLDIDNLQNLESCLFVLFPYFSYMLAEGLGLSGIVSILFTGIVMKHYTFSNLSEKSQQFVSEFFHLISSLAETFIFIYMGLDIVMEKHSWSHVGFIFFSIIFIVISRAVNVFSCGYLINLARPAHRKIPMKHQKAPWYSGLRGAMAFALALQSVHDLPEGHSQTIFTATTAIVVLTVLLIGGSTGTMLEALQVIGDSNEGHIGDGFNRSDGYVSPSQDEEESSSNRFKMRLKEFHRSAPSFSSLDKNYLTPFFTTQSGDEEEHETLMPSPRREVYLSRN

SEQ ID NO: 3800 - protein, 219 aa, Mannheimia succiniciproducens MBEL55E
MSKIQRVAEANLPTEFGLFRIVGFEFPDTKKEHVALVMGDISNSEENPVLARIHSECLTGDALHSLKCDCGFQLSTALRQISEAGRGVLIYHREEGRGIGLINKIRAYSLQDNGMDTIEANLALGFAADERNFKVCADIFELLGICKVRLLTNNPAKIDTMKKAGINVVERIPLNVGENRYNTGYLDTKAKKMGHYIVHDNEKHYLDCPYCQSEIPNKK

SEQ ID NO: 3801 - protein, 358 aa, Clostridium perfringens ATCC 13124
MHKKLFIPGPVEVREEVLEKMATPMIGHRSKEASQLQRRISDNLRKLFFTNNEILLSTTSGSGLMEGAIRSCTLKKAAVFSVGAFGDRWYEMGISNNVPVDKFEVPWGKSINVDLIDSVLKTGQYDLITVTHNETSTGVMNDLEAISKVIRKYPEVIFCVDAVSSAGGSKIEVDKLNIDICITSSQKALGLPPGIAICTFSERARERAEKVKFRGTYLDLLALYKYIKKKDYQYPSTPSISHMYALDYQLDYILNVEGLENRFNRHIEMAKIVREWAEKYFEIYPEKEYYSNTLTTIKNNKNIDIGALNKELGKRGFQISNGYGKLKDKTFRIAHMADCQVKDIKELLSNINEILELE

SEQ ID NO: 3802 - protein, 459 aa, Rhodococcus sp. RHA1
MSLAPSRVTLPDFIDSRPVSRYQYIVIALCGVVMFIDGFDTQSISYMAPHIAEEWGLSKQVLGPIFSAALAGLMVGYLALSPLSERFGHRRMILTSTVIFALGTLAAAWSQNVTELMALRFITGMGLGAAAPSAIALTGEFSPKRLRATFVLVIYCGFSLGFVAAGLVSGWLIPILGWRSVLVVGAVAPLLLLPALLRYLPDSLTSMINRGAEPNRIQAIFRKMDPALAVGPDITYEAEKRTDGQRTALRSLFTRDRVLGTLLLWLVFVINLGEFYALQSWLPSIMTSLDYDMGTVVTATTLTTVGGIAAAFVTGPCMDRLGAYVTLGTVYVVGFAFVALTGVAFTAPLWVLLTANFFAGVCISGGQKSLIALSAVFYPTPMRSTGVGWALGVGRLGGIVGPIAVGAALGMGWSASAVFYAMSVPMLVAGAAVFLLGRWVRSDNHPDRKSAESHSLARK

SEQ ID NO: 3803 - protein, 381 aa, Arabidopsis thaliana
MTCCFSCLNPRTKDIRVDIDNARCNSRYQTDSSVHGSDTTGTESISGILVNGKVNSPIPSGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 3804 - protein, 297 aa, Geobacillus kaustophilus HTA426
MNKPTITVIGSLNMDLVTVAARFPNQGETILGEQFLTTPGGKGANQAVAAARLGANIRMIGAVGDDAFGQELIRSLQNEGISVDYVKPVTHGSTGIASITISERDNRIIVVPGANHALTPEDLDSCESVIAESDVCLLQLEIPLPVVERAVSIAHRHGVRVIVNPAPAQPLPPSVLEQASFLTPNEHERTILFDKMDEEAFADKLIVTEGAKGVRIWQDGQERLIPSFQVPVVDTTGAGDTFNGALAVALAEGKPLDEACRFANAAAALSVTKLGAQAGMPRRQEVESFLSRQKESH

SEQ ID NO: 3805 - protein, 477 aa, Pseudomonas fluorescens
SQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 3806 - protein, 360 aa, Wolbachia endosymbiont of Dirofilaria immitis
MLIENQGRNKVKRAVSEIRCSLPILIYDESDYLLFAAAETLERDLFDQYKVISNNLYITLTSDKMQYILKNGKSDNKRLPVNNFDELLSLVNCSIEDYTERLQCSKTIDEYAIALLKFSELLPYALVVDMTFKDENEMRYWCEKNDVIALDTSLVNHFQQDYGVYEVCRTSLFLKQARKVNIVSYRTRSCGKEHYAIIIGSPGEEGEPLVRIHSSCYTGDLLDSLSCDCGSQLHQAIQVISDSGGGIILYLMQDGRGIGLANKLRAYGVQRKYNLDTVDANRVLGFKDDERNFTIAAKILEKLDIKKIQLLTNNDRKLLGLRSSGIEVTKCLPLIMERNEHNDSYMETKFSKLGHKLRIF

SEQ ID NO: 3807 - protein, 801 aa, Oryza sativa Japonica Group
MQPHAVCLPFPAQGHITPMMKLAKILHSRGFHVTFVSTEYNHRRLVRSRGAAAAAGIPGFRFATIPDGLPPSDADATQDPPSLSYSTMTTCLPHFRKLLADLNNRLAPDDDDAAPPVTCVVADHLMGFSLDAAAELGVPCALFWTASACGYMGYRNFRLLIDMGIIPLKGEEQLTNGFMDMAVDWAPGMSKHMRLKDFPTFLRTTDRNDILMTFQLRQVERAEEADAVVLNTFDELERPALDAMRAITPAIYTVGPLAFLTEQIPPGGPLDDISPSLWREDDACLRWLDGRNPRSVVYVNYGSVTVMSGHELEEFAWGLAGSGHDFLWIVRPDVVTRTAAATAAEAALPREFTEATKGRGLVASWCDQEAVLRHPAVGLFLTHSGWNSTVEALSGGVPMLCWPFFAEQQTNCRYKCVEWGVAMEVGDSVRREAVEGRIREAMGGGEKGKEMRRRAAEWKEAAARARGRSLANLERLIGDVLLSGKKDRINHRVPRGLPPYSDLTLLKNNMQSFCYPTSPPTLDVLMQAILLIEADVALMDVSATMWSVQSRLTRCPRPWSSAEAVFQVPEEMKRMLGSFYGRCENKIIGNRKAQGRRFTTMEAGEEIEDGEPSTPTYKAHHPPPHLPPPMRSSGVSLVLSVADLVLRFVAIGGTAGSAIAMATTSETLPFAAPFVRFRAEYSDLPTLMFFVVASSVVCAYLVLSLPASVVHVVRPGARSSRAILAFLDTVMLALLTASASAAAAIVYLAHRGSARANWLGICQQFTSFCQRITASLVGSFAAAVVLVALVFLSALSLARRA

SEQ ID NO: 3808 - protein, 257 aa, Neotyphodium lolii
MAATPRNRRLVGLSTKMYFSLSRNRQVTEGFLERLGKLAPSSLAHVDIFIIPDFVSLAETAEQVKTSPVPVWPGAQDCHWEDSGAFTGEVSPAVLSEVGVRIVEVGHAERRRLFGEDDAVVAKKAAAVSRNGMVPLVCVGEQTRGGIALAVGECRAQVEAVLAGVSPAAEVALAYEPVWAIGASEPAGEEHVLGVVEGIRQLGCVKSREGVTRIVYGGSAGPGLYAQLKSGLDGLFLGRFGHDPERFVKTIQEVAEA

SEQ ID NO: 3809 - protein, 346 aa, Robiginitalea biformata HTCC2501
MKQEIQAFNNILELIGKTPLVRLNRLTAGFPGEYYAKLEAFNPGHSSKDRIAHFIIEEAERSGILKPGSTVIETTSGNTGFSLAMVSIIKGYECILAVSSKSSRDKIDMLRSMGAKVYICPAHVSADDPRSYYQVAKRLHQETQNSIYINQYFNDFNIKAHYATTGPEIWEQTGGQITHLVACSGTGGTISGTARYLKEQNPDIRIIGVDAYGSVLKKYHETGEFDTEEIYPYRIEGLGKNLIPDATDFTVIDEFIKVTDEESAHTARELCHKEGIFAGYTSGAAMQALKQLQEDKTFDANSRVVVIFPDHGSRYMSKIYSDKWMEDQGFFDSKHVGEEQQIQVIK

SEQ ID NO: 3810 - protein, 427 aa, uncultured haloarchaeon
MGTQEQKAYPIDIPSVRGDFPILDRKVGGDIETPGPSPDDTDPLVYLDNAATSQTPTDVVEALTEYYYQYNSNVHRGIHHLSQEASVAYEVAHDRVAEFIGADGREEIIFTKNTTESMNLVAYAWGLAELEPGDTVVLSEMEHHASLVTWQQIAKRTGANVEYIRVDEDGYLDMEHARELIDDSIAMVSVVHISNTLGTVTPVEELAELTHDHGGYIFIDGAQSAPTRPVDVDAMDTDFFAFSGHKMLGPTGIGVLYGKQEILESMEPYLYGGEMIRRVTYEDSTWEDLPWKFEAGTPVIAQAIGLHAAIDYLEDIGMETVQAHEELLAEYAYNQLSAFDDVETYGPPGGDRGGLVAFNLEGVHAHDLSSILNEYGVAIRAGDHCTQPLHDKIGVPASTRASFYIYNTREEIDELVTAVDAARELFA

SEQ ID NO: 3811 - protein, 482 aa, Marinobacter sp. ELB17
MLRRTKIVATLGPATDSPESLGAIIAAGVDVTRLNFSHGTAEDHEKRARLVRDTAKAQGRFVAIMADLQGPKLRIARFRDNKVTLTAGQTFVLDATMDKESGTSDCVGIDYEQLIRDVKPGDILVLDDGRIEMQIDAVDDHSITSTVLIGGPLSNNKGLNKRGGGLSAEALTEKDKQDIVTAAKLGADYVAVSFVRNAEDMHTARRLLKEAGSEAGLVAKIERAELAHDDAALDAVIEASDVVMVARGDLAVEIGDAELVGVQKHIIQRARILNRAVITATQMMESMITNPMPTRAEVSDVANAVMDYTDAVMLSAETAVGDYPVEAVTAMVRICIGAEKHPSMHQSKHRMHESMGRVDEAIALSTMYAANHLNGIAAIICLTETGATPQLMSRIKSSLPIYAFSRHHTTQHRVVMYRGVQTVPFDAANFAAEDTNTEAVEQLVKQGVVKNGDLVIITKGNFTNAQGGTNSMQILRVGEHLH

SEQ ID NO: 3812 - protein, 334 aa, Marinobacter sp. ELB17
MTIRIAINGFGRIGRNTLRALYENNYREQMQVVAINDLGDAETNAHLLKYDSVHGRFAADVSHDADSLSVNGDRIAISAIRNPADLPWKDLGVDVVLECTGLFTTREKAAAHLQAGARKVIISAPSPDADAMVVFGVNDQILNADHHIISNASCTTNCLAPIAEALNNAVGIESGLMTTIHSYTNDQHLSDVYHSDLYRARSATQSMIPTKTGAAAAIGKIIPALNGKLDGLAVRVPTINVSLVDFGFIASRDTSVEEVNAAVKAAADKNSVLGYNQEKLVSVDFNHDARSSIFDANHTRVIGRHVKVMAWYDNEWGFSNRMLDNAAALIKASQ

SEQ ID NO: 3813 - protein, 306 aa, Sulfolobus tokodaii str. 7
MRKTIFDTDTASDDAIALMLALDYFEVLGVTIVAGNVKFENEVSNALFTLEYLSRPDIPVYLGAQRPLLGQWRTVEEVHGKNGFGDWEYPSPLKKPESEFAADAIIRLSKEYEGELEILAVSPLTNIALAYLKDPKIINRIRKIWIMGGAFTRGNTTEIAEFNFWVDPEAAQIVLNAGFDITIVPWEIAEESATITDEEWNKIEDINTKRSEFFIKVNRVLREYSKSVGSRGSVHPDSLTVTIAYDNSVAIEKVSKYVNVELCSRSRGAMLIDWYGLNKRRPNAEVVIKADSQKFKKYLFDSLSKA

SEQ ID NO: 3814 - protein, 355 aa, uncultured haloarchaeon
MCRQFISGNMEAVQFAAHGDRDVIEYGEFPNPTIERDEVLVDVKAASVNHLDVWTRRGLPGIDVEMPHIPGSDMAGVVSETGADVTRFDPGNHVALIAGVAGDTDEFTRKGDPTLAADYHLIGEHVRGVHSEYTAVPAANLVPVPDHVPWEIAGSTSLVFQTAWRMLIDRAELRTGEHVLIHGASGGVGHAAVQIASHAGATVSATASTERKLEHAADYGAEHLINYENTSFADEIYQITDGRGVDIVIDHVGEATYEGSLKSLRKGGRLITCGATTGPNPDANLNRIFWNQLQIIGSTMATPGQAEEVLDLVWDGTLKPHIRETLPMSDIAHAHELLENREGFGKVVVIPDNEY

SEQ ID NO: 3815 - protein, 325 aa, Physcomitrella patens subsp. patens
MVKVVKVYEFGGPEKLQFEDVELGKPGPKQARVKHAAVGLNMIDTYFRRGQYKADLPFVPGMEGAGTVEEVGSEVTDVGVGDRVCYAGVMGSYVEEKLIDAEKLVKIPDGIEFTVAAALILKGMTTQVLLRKVFKVESGHTIVVHAAAGGVGSLMVQWASSIGATVIACVSNEEKGKQATADGAQHVIVYSDNNLVERVKEITKGVGVPVVYDSVGKDTFQASLECLAYRGMLVLYGQASGPPEPIPVTAIASKSLFISRPSLMHYIMTRKELEEIAGDLFANVANGVLKVRVHAIYPLSQAAKAHEDLEGRKTTGSTVFVPDSV

SEQ ID NO: 3816 - protein, 322 aa, Gluconobacter oxydans 621H
MKVLVTGVAGFIGFHVARALLKQGMEVVGVDTLNAYYDPALKAARLEQLEPYPGFSFLKVDVASPAAMQDLVARHSDLEGVIHLAAQAGVRHSMVDPYSYVTSNVMGQVALLEACRHLKKLTHVVYASSSSVYGRNQSVPFRETDRVERPSSVYAVTKRAAELMSESYAYLHGIPQTGLRFFTVYGPWGRPDMAYYGFAKAISEGRPVTLYEGKHLSRDFTYIDDIVRGVQQVLGRPPEAGMSRVLNLGGDKPERVTRMIELLEQNLGKKAFVERRPRPVADMESTWASLENVREFCGWKPAVSFEDGMKEFCLWFRKFHEI

SEQ ID NO: 3817 - protein, 164 aa, Sulfolobus tokodaii str. 7
MDTTIGVIGNKVVHVIKENDSVKTAAEEMKKHNLGALVVIDDNDKIVGIITERDIVKVVAEGKLDAKVKDYMTRNVIGVTEDTPITDALEIMLDHGFRHLPIIGKDGKVIGIVSIRDLSKAILDPHFFQFKKEAADVKGSGYVCPVCGMEIDEYGYCGCGAGSG

SEQ ID NO: 3818 - protein, 316 aa, Mannheimia succiniciproducens MBEL55E
MPDIKLFAGNATPELAKRISERLYISLGDATVGRFSDGEIQVQINENVRGSDVFIIQSTCAPTNDNLMELIVMVDALRRASAGRITAVIPYFGYARQDRRVRSARVPITAKVVADFLSSVGVDRVLTCDLHAEQIQGFFDVPVDNVFGSPVLINDILKKTDLENPIVVSPDIGGVVRARAVAKLLNDTDMAIIDKRRPKANVSQVMHIIGDVSDRDCILVDDMIDTGGTLVKAAEALKERGAKRVFAYATHAVFSGSAAQNIANPALDEVVVTDTIPLSAEIKALGKVRSLTLSAMLAEAIRRISNEESISAMFDA

SEQ ID NO: 3819 - protein, 557 aa, Synechococcus sp. WH 5701
MAQFPASLLPSGYRRGLGQADLAAGLTAAAVVLPKAMAYATIAGLPVQVGLYTALVPMAVYALLGSSRPLSVSTTTTLAILVGSELNRLSPLGDPSALVAASTTLALLVGTMLCGAALLRLGFIANFISESVLVGFKSGIGLVIVVDQLPKLLGLHGEKEGFFRDLAALLVGIPQASLATVLLSAALFGLLFGLKRRLPSVPAPLVVVAVAIAGCALLGLDRFGVELVGAVPRGLPSLSLPRLDLLGGLWPGAAGIAMMSFTESIAAARAFRASDEPSPQPDRELLALGLANIGGGFFGAMAAGGGTTQTAVNRQAGARSQMAELVTAGAALATLLLLAPLIALMPLAALAVVVIVYSFELIAPGEFLAIRRVRHIEFRWALVAFLGVVFLGTLKGILVAVILSLLALVQQEVNPPVYAIGRKRGTDVFRPLSARHPRDETWPGLLLLRAEGRLFFANAHGVLQRMRAEINQHQPRVVVLDGSAVIDIEYSALKVITEAERRLDRQGISLWLAGLNPTVLEVIRRSELGERLGKERMHRNIERAVEHYLAAGLDQQA

SEQ ID NO: 3820 - protein, 681 aa, Staphylococcus aureus subsp. aureus MW2
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 3821 - protein, 583 aa, Oryza sativa Indica Group
MSFGGAGSIPEEALHLVLGYVDDPRDREAVSLVCRRWHRIDALTRKHVTVPFCYAASPAHLLARFPRLESLAVKGKPRAAMYGLIPEDWGAYARPWVAELAAPLECLKALHLRRMVVTDDDLAALVRARGHMLQELKLDKCSGFSTDALRLVALSCRSLRTLFLEECSIADNGTEWLHDLAVNNPVLETLNFHMTELTVVPADLELLAKKCKSLISLKISDCDFSDLIGFFRMAASLQEFAGGAFIEQGELTKYGNVKFPSRLCSLGLTYMGTNEMPIIFPFSALLKKLDLQYTFLTTEDHCQLIAKCPNLLVLAVRNVIGDRGLGVVADTCKKLQRLRVERGDDDPGLQEEQGGVSQVGLTTVAVGCRELEYIAAYVSDITNGALESIGTFCKNLCDFRLVLLDREERITDLPLDNGVRALLRGCMKLRRFALYLRPGGLSDTGLGYIGQYSGIIQYMLLGNVGETDDGLIRFALGCENLRKLELRSCCFSEQALACAIRSMPSLRYVWVQGYKASKTGHDLMLMARPFWNIEFTPPSSENANRMREDGEPCVDSQAQILAYYSLAGKRSDCPRSVVPLYPA

SEQ ID NO: 3822 - protein, 370 aa, Mycobacterium sp. MCS
MKTNAAILWEYGGDWTVEEIDLDPPGDGEVLVSWEATGLCHSDEHIRTGDLPAPLPLIGGHEGAGIVREVGPGVVGLAPGDHVVASFLPACGRCRFCSTGHQNLCDLGAMIMAGTQLDGTYRRHVRGQDVGVMALVGTFSQYGTVPEASIVKIDDDLPLARACLLGCGVTTGWGSAVNTADVSPGDTVVIIGLGGIGSGAVQGARLAGAEKIVVIEPVESKRELAFRFGATHFVTTMEEANALVADLTRGVMADSAILTVGLLEGSMLEDAANIIRKGGAVVMTALSTMADNQPTLGMMMFTLFQKRLLGSLYGEANPRADIPRLLSLYREGKLLLDETVTHEYKLAEVNEGYEDMRAGRNIRGVILHDH

SEQ ID NO: 3823 - protein, 429 aa, Escherichia coli
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIAPFGKLIYLMPPYIILPQQLQRLTAAVNRAVQDETFFCQ

SEQ ID NO: 3824 - protein, 472 aa, Synechococcus sp. RS9916
MTLLSAPADTTENNGNGLPNVERLRAPVARGETRAEPWRRQQLKAMRQLLDQHQDDILDALHADLGKPPTEGMVEVLALRQELKLCDRLLRRWMRPRKVTVPLPLQPGQAEVIREPLGCVLIIGPWNYPFHLTLQPLISALAAGNTAVVKPSEHAPATAALIERLLQKTFNSDVVQVVQGDGGTAAALVDQGYDHIFFTGGGSIGSKVLAGAARHLTPVTLELGGKSPAVVLAGADLAVTARRLIWGKGLNAGQTCIAPDYLLVERDLRNPLLEALKVARSELYGDTPLNSPDLGRIINVRQYQRLEGLLQGAQAQEQVLIGGECDATKRQIAPTVLAVDRSDDPLMRDELFGPLLPMIEVEDLAMAMEQIRSRPKPLALYLFGGTAAQQQQLLMGTSSGGVCFNDVVMHVGIPDLPFGGVGPSGMGSYHGEAGFSTFSHERSVLRRPFALDLRLRYPPYRLSLDWMRRLLG

SEQ ID NO: 3825 - protein, 527 aa, Triticum aestivum
MALEAAFHYLQLAGIHGTSTPAVLLTILLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIHEAATRGTAVDMSELLSGYTNDVVCRAVLGESHRKEGRNRLFSELTEINVSLLGGFSLENYIPPNMVMADVLLRLVSVKARRLNKRWDELFNEIIEEHLHPSKPSSGDQQAVDFIDLLLSLKEEYGLTTDNIKAILVDMFEAGIETSYLTLEYGMAELMNNRHILKKLQEEVRSQGKKLDMITEEDLGSMAYLRATIKETLRLHPPAPFLLPHFSTADCKIDGYLIPSNTRVLVNAWALGRDPSSWERPEDFLPERFLQDQDGDVDTQMRGKDLRFLPFGFGRRICPGMNFGFATMEVMLANLMYHFDWDVPNMVGTGAGVDMAESFGLTLRRKEKLQLVPRIP

SEQ ID NO: 3826 - protein, 524 aa, Synechococcus sp. RS9916
MSEPLDLLVIGGGASGASVTYEAARRGLSVALLEGSDLSCGTSCRSTKLLHGGVRYLELAFKTADPAQLRLVREALLERGHWLRQAPFLAQRLELALPTNGLIGQLYYRMGLGVYDALAGQTSIGSSRWLSKTQLHQALPQIKPGLNGGVAYSDGQFDDARLNLLLALTAEQAGAQILPGCRVTSLTKDGSGRINGAISMNADGQEQRWTARAVVNATGIQADSIRQMADPDVPDRMLTSRGVHLVLRANLCPAGVGLLLPSTDDGRVLFMLPFFGRTLVGTTDTACSLTAAATPSQDERDYLLAYVRRWFPQLSDLDVGSSWAGGRPLLKPAGAERDSSRVVREHEVETLPCGLVSVMGGKWTTCRPMALDTLDAVADQLGRPLPSPKPLPLLGAADTPDHTRDQLQQQQQELHTLLPATPQRGAQIRHLQGNFGVRAATLVSRWTADERVPLSDVIPICRGELRHAVKAEHARSVTAVLARRCRLAMVDQGDAERLVPLVNDLLEEHQDTTPAGADRLNLAL

SEQ ID NO: 3827 - protein, 544 aa, Oryza sativa Japonica Group
MGLDLGALVLKSGGLLVSDYDSIVAINIFVALLCSCIVIGHLLEGNRWVNESITALVMGLITGGVILLVSGGKNSHILVFSEDLFFIYLLPPIIFNAGFQVKKKQFFRNFMTIILFGAVGTLISFVIISLGAMTLFKKLDVGPLQLGDYLAIGAIFSATDSVCTLQVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 3828 - protein, 248 aa, Zea mays
MGIELLLIDFVNVRPIGINYADILFFLHSFPRYVKSRSDKQLRYKDAAHLTKDCEPEVYSAGGAPIVPCGLVAWSLFNDTYTISVNKKAIVVNKKDIAWQSDKKKKFGSDVYPSNFQNGNLIGGAKLNESIPLSEQEDLIVWMRTAALPTFRKLYGRIETDIMENDELTVVIQNNYNTYSFGGSKALVLSTTSWIGGKNNFIGFAYLIVGGFCLFLALVFVVLYMIKPRTLGDTSFLSWNRGTMDYPS

SEQ ID NO: 3829 - protein, 198 aa, Corynebacterium diphtheriae
MSILTVGEKFPEFNLTALKGGDLHDVNASQPEDYFETVSLDKYEGKWKVVFFYPKDFTFVCPTEIAAFGKLDEEFQDRDTQILGGSIDNEFSHFNWRATHPELKTVPFPLFSDIKHDLIKALGVENEEGVADRATFIIDPDGIIQFVSVTPDAVGCNVDEVLRVLDALQSEEVCACNWQKNDPTKNIDKFAELEKGLN

SEQ ID NO: 3830 - protein, 134 aa, Brassica napus
VASKVESQVKLVVRPMYSSPPIHGASIVATILKSSDMYNDWTIELKGMADRIISMRQQLFEALQAKGTPGDWSHIIKQIGMFTFTGLNKEQVAFMTKEYHIYMTSDGRISMAGLSTKTVPHLVDAIHAAVTRVV

SEQ ID NO: 3831 - protein, 285 aa, Zea mays
MAGEVQSWGRNQNGQLGLGTTEDSLLPQKIQAFESVCVKMIAAGAEHTAAVTEDGDLYGWGWGRYGNLGLGDRNDRLLPEKVSSVEGEKMVLVACGWRHTITVSDSGNLYTYGWSKYGQLGHGDFEDHLVPHKVEALKDSTISQFGQVGVGNNDDHSSPGQVSFPEDQKISQVACGWRHTLALSEKKNVFSWGRGTSGQLGNGEIVDRNTPVLIDALSSDGSACKKLESSTAAPFAAKVWVSPSERYAIVPDENVRKAGGGTARGNGADANVPENDVKRMRVQSS

SEQ ID NO: 3832 - protein, 422 aa, Oryza sativa
GMGMEVAAARLGALYTTSDYASVVSINLFVALLCACIVLGHLLEENRWVNESITALIIGLCTGVVILLMTKGKSSHLFVYREDLFFIYLLPPIIFNAGFCLLEFYSWSIYSAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLLGRAGWVFPLSFLSNLTKKAPNEKITWRQQVVIWWAGLMRGAVSIALAYNKFTRSGHTQLHGNAIMITSTITVVLFSTMVSHLAATYA

SEQ ID NO: 3833 - protein, 211 aa, Lotus japonicus
MAPAKGSSLTPIQVENLQFPASVTSPATAKSYFLGGAGERGLTIEGKFIKFTGIGVYLEDTAVDSLATKWKGKSSQELQDSLDFFRDIISSPSEKLIRGSKLRPLSGVEYSRKVMENCVAHMKSAGTYGEAEATAIEKFAEAFRKVDFPPGSSVFYRQSTDGKLGLSFSLDDTIPEEEAVVIENKALSEAVLETMIGEHAVSPDLKRCSFG

SEQ ID NO: 3834 - protein, 689 aa, Zea mays
  misc_feature (668)..(668): Xaa can be any naturally occurring amino acid
MLQQTVSGEGTVLGSKDMFTNQSTVKPDNVVQKFVTDAQHIPFSKGKKETVRERWVTTNGIQDSVELTKDRVMQAPMSADMCPMPMTHKKKAATTRDFFGHKRMVKAKALGHQQRMFASGSKSKRDDEVASNLKIHDIFREIVLNERNLELYLNSSSGLPSVRCQRQYRYMNADARSRFKMLCRMFEFVCRTLVQTMEQRSLKMRIDNEAAKVMKALPGFTKHGPIVGQVPGVEVGDEFLYRAQLAIAGLHSEYRRGISTTTYRNGMLIAISIVASGGYPDELGCSGELIYTGSGGKSAVKKKDEDQKLKCGNLALKNCIKTKTPVRVIHGFKCRNTDRGSHSGAKLIPKYTYDGLYLVVDFWMDGKPGSRVFKYKLKKIHGQPELPMHIAKRLKSFKSRPGLCMTDISQGKEATPICVINTVDDVQPGPFQYTTRIRYPFGLTEKHNQGCDCTNGCSDSESCACAVKNGGEIPFDLSGAILNEKSVIFECGSSCKCPPSCRNRVSQHDMKIPLEVFRTTKTGWGVRSLWSIPAGSFICEYIGEVQHQKAADKRRNNNYLFDVGLNYDDENVSSVLLSNVSGLNSSSSCSQAMEDVRFTIDASVYGNIGRFINHSCSPNLQAQNVLRDHGDKRMPHIMFFAAETIPPLQELTYDYNNSEIDRVQGVNXNRRMKSKVCQCSSSLCRRRFY

SEQ ID NO: 3835 - protein, 426 aa, Nostoc sp. PCC 7120
MSFSHLGLSNEIINAVTELGYTKPTPIQMQSIPAVLSGRDLLAGAQTGTGKTASFTLPLLHLLSQDSLKSASNASSPIRALILTPTRELAAQVESSVRDYGKYLKLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQAKPEPTQDERKQKPKDSQHQPRSAAQGVPKKSGKKRLTNSGKR

SEQ ID NO: 3836 - protein, 465 aa, Aspergillus oryzae
MAVNGTNGTSKTNGHSVNNGTSAYHAASTQEAIQAESDFAAHNYHPLPVVFARAQGTSVWDPEGRHYLDFLSAYSAVNQGHCHPKLVAALVEQASRVTLSSRAFYNDVFPRFAQFVTQYFGFDMVLPMNTGAEAVETGIKIARKWGYKVKGIPENQAVVLSAENNFHGRTFAAISLSSDPESRDNYGPYLPGIGCNIPGTDKPIAYNDKAALREAFEKAGPNLAAFLVEPIQGEAGIVVPDEDYLQEARALCDKYNALLICDEIQTGIARTGKLLCHEWSGIKPDLVLLGKAISGGMYPVSCVLGRKDVMLTIEPGTHGSTYGGNPLGCAVAIRALEVVQEEQMVERAEKLGHVFRDGLKAINSPMIQTVRGKGLLNAIVIDESKTNGHSAWDLCMLMKEKGLLAKPTHENIIRLAPPLVITDDEIKKSLEIIAEAVSELPTLKGAAEDKVIPPPEKKVKIGVEN

SEQ ID NO: 3837 - protein, 358 aa, Solanum tuberosum
  misc_feature (277)..(277): Xaa can be any naturally occurring amino acid
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYAAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVAPEVIAEYTVRALQRTMPAAVPAVVFLSGGQSEEEATRXLNAMNKLQTKKPWTLSFSFGRALQQSTLKAWSGKEENIGKAQAALLTRCKANSEATLGKYAGSSNLGDGASESLHVKDYKY

SEQ ID NO: 3838 - protein, 668 aa, Aspergillus oryzae
MVAGISKRQQLRNERALQDLVRSVPGNDRCADCQAMNPGWASWNMGIFLCMRCAALHRKMGTHISKVKSLSMDSWTAEQVDNMKSHGNNLMNKIFNPRNVKPPVPADVDESDACMERFIRQKYQHRTLEEGKPKPPSREGTRRDDRSPEGSPPPLPPKPARPHGLGLRSASSTTSLHRLSNRQAASSRFEAYESPRSVSQGMGASVGNSNASHESQMATLRSMGFTNEYRNSAVLKGLDGNLDKSIETLVRLGEGPPSLQGGTRVQTTTANDAARQQASSNPFDQLDSKPAQPSGQSYNPFDVPTPQPAAQTLEASFQNLQVSQPLFPHSTGGYPNQQPSFPQPLYQQPITPPVMPTISQGAVVQSPQPVDGGQNPFFQSGSFTSTPNQTPGLAQPQTNPFFTQPPSQLNSMQTPSQAPAGYPHPPRHANTMPAISSTSPFGTASPFQQQQQQQQQIQPPQLQVQPPQQMQPSHNPFQPMTAPPTPQSAGYQVQSQLGLQAPAQHLAPQPTGRIDKNSILSLYGLSPPPSATSEYSQPPNPAGAFPGPGTAPAPAPGYATTTQPQQPTDPHSAGTRNPFLTSQAPAAGLPQQQQQQAYLQQPQLQPQPQYTTTSPFTMPVKSNTMPPAAPSAFPRPQGHMSQQSVDINAFQNGRHSPDAFASLSARYG

SEQ ID NO: 3839 - protein, 285 aa, Pseudomonas fluorescens Pf-5
MKSYPRPPFPAQQQAVPGTQAAMAPYPDCGEQSYQGSGRLAGKIALVTGADSGIGRAVAIAFAREGADVALAYLDEHDDAHETARWVEQAGRQYLLLPGDLAGRQQCHDIVAKTVEQFGRIDILVNNAAYQMTHHELADISDDEWVRTFDINITAMFRICQASVPHMAPGSSIINTSSINSDAPKPTLLPYSTTKGAIANFSAGLGQLLGPAGIRVNSVAPGPIWTPLIVSTMPSEAITHFGEQTPLGRPGQPVEVAPIYVLLASDEASYISGSRIGVTGGKPIL

SEQ ID NO: 3840 - protein, 616 aa, Arabidopsis thaliana
MSDLYIHELGDYLSDEFHGNDDGIVPDSAYEDGGQFPILVSNRKKRRNDDMGSGTNHLKSNTFIKREANMLGKNPWPEKDSGGSSVSRDTGTGKDVQDMTLEDTNTSDHGFNGGHVDVVENFSTGDPMLCDTSAATNDGVYNYSLNSIPDAENDLSFFDNGDKEKNDLFYGWGDIGNFEDVDNMLRSCDSTFGLDSLNNEGDLGWFSSAQPNEETAGAMTDDLKPDKMLENQRTAMLQVEDFLNNSEPNHAVEDEYGYTIEDDSAQGKSSQNVFDTSLQKKDILMLDVEANLEKKQTDHLHHLDGKSDGFSENSFTLQHSGISREIMDTNQYYPPSAFQQRDVPYSHFNCEQPSVQVSACESKSGIKSENKPSPSSASNESYTSNHAQSIESLQGPTVDDRFRKVFETRANLLPGQDMPPSFAANTKKSSKTDSMVFPDAAPIQKIGLENDHRKAATELETSNMQGSSCVSSVVDDISLEATSFRQLQQVIEQLDVRTKLCIRDSLYRLAKSAEQRHHGGNRPEKGAGSHLVTGEADKYAGFMDIETDTNPIDRSIAHLLFHRPSDSSLSSDNNVLSYKSHPMIPQPNSSPSLRIEKQEETTELRPEAEVVTSDNN

SEQ ID NO: 3841 - protein, 301 aa, Solanum tuberosum
MASQVIREWVGFQQFPSATQSKLIELIRKLKQESVSTLTILVMGKGGVGKSSTVNSILGERAVAVSAFQSETPRPVMVSRSWAEFTLNIIDTPGLVEGGYVNDQALDLIKRFLLNKTIDVLLYVDRLDTYRVDNLDRQIVKAITDSFGKEIWHRGLVVLTHAQVSPPDGLSYDEFTSRRSEALSKIVRLGARIRKQEVKASSVPIVCVENSGRCNKNELDEKILPNGTAWIPNLLQTITEVVASESKGILVDQKLIEGPNPNNKGKLLIPLIAAFQYFFVVKRIQKWIKNDIARETRPSWA

SEQ ID NO: 3842 - protein, 445 aa, Pseudomonas fluorescens Pf-5
MTFTIWVAVLGTVLLILALTSSYLRWLPITTSVVCLALGVIIGPAGVGLLQLDIRKAADWMESLTEVALLFSLFVSGLKLRLPLADRSWWVAFGLAGPVLGLGILGVALVLHVLLDLDWSFALLLGAILAPTDPVLASMVQVNDAQDHDRVRFGLSGEAGLNDGVAFAFVILGVLLLKQDSAPQHWLADWLLYGMLWAIPAGLLCGYGLGHGLGRLTLRLRTRHADSSVSPNDYLSFALIALAYVVAELVHGYGFLSVFAAGLGLRQAEVHANSASHPPAEHLVQPVVGHLHGDPGQSVHGDVQALEERQVAAGIMLGDMLSLGSLVERAMEVFIVTLLGVVLPAHWDWRGLLLGALLFLVVRPLSVLAMPWGTLLDRHQRLLLAWFGIRGIGSMYYLFYALNHQLEPAQATLSIQLTLSVVALSILVHGLSTQPLLQHYQRRHR

SEQ ID NO: 3843 - protein, 303 aa, Zea mays
  misc_feature (62)..(62): Xaa can be any naturally occurring amino acid
  misc_feature (188)..(188): Xaa can be any naturally occurring amino acid
  misc_feature (267)..(267): Xaa can be any naturally occurring amino acid
MAEHLASIFGTEKDRVNCPFYFKIGACRHGDRCSRLHNRPTISPTLVLANMYQRPDMITPGXVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGXRSASRRYHGRSRSRSPPPQRRGHRDRDDYHHRDRDDYRGGGGGGRGRGSRYDRYDDGAGRGGRHGRGGRHDRYDDGGRXRRHGSPPRRARSPVRESSEERRAKIEQWNREREGKQ

SEQ ID NO: 3844 - protein, 166 aa, Oryza sativa Indica Group
MATTRPARSDPHLPPEEAARVEAEVRGYFDSMAPRRPSKPPRSDPSDAGEGGAEADADADLPELRRLRDLEAKPQKLVLDGGDVNGEEYVETQYYNGLNCIDKQHHTTGTGFIKVERPNDSSFNVTTVAYSSDSIVRCTSNPATNDWIPSSETVIPVSNKPSRSDS

SEQ ID NO: 3845 - protein, 395 aa, Mycobacterium sp. MCS
MSGAHAQRTEPRDVALRAGIPPFYVMDVWLAAAERQRTHGDLVNLSAGQPSAGAPTAVREAAIAALQENQLGYTVALGIPELREAIAARYADQFGLTVGLDDVVLTTGSSGGFLLAFLACFDVGDRVAIASPGYPCYRNILTALGCEVVEIPCGADTRFQPTAAMLAELDPPVQGVIVASPANPTGTVIAPAELAAIATWCEATGTRLISDEVYHGLVYDGAPPISCAWQTSRKAVVVNSFSKYYAMTGWRLGWLLVPQELRRAVDRLTGNFTICPPALAQHAAVAAFTPESTAEADGLLAHYAENRRLLLDGLRAIGISRLAPADGAFYVYADVSHLTDASLSFCAKLLADTGVAIAPGIDFDTVHGNSFVRLSFAGPTADITEALSRIGGWLR

SEQ ID NO: 3846 - protein, 355 aa, Oryza sativa Indica Group
MQARVVVFPVKGRAWCFASPRATAPAAACGGGDGGALLPPPPPTVKDLWRGIAGGGRTASENAEAVVDFVADKVLDSTGSAFSSLALTAFSHAARIWGVSDGGVLAAADEPGVDRVRERAGGVDEEPDPQVGSLRAEAALAGAAVGGAAQVGDQGRLPTRDRASGKLVAACFLNLCACSVTVKCINPRLVRRRLRHIAVSSIYIFPHPSVSAMFLRTRGASVHRKFLYGSVCLLPVTSVFMVLPLPNIPFFWVLFRAYSHWRALQGSERLQLLVSDSSDQWKILLEKQKEMSSRKDGNPCENTQYAPWNLQPSKKLDGFLESRKLNEGLDCDTISRICQAYDLDKIDVLKYRDLE

SEQ ID NO: 3847 - protein, 246 aa, Thiomicrospira crunogena XCL-2
MLSGKIAFVTGASRGIGKAIALDLAASGATVIGTATSEKGAQAISDYLSAAGAKGTGKCLNVTDADMIASVLSEVTKEFGTPTILVNNAGITRDNLLMRMKDEEWDDIIDTNLSSVYRMSKACLRGMMKAKQGAIINIASVVGVMGNAGQTNYAAAKAGIMGFTKSLAREIGAKNVTVNTVAPGFIDTDMTRALPEEQREALTQQIPLKRLGEPEDIAKTVTFLASEGGSYITGQTLNVNGGMYMI

SEQ ID NO: 3848 - protein, 78 aa, Thiomicrospira crunogena XCL-2
MSSIEERVKKIVVEQLGVEEDQVTADASFIDDLGADSLDTVELVMALEEEFDCEIPDEEAEKISTLAQATSYVEANLD

SEQ ID NO: 3849 - protein, 57 aa, Glycine max
  misc_feature (29)..(29): Xaa can be any naturally occurring amino acid
  misc_feature (34)..(34): Xaa can be any naturally occurring amino acid
AVVCNPLLKSGFSLIQQFMILTFGSLSNXNPILXGVLLLIVSAFLASSKFLDTQFTA

SEQ ID NO: 3850 - protein, 547 aa, Clostridium perfringens ATCC 13124
MAYKALYREWRPQTFNDVVGQEHITTTLKNQIINERTAHAYLFCGTRGTGKTSTAKVMAKALNCLDLKDGEPCNQCEMCKKINEGLAIDITELDAASNNGVDNIRDIIDDVQYPPQEARFKVYIMDEVHMLSIGAVNAFLKTLEEPPKNVVFILATTDPQKLPITILSRCQRFDFKRISRKDITGRLRKIVTEQGIFCDDKSLDLVARVSDGAMRDSLSILDQAISIGDGKVDYDELVSMLGLVTNDNLFKIVDSIIKRDIESAMEIIEELVLTGKDMTLFIKDLIVHYRNLLMIKVTSNPEEVLDTAEENIEKLKVQGAKLKVEEIMRCIRIVQECDEEAKLSKQARVYLELAVIKMCKIEYDTSKEVMLARINKLEQAIRSGNIQVNTNLEEVKSQVSNEASNNKTLNNKQQNVTQSSNNYEVVNENSTLTPEYLRKVWKDILETFKSRGKYMVYIALAKGISKVSCNKGVVEFRYTYEYRHNKERLEKHDFSKIVNDIFSEVLKEPVRVVYSVEQGTEEEKAEEADLEARLSGIMGDGLEIVEE

SEQ ID NO: 3851 - protein, 174 aa, Yersinia pestis KIM
MAKQNGEDLIMRRRILSVLLENESGALSRVVGLFSQRGYNIESLTVAPTDDPTLSRMTIQTVGDAKVLEQIEKQLHKLVDVLRVSELVSGSHVEREIMLVKLQASGYGREEVKRCAEIFRGQIVDVTATLYTVQLAGTSEKLDAFLNAVREVAEIVEVARSGIVGVSRGDKIMR

SEQ ID NO: 3852 - protein, 588 aa, Oryza sativa
  misc_feature (565)..(565): Xaa can be any naturally occurring amino acid
MASAAAPKRCYYEVLGVPRDCSPADIKLAFRRLALSLHPDKQPPGSDVAAATAAFQELQHAHSVLSDPHERSYYDSHRSQILFSDHHPSSGPGRGGGVASASASPVPDLFAFFSSSAFSGFSDSGRGFYKVYGDVFDRVFAQELAYARRMGMPADAVPTPPVIGNLDSPHAQVAAFYSYWLGFGTAMDFGWAAEWDAARGESRRVRRLMEEDNKKATRKARREYNDAVRGLAAFCKKRDKRVVDMALKKKVEEEKRKAEEAARKKEEERRRKERAMAYQEPEWARVDEDEAAVFEDDEEEETRAKRKEELYCVACNKKFKSDKQWKNHEQSKKHRDKVSELRMVFEEEEEALKDAEEEEPEEVDVGFDFQPAQESEESEFSDAAEELADELSEGLEVRDEEEKGDKHLGNGEQKVGSYDETSVLEEMLSRSRRKNRKSGFVAPQEEASPAGAMDDDDDEDTSYEINNVKKKGRRRRAAKKGGTYADNGQGRKSENQPEESRHNNDENGADDKMEGPSSNEDSAAASKEDQQKGKTGNTKKNKKGTEKNTTISSEQKGTSKGKKQXRNKLFSHLEETGHAMLKTRQKNR

SEQ ID NO: 3853 - protein, 363 aa, Petroselinum crispum
MVSCLGDKDGNANGLGFLFLLALSLLFISSQLYVSATYSTVPAVKGLEYNFYHSSCPKLETVVRKHLKKVFKEDVGQAAGLLRLHFHDCFVQGCDASVLLDGSASGPSEQDAPPNLSLRSKAFEIIDDLRKLVHDKCGRVVSCADLTALAARDSVHLSGGPDYEVPLGRRDGLNFATTEATLQNLPAPSSNADSLLTALATKNLDATDVVALSGGHTIGLSHCSSFSDRLYPSEDPTMDAEFAQDLKNICPPNSNNTTPQDVITPNLFDNSYYVDLINRQGLFTSDQDLFTDTRTKEIVQDFASDQELFFEKFVLAMTKMGQLSVLAGSEGEIRADCSLRNADNPSFPASVVVDSDVESKSEL

SEQ ID NO: 3854 - protein, 498 aa, Oryza sativa Japonica Group
MAACVDDVGKPRASRKVCVIGAGMAGLAAARELRREGHAVTVLEQAGDVGGQWLYDDPRADDDDEDPLAAAAAAAKPVRVHSSMYASLRLLGPREVMGFSDFQFVPARKSRCGGGDNPGGRDPRRFPGAPRGLTPGWCAVAVAPPPCRGGPGDALRWVVRSMDAGLWKRCTDDQMAEAHCVEEVFDAVVVATGHYSQPKLPSIQGMGDWKRRQMHSHWYRVPDSFRDEVVVLVGCGDSGMDIALDLLAVAREVHLSAKSVEAAATPAMSKMLARHANLHLHPQIERLCDDGRVVFADGGGGVVAADTVMYCTGYRYSFPFLDTEGKVAVDDDDNRIGPLFEHTFPPSLAPSLSFVGIPRKVMVPWFFEAQGRWIAGVLSGRRALPSEEEMTRSVEEFYRARELAGVPKAHTHDVEPHKMYELGEKYCDFPRTEEWKRELMAIISRNTSDDMETFRDRDDDSDNVRRCLQEWYALAEHQAQDEEDPAAAAAQAPVHSSL

SEQ ID NO: 3855 - protein, 506 aa, Shewanella oneidensis MR-1
MIYAQPGTAGALVNFKEKYANFIGGKWVAPVNGKYFDNRSPVNGQNFCKIPRSDAQDIELALDAAHAAKDAWGKTSVTERSNILLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGVLNVVNGFGAEAGQALATSKRIAKLAFTGSTEVGFHILKCAAESLIPSTVELGGKSPNLYFADVMDQEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRMGRGIQAGRVWINCYHAYPAHAAFGGYKKSGIGRETHKMMLNHYQNTKNLLVSYDINPLGFF

SEQ ID NO: 3856 - protein, 430 aa, Shigella flexneri
MSYTKLLTQLSFPNRISGPILETSLSDVSIGEICNIQAGIESNEIVARAQVVGFHDEKTILSLIGNSRGLSRQTLIKPTAQFLHTQVGRGLLGAVVNPLGEVTDKFAVTDNSEILYRPVDNAPPLYSERAAIEKPFLTGIKVIDSLLTCGEGQRMGIFASAGCGKTFLMNMLIEHSGADIYVIGLIGERGREVTETVDYLKNSEKKSRCVLVYATSDYSSVDRCNAAYIATAIAEFFRTEGHKVALFIDSLTRYARALRDVALAAGESPARRGYPVSVFDSLPRLLERPGKLKAGGSITAFYTVLLEDDDFADPLAEEVRSILDGHIYLSRNLAQKGQFPAIDSLKSISRVFTQVVDEKHRIMAAAFRELLSEIEELRTIIDFGEYKPGENASQDKIYNKISVVESFLKQDYRLGFTYEQTMELIGETIR

SEQ ID NO: 3857 - protein, 325 aa, Oryza sativa Japonica Group
MLLMNSALSESDPSSVWIGLVKDGKEVKAVVSPGAAAGANSGSPILASPHPPLPRRRAEIRTREGDPEDFKEDSVGASQDVGSSDHESPLHSPVSYNPPIGCLQQKHCSGNGGGRSFSSGSSAWSSSRSVTDSDDDTGGSPENDDDGVLDDWEAVADALSVDDNHNHQDPVPADPPVVPASCPVPANAATRQEPIKSSTRAWSPDDAFRPQSLPSLSKQVSFPASMGNCWVAMGIGSAQKGVPSKPTSCPICYEDLDPTDSSFLPCPCGFHLCLFCHKRILEADGRCPACRKQYISASSGGETVGSEREMGNLRLSRSCSMGPRY

SEQ ID NO: 3858 - protein, 457 aa, Geobacillus kaustophilus HTA426
MKITIAGAGYVGLVTAACLADKGHDVICVDVNEEKIRRLNEGIVPIYEPGLEPLIQRNSARLRFTTDDAEAYRWAEVIMVAVGTPPLPDGSVKLDDVWETLRRIAASAERDCLVAIKSTVPVGTGDEAARFLAEHGRGGVRIDVVSNPEFLSQGTAVRDTLQAPRIVLGVESERAERIMKDLYAPFALPYVVTDRKSAEMIKYAANVFLALKISYINEIANVCELVGADIQAVAEGIGMDPRIGRRFLRAGVGYGGSCLPKDTKALYALAASHGYSLKTVWAAMDVNEKQKWKLFEKARAHLGVFSGRTAAVLGAAFKPGTDDVRESPALANIERLIAEGADVRVWDPAALGHVSRRFGDAVVCCETMEEAIRGADVCFIFTEWPAVLQFDLHRYKTLMNRPIVLDGRNCYDPKQADAAGLIYESIGRPVGHRQLKVDRAVDVLQCASAAFFHKQSE

SEQ ID NO: 3859 - protein, 194 aa, Brassica napus
FALSFGVPGWDKEKEAVMATVLQMLMGGGGSFSAGGPGKGMHSWLYLRVLNQYQEFQSCTAFTSIFNNSGLFGIYGCTSPEYAAKGIELVADEMKAVAEGKVNQKHLDRAKAATKSAILMNLESRMIVAEDIGRQILTYGERKPVDAFLKTVDQLTLKDIADFTSKIIAKPLTMGSLGAVLNVPSYDSVSSIFS

SEQ ID NO: 3860 - protein, 288 aa, Solanum tuberosum
MAENKEEDVNLGANKYRETQPLGTAAQTDKDYKEPPPAPLFEPGELSSWSFYRAGIAEFMATFLFLYITILTVMGLKRSDSLCSSVGVQGVAWAFGGMIFALVYCTAGISGGHINPAVTFGLFLARKLSLTRAVFYIVMQCLGAICGAGVVKGFMVGPYERLQGGANFVNPGYTKGDGLGAEIIGTFVLVYTVFSATDAKRSARDSHVPILAPLPIGFAVFLVHLATIPITGTGINPARSLGAAIIYNKDEAWDDHWIFWVGPFIGAALAAVYHQIIIRAIPFKSSRS

SEQ ID NO: 3861 - protein, 321 aa, Oryza sativa Japonica Group
MGVAAAAGRLLAAVDWEREAYPAYRDFFALPLFAVFFLVVRYLLDCFVFEWLVREYNGLRFKWIGRKLIFGKEKVDYEKEETRKKIRKFKESAWKCVYFLSGEILSLSVTYNEPWFTNTKYFWVGPGDQVWPDQKIKWKLKAVYMYAAGFYTYSIFALMFWETRRSDFGVSMSHHVATVALIVLSYVFRFARVGSVVLAIHDASDVFLEVGKMAKYSHCDLLANVAFLLFVVSWVLLRLTYFPFWILRSTSYEVLLTLDKKKHNFDGPIYYYVFNSLLFSLLVLHIYWWVLIYRMLVRQIKTRNVGDDVRSDSEGEDEHED

SEQ ID NO: 3862 - protein, 419 aa, Solanum tuberosum
  misc_feature (278)..(278): Xaa can be any naturally occurring amino acid
  misc_feature (284)..(284): Xaa can be any naturally occurring amino acid
  misc_feature (384)..(384): Xaa can be any naturally occurring amino acid
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHXLSLTEXLCGFQFILTHLDNRQLIIKPQPGEVVKPDQFKAINDEGMPMYQRPFMRGKLYIHFTVEFPDTLSPEQCKNLEAVLPPKPKTQMTDMELDECEETTLHDVXIEEEMRRKQQQAQEAYDEDDEDMHGGAQRVQCAQQ

SEQ ID NO: 3863 - protein, 504 aa, Yersinia pseudotuberculosis IP 32953
METKDLIVIGGGINGAGIAADAAGRGLSVLLLEAQDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNAQEVVKHGGEVRTRTKVTRAWREQGLWMVEALDVNTGKTFTWRAKGLVNATGPWVKQFFDDGLKLKSPYGIRLIKGSHIVVPRVHNQPQAYILQNEDHRIVFVIPWLDDYSIIGTTDVEYHGDPKEVKIDDQEMTYLLKVYNDHFKKQLGRDDIVWTYSGVRPLCDDESDSPQAVTRDYTLDVADEAGQAPLLSVFGGKLTTYRKLAEHALEKLSAYYPNVGPAWTKTGALPGGDIGGSRDSYTVQLRHRYNWLPEGLARRYTRTYGSHSELILANATRLESLGEHFGHGLYEAELRYLVENEWVVELDDAIWRRTKLGMALSDEEKQRVAQWLADAHTEKQQALPLVS

SEQ ID NO: 3864 - protein, 564 aa, Robiginitalea biformata HTCC2501
MSDDKKVIFSMSGVTKTYKNANTPVLKDIYLSFFYGAKIGILGLNGSGKSTLLRIIAGEDSNYQGNVVFSPGYTVGYLEQEPHLDDDKTVLEVVREGAAETVRILDEYNKINDMFGLPEVYEDADKMQQLMDKQAKLQDQIDAAGAWELDSKLELAMDALRTPEPDKKIGVLSGGERRRVALCRLLLQEPDVLLLDEPTNHLDAESVHWLEHHLAQYKGTVIAVTHDRYFLDNVAGWILELDRGEGIPWKGNYSSWLEQKAKRLAQEQKQASKRQKTLERELEWVRQSPKGRQAKQKARLNNYDKLLSQDQKQLDEKLEIYIPNGPRLGTQVIEAKGVSKAYGDKLLYEDLNFRLPQAGIVGVIGPNGAGKTTIFRMIMGEETPDKGNFEVGETVKIAYVDQSHADIDPDKTIWQNFSDSQELINMGGRQVNSRAYLSRFNFSGSEQNKKVSMLSGGERNRLHLAMTLKEEGNVLLLDEPTNDLDVNTLRALEEGLDNFAGCAVVISHDRWFLDRICTHILAFEGNSQVYFFEGSFSDYEENRKKRLGADSIPKRIKYKKLVRD

SEQ ID NO: 3865 - protein, 302 aa, Picea sitchensis
MKVEDTHLENGNVGVIKSKKKKKKKKKKKEEGKNKSEQGTSDDLALSSAAEAAEDIVINANEGTLPQSQESNYDECKVYVGGIPYYSNEDDIRSFFEGCGTVTEVDCMTFPDSGKFRGIALISFKTKAAATRALALDGADMGGRFLKIQQCRTHRSSKNDKPAGFVPTKVDKSNRAYIGNLAWDIAEDDLKVVFGDCKISAIRLGKDKTTGEFKGYGHIDFADEVSLAMALKLDQTVVCGRPIKIAYAIPKRDAETDDSAKTKSSTEKKKRRTCYHCGMPGHLSSSCPHNQSAENVGSKEGS

SEQ ID NO: 3866 - protein, 381 aa, Rickettsiella grylli
MAKKTDYYETLGVSRHATDSELKKAYRKLAMKYHPDKHHAAETQQAKEAEEKFKAISEAYDVLSDSKKRAAYDQFGHAGVESTGTSGNAQGFNFNDVFGDIGDVFGNIFGNRGGPQQSQRAQRGADLRYTLELDLESAIHGTTVQIRIPRLVTCKSCQGSGARKGTKPIVCKTCGGQGQVRIQQGFLTIQQTCPECHGEGRIITTPCPDCRGQGHVQETKTLAVKIPAGIDEGNRIRLAGEGEAGHRGAPAGDLYVQIHLKPHPLFKREGNNLYCDVPIHLTLALLGGDIQIPTLTGIVNLHIPPETQSGKVLRLRGKGVPGRPGGTGDLLCRVSVETPVHLTKAQKELVIALENALKNGNHYPKAKIWFEHVKKFFSKQY

SEQ ID NO: 3867 - protein, 428 aa, Yersinia pseudotuberculosis IP 32953
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENANEDSARFYRSEGGVVLVTRDMLAKLEAK

SEQ ID NO: 3868 - protein, 213 aa, Zea mays
MAATTDRSRMQAAALVLTLLALLPPSILGARTRPPSPPHHSQGGHKRSPPPPASLPPPPPPPPPPPPAADAGLVRATCNSTAYYDLCVSTLGADPTSATADVRGLSTIAVSAAAADASGGAAAADALATAAGNTTATPVDATTRALLRSCAAKYGEARDALAAAEYPQVCRVLFQRQRPADYPPELADREEPLRRLCTVALDIITLLANNDTN

SEQ ID NO: 3869 - protein, 139 aa, Methanosarcina barkeri str. Fusaro
MANFKVVVSDPKEGRAYQIDVKDAEANALIGKSIGDVVDGAVFGLSGYKVKITGGCDGSGFVMKPDLLGPRRQRILMAVGVGYTPKHPGQRRRKMVRGKEVAPDIVQINAKVVEYGSKSIKALLGLEAPAEAPAEAPAE

SEQ ID NO: 3870 - protein, 371 aa, Sulfolobus tokodaii str. 7
MKFHEDFRNLVPVTKEYVYLNHAAISPIPLPILYESLRYLLDISRYGSLPVNDEENDDFYHLREKVGKLINAEPDTISFIPNTSFGINIIAHGLDLNEGDEIVTDSLEFPAVTYPFFKLKKKNIKIVIVKPRLENFEDDLLSSISKKTRLIAISHVSFNTGVKLDIKKISKEAKSVGAYTLVDIIQSAGATEVNVKDFDIDFAVAGGYKWLMSPQGSGFMYVKKGLIEDPPFYGWRSSSNYLDFNSENFMLEKGPRRFEIGTIDVAANIALAKSCEIVSQHKDEIYPRIQNLTDFVIKYAEEQGLEVITPKNKKAGIVIIKTNNPKELSRRLLEKKIVVSPRGNGVRISTHFYNLEDEVKIAIDEIRKLAF

SEQ ID NO: 3871 - protein, 149 aa, Methanosarcina barkeri str. Fusaro
MEQTYVMVKPDGVQRGLVGEIISRIEKRGLKIVALRMNVISEATAKEHYSEHAAKPFFPGLVGFITSGPSVSMVVEGKDAIRVMRAINGATNPVDAAPGTVRGDFALDVGRNVVHASDSPEAAAREIAIHFKDSEIGNYSRIDEVCLYE

SEQ ID NO: 3872 - protein, 285 aa, Zea mays
MAEHLASIFGTEKDRVNCPFYFKIGACRHGDRCSRLHNKPSISPTLLLCNMYQRPDMITPGVDAQGNPIDPERIQEDFDEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYYYYNYRSGSGSRRSSERHRSHDSDGSRRRRGRSRSRSRSPVREGSEERRAKIEQWNREREAAQV

SEQ ID NO: 3873 - protein, 329 aa, Vitis vinifera
MAEQDNCVHTPGAFRKRASDECPQSTTTKKRVVLEDITNSPNNELIQNSDRESQKPKRGIRRTGGCSSIMYQHLHALEMEEKRRARPDYMEKVQNDVTPNMREILVDWLVEVAEEYKLVSDTLFLCISYIDRFLSSHALRRDKLQLLGVSCMLIASKFEEISPPHAEDFCYITDNHYTAEEVVNMERDVLKFLNFEKVAPTTKNTLNVFPLLSMARLLFFEALSWYLAELSLLDYGCLQFLPSMIAASSIFLARFTLEPNKHPWSLALQRYSGYKPSELKECVLLIHSRQLNRRGNSSLRAIRQKYLQPMVSLPQFISNIHVDIANSAS

SEQ ID NO: 3874 - protein, 126 aa, Zea mays
IAAMLSTILYSRRFFPYYVYNIIGGLDEEGKGAVYSFDPVGSYQRDSFKAGGSASAMLQPLLDNQVGFKNMQNVEHVPLSLDRAMRLVKDVFISAAERDVYTGDALKVCIVTKEGIREETVPLRKD

SEQ ID NO: 3875 - protein, 120 aa, Methanosarcina barkeri str. Fusaro
MAQLAKFDVPEELTNKALEALELARDTGKIKKGTNEATKAIERGNAKLVLIAEDIEPAEIIAHIAPLSEEKKAPYIFIKNQKELGAASGLGVSCATVAIVDAGKAGEMVQDIAQKLEALK

SEQ ID NO: 3876 - protein, 527 aa, Brassica napus
MHSSHLLLEEPIRMASILEPSKSSFFPALTKIVGTLGPKSRSVETLSGCLKSGMSVARFDFSWGDAEYHQETLDNLKIAVKSTKKLCAVMLDTVGPELQVINKSGKAITLKADGLVTLTPSQDQEASSEVLPINFNGLAKAVKKGDTIFVGQYLFTGSETTSVWLEVDEVKGDDVICLSRNAATLAGSLFTLHASQVHIDLPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMSHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKQAGVIKSHDRVVVCQKVGDASVVKIIELED

SEQ ID NO: 3877 - protein, 430 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPLEKVCVALGFTVTYMLIHATLYLL

SEQ ID NO: 3878 - protein, 180 aa, Prochlorococcus marinus str. MIT 9515
MLNKNKIFKRFYLNIPNILTISRLFLVFPLILFLELTKTKFVFALIVLGGITDYYDGFFARKLNLKTKFGAILDPLSDKIFLLIPLIWLCKIKLIPFWSLSIILFRELIISALRTRIKDGLPASQLGKYKTVSFFISLLLFFLPFEIDSFSNLGIIFYWLGFILSLITLIDYLRAKKNFI

SEQ ID NO: 3879 - protein, 335 aa, Fulvimarina pelagi HTCC2506
MAVRVAINGFGRIGRNILRSIVESGRTDIEVVGINDLGPVETNAHLIRFDSVHGRFPGEVKVDGETIDVGRGPIRVTAERDPKNLPWGDLDVDVALECTGLFTARDKAAAHLDAGAKKVLISAPGTDADLTVVYGVNHDKLTAEHKVVSNASCTTNCLSPVAKVLHEAIGIEKGMMTTIHSYTGDQPTLDTMHKDLYRGRAAALSMIPTSTGAAKAVGLVLPELDGKLDGFAMRVPTPNVSVVDLKFVAKRSTSVDEIKNAIKAAADGPLKGILAYTNEKNVSIDFNHDPHSSIFHMDQTKVMDGTLVSVLSWYDNEWGFSNRMSDMAIALHNAG

SEQ ID NO: 3880 - protein, 600 aa, Fulvimarina pelagi HTCC2506
MLEDLYLVILVGTVLVLLAAFSSLLASRFGTPLLLLFLSVGLIAGTDGLGLEFDNAGLAYFIGTLALAVILFDSGFQTPISTFRQAAAPALTLATIGVLGTSILFGIAADWLLGIGLFEGMLLGAIVGSTDAAAVFFLLKTSGIVLRDRIRSLLEIESGTNDPMAIFLTIALVELLSTGGGFEQLGLSVLLGFVQQMGLGLVAGLLGGRGIAFFIAKLSVDRGLLPILILALSIAVFALTGALGGSGFLAVYVAGLYAGNAGLKRAPSIRRFQEGMTWLAQIIMFLILGLLATPRNFDAILIPGIILALFLIFIARPVAVSMCLWPFGFRRRETLFVSWVGLRGAVSILLAILPILGEIEGSYAFFNIAFVIVLTSLLLQGWTLASVARWLRLTVPPRIGPVEKFELELPGAADHELLSYRVVEGSPVATGSRVPRWARPSLVIRNGRSMRYQYAGRLQPGDHVYLFISPRFPPLLDRLFASRTPVAEDDEEFFGEFTVNPDSQASSLAEAYGFELDDTENEMTIAEVMSRRLGGYPSYGDRAPIGPVELIVRETDADGVIVSAGLSLSPPDDTLLTFLRTTGSGRSALGRLFKGTRSKD

SEQ ID NO: 3881 - protein, 542 aa, Robiginitalea biformata HTCC2501
MDEKFNKNEDQNRLKLSELRKRYARIRKGGGDKRIEKLHADGKMTARERIEYLLDNPEEAIEIGAFAGYNMYEEYGGCPSGGVVVKIGKVAGRLCVVVANDATVKAGAWFPITGKKNLRAQEIAIENRLPIIYLVDSAGVFLPMQDEIFPDKEHFGRIFRNNAVMSSLGIPQVAAVMGSCVAGGAYLPIMSDEALIVEKTGSIFLAGSYLVKAAIGETVDNETLGGATTHCEISGVTDYKAKDDKDALDRIRKVFDKMGSRDSAGFDRAEPKKPAEDPQTLHGVLPASRSEPYDMVEIIRRLTDGSEFEQYKEGFGKSLLCGYARIDGWAVGIVANQRKVTKTAKGEMRIGGVIYSDSADKATRFIANCNQKRIPLVFLQDVTGFMVGSKSEHGGIIKDGAKMVNAVSNSVVPKFTVIIGNSYGAGNYAMCGKAYDPRLIVSWPGAELAVMSGNSAAKVLLQIETAALKKKGETITPEKEKELFEKIKKRYDEQISPYYAAARLWTDAIIDPADTRHWISTGIEAANHAPIERDFNMGVLQV

SEQ ID NO: 3882 - protein, 383 aa, Thermotoga sp. RQ2
MNQRISGGHLWIFYNEILKVEGEYENGSVVDVFRPDGSFFGKGYINDNSKIRVRILTWKNEVIDRNFIKNRIESALKRKKKLVKETTAFRVVHSEGDFLPGLIVDLFGDYLVFQITTLGMEKMKDWILDSLIEIFKPKGIYEKSEGTFREKEGLDNREEWVYGKGPELIEFEMNGFKFLADTRGQKTGFFLDQRENARMVMDLAEGKVCLDVFSYTGNFAVHLLKGGAKHVTLVDYSERALEVAREILKLNGFDSSRYDLLPGNAFDILKSFDREGRKYDLVVLDPPSFAKSSSNLESARRGYKEINLRAMRILKKPGVLVTSSCTQIVSEELFREILFDASFDTKTSLTVLRRGGQPPDHPVLMNVPETQYLKFYILQVDKR

SEQ ID NO: 3883 - protein, 535 aa, Aspergillus oryzae
MPDTKALEEGPRRADGVSQLYEGNVFDATPEDRRQIGVVSASFLIFNRVIGTGIFATPSTILSLAGSVGLSLFMWVIGTVIAMAGTAVYLEWGTAIPKNGGEKNYLEYVFKKPKFLITCMYASYVMLLGWAASNSVVFGEYILNAADVEVDRWNQRGIGLACISAAFLIHAFALKWGLHLQNFLGVVKLVIIVFVVVCGFVALGGHMKIDNPPHNFRNAFEGTTNSGYGIVMSLYNVIWSFIGYSNANYALSETKNPTRTLKIAAPIAIGSVGVLYMLCNIAYFAAVPREQFLSSGQTVAAVFFGNMFGPRAEKVMSVFVALSAFGNVLSVIFSQGRIVQELGREGVLPLSKFFASNKPLNAPAAGLFEHYIVSIIILLAPPPGDAYNFLVNLISYPLAIINVFVSGGLVYVYFTHKTKFPDWNPGIRATLPVTIFFCLSNVYLVVAPYVPPSAGQSVYEELPYYLHCVVALGIFAAGGIYYLVWAVLLPRLGNYVLVKETVVDADGWSRSVISRLPLAEAEIRQAQWQQEQQHS

SEQ ID NO: 3884 - protein, 112 aa, Chlamydomonas reinhardtii
GGSVIVIDSKAAWDAQLAKGKEEHKPIVVAFTATWCGPCKMIAPLFETLSNDYAGKVIFLKVDVDAVAAVAEAAGITAMPTFHVYKDGVKADDLVGASQDKLKALVAKHAAA

SEQ ID NO: 3885 - protein, 359 aa, Glycine max
  misc_feature (74)..(74): Xaa can be any naturally occurring amino acid
MSHFKGKYHDELIANAAYIGTPGKGILAADESTGTIGKRLASISVENVESNRRALRELLFTAPGALKYLSGVIXLFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 3886 - protein, 472 aa, Staphylococcus aureus subsp. aureus MW2
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLISLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 3887 - protein, 349 aa, Zea mays
  misc_feature (140)..(140): Xaa can be any naturally occurring amino acid
MGNCNCSSSSFFSLPKRGSKLLKLNNGMVSVDDEGGTHEGIKTIPVQRACEFTTNSVLCVCIVTWNMNSKMSAEDVAKLESSDGKFDLLVVGLQEAPKPDVSRVLQEALAGTHVLLGQKSMQSLRMLLFGSRSSEKYTRXPMKVVTHAVGGCGGIIGRKKGAVAMHINFSGIRMVFVSCHLAAHEHKAEKRNAEFQHISQSLFARYGAPTPYAQSADITVWLGDLNYRLQGISSTPARKMIEENRQSKLRGRDQLLQEAEKGQVFSGYCEGTLSFKPTYKYDVGGSVYDTSYKVRVPSWTDRILFKVGQSSGLDAVLSSYESLDCVRSSDHKPVKAHLCLKVRSDGDAD

SEQ ID NO: 3888 - protein, 475 aa, Nostoc sp. PCC 7120
MSHEFDYDLVIIGAGVGGHGAALHAVSCGLKTAIIEAADMGGTCVNRGCIPSKALLAASGRVRELRDAHHLKSLGIQIGNVEFDRQAIANHANNLVSKIQGDLTNSLKRLGVDIIRGWGKIAGTQKVTVTGDGGEKTITAKDIILSPGSVPFVPPGIEVDGKTVFTSDQGVKLETLPEWVAIIGSGYIGLEFSDIYSALGCEITLIEALDQLMPGFDRDIAKLAERVLITPRDIETKVGIYAKKVIPGSPVVIELADFKTKEVVDVIEVDACLVATGRIPATKNLGLESIGVELDRRNFIPVDDRMAVLSAGEVVPHLWAIGDANGKMMLAHAASAQGIVAVENIIGRERTVDYRSIPAAAFTHPEVSYVGLTETGAKELGQAEGFEVATSRSYFKGNSKALAENEADGIAKVIYRKDTGEVLGVHIFGLHASDLIHEASAAVANRQTVQTLAHLVHAHPTLSEVLDEAYKRAIV

SEQ ID NO: 3889 - protein, 292 aa, Triticum aestivum
GRTEDAFRESVASLKRNKLGLKGILHTPISRSGHQSFNVAMRQELDIYASISLIKNIPGYETRHKDVDLCIIRENTEGEYSGLEHQSVEGVVESLKIITRAKSERIAKFAFSFALANGRSKVTCIHKANIMKLADGLFRSTFHQVAKDYPTLETNDMIVDNASMQAVSRPQQFDVMVMPNLYGGILSNIGAALVGGPGIVPGCNMGREVAVFEPGCRHVGLDIKGKDQANPTAMLLSGSMLLRHLGLDEHANRISKATYAVIAEGKVRTPDMGGKSTTHEFTRAILDKLETV

SEQ ID NO: 3890 - protein, 325 aa, uncultured haloarchaeon
MFLWLALLVFMMVPSWSTEQMPQCANKTIIITGANSGLGYEATKAFATKGATVIMACRSIERGQQAATDIRNNVDMASGDLTVRQCDLASLESIKSFAAAVSREYDSIDILSNNAGVMAIPRQETEDGFEKQFGVNHLGHFALTGHLLELMISGDDESRVVTHSSGAHEFGKINFDDLQRKQSYGKWEAYGQSKLANLLFAYELQRRFETAEITQTISVACHPGYAATNLQYRGPKQSGSALRLRMMKVANRIFGQSAADGVLPLLYASTATDVQGSEYYGPNGFLNMRGAPEEQSSSQESYDTQTAQRLWRRSETLTGVSFEFS

SEQ ID NO: 3891 - protein, 516 aa, Chlorobium tepidum TLS; identical to SEQ ID NO: 1583

SEQ ID NO: 3892 - protein, 285 aa, Salmonella enterica subsp. arizonae serovar 62:z4,z23:--
MTPDNGSEIWVKLEGNNPAGSVKDRAALSMIVEAEKRGEIKPGDVLIEATSGNTGIALAMIAALKGYRMKLLMPDNMSQERRSAMRAYGAELVLVTKEQGMEGARDLALSMAERGEGKLLDQFNNPDNPYAHYATTGPEIWRQTAGRITHFVSSMGTTGTITGVSRFLREQDKAVTIVGLQPEEGSCIPGIRRWPADYMPGIFSAPLVDEVLDIHQQEAENTMRELAVREGIFCGVSSGGAVAGAIRIAKANPGALVVAIICDRGDRYLSTGVFGEEHFSQGAGI

SEQ ID NO: 3893 - protein, 224 aa, Synechococcus sp. RS9916
MPNELEERAQRWRALQTQMPEGVRLLAVSKGHPAAPVRELAELGQVDFGESRVQDALPKQEQLADLVQIRWHFIGRLQANKVRPVVRAFAVIHSVDSLALAQRMDRIAAEEGVIPEAFLQVKMRPDPAKGGWDPQALTDAWPQLQALPHVRFTGLMTMAPLGCSQEQRSALFADCRTLADRLGLRECSMGMSGDWPEAAAAGATWVRVGSGLFGARPGVVNFPA

SEQ ID NO: 3894 - protein, 266 aa, Synechococcus sp. RS9916
MIGLGRMAQALLLPLLEQNDPAAADVIAVVGQQATADRLAASLPGDLNLVSASDSRAAAAWTAPVQLLAIKPYQLDQVAASAPAVQGPEPPLLISVLAGITLERLEQSFPGRVCVRAVPNTPSLVRAGLTGLAWGQGVTDAHKQRVQAFFSPVSEVLELPEERLDVFLALTSSGPAYVAMMAEAMADGAVAVGMPRDQALHLANRTLAGTAALLHEQQLHPAQLKDMVASPGGTTMAAIRRLEQAGLRSALIEAVVAAAEHGRNLR

SEQ ID NO: 3895 - protein, 139 aa, Vitis vinifera
MTAFIVYYYSHCPPPVITSPALLTIKYSVILFSSHTTLIHSSLLLSSNIITMKHLFPTLLLLSLLLHSCFSQPTTDGAGFCGLKCSKRCSQAAVLDRCMKYCGICCQECKCVPSGTYGNKHECPCYRDKKNSKGKPKCP

SEQ ID NO: 3896 - protein, 470 aa, Vitis vinifera
MDRKQGFFAALKEEVVRGLSPARSRAKSPGRAGSPMSGLLRRRKQSHNQYVANPEPLISRSGSLRPVVGETLTPLMEGPDPDGSEIGESKRRHWMKGQLSRTPSVTSAAYRRSDLRLLLGVMGAPLAPVHVSTTDPLPHLSIKDTPIETSSAQYILQQYTAASGGQKLQNSIRNAYAMGKVKMIASEFETATRVLKNRNASKDADSGGFVLWQMNPDMWYVELAVGGSKVHAGCNGKLVWRHTPWLGAHSAKGPVRPLRRALQGLDPRTTASMFADARCIGEKKINGEDCFILKLCADPQTLKARSEGPAEIIRHVLFGYFSQKTGLLVHMEDSHLTRIQSNGGDAVYWETTINSFLEDYRPVEGIMIAHSGRSIVTLFRFGEMAMSHTKTRMEETWTIEEVAFNVPGLSVDCFIPPADLRSGSISEACELPHEERGKSSVSLAAHRAKVAALEKTHDGGIDNVIWRMEV

SEQ ID NO: 3897 - protein, 477 aa, Listeria monocytogenes
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPPLYLYFTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 3898 - protein, 405 aa, Anaplasma marginale str. St. Maries
MAAPYEHNTRKCILKSTNNPLTFVRFCTTIPGFLFSLLAMIYGRHDAVLVLSDGRHFFGTSLGKRQDCVGEVCFTTGFTGYQYTITDPSFAGQIVVFSFPHIGNVGVNSRDFECEHVLARGIVVREMSHASHVSSLADLNSWMEASGVSGISGVDTRALTLHLREHGSQNGVIHCFDDPDLLDLQKLKSAAMAPTVPTVATELPHLKSHQVSHTGLRICVIDVGAKRGIMQTLSTLGCAIHVVAARDDFVTQIMDLRPQGIVISNGPGDPHAVPTDTIEQLRVLLQQGIPMLGICLGHQLLAIAIGAKTVKMRHGHRGSNHPVYNVATKAVEVTSQNHGFAVDAQTLPENAEVTHISLFDGTIEGMKLLDRPVLSVQYHPEGHPGPHDSHYIFRDFVNLARAYRW

SEQ ID NO: 3899 - protein, 416 aa, Listeria monocytogenes
MAVDKITMPKLGESVTEGTISSWLVKPGDTVEKYDAIAEVLTDKVTAEIPSSFSGTIKEILAEEDETLEVGEVICTIETEEAGSSEPVAEAEQTEPKTPEKQETKQVKLAEAPASGRFSPAVLRIAGENNIDLSTVEGTGKGGRITRKDLLQVIENGPVAPKREEVKSAPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 3900 - protein, 420 aa, Rhodopseudomonas palustris CGA009
MRVTRPAGGPLFPIGSAMSQSASTSHLLPVFARADVAFERGEGVWLHGTDGERYLDFTSGVAVNALGHCHPHLVEALQQQASKLWHVSNLFKSPEGERLAARLCEQSFADKVFFCNSGAEAVECALKMARHYHFSKGEPERTRVITFEGAFHGRTLGTLAATGSAKYLEGYGQPLEGFDQLPLGDLDAVKAAIGPNTAAILIEPLQGEGGVRSPELAFFRGLRELCDAHGLLLVFDEVQTGMGRTGELFAYKRIGVAPDIMALAKALGGGFPIGACLSTAEAAKGMAPGAHGSTFGGNPLAVAVANAVLDVMLQPGFFDHVKKMSLLLKQKLAGVVDRHPRVVSEIRGEGLLLGLKAVVPSPELIAALRAEKLLSVGAGDNVVRLLPPLIVNEAELDEAVGRLERACVTLAGQAAQKEAV

SEQ ID NO: 3901 - protein, 178 aa, Prochlorococcus marinus str. MIT 9515
MNDHKSQDNYEAQTLILNDSNGNELFCYLEQIVKVEEKEYALLTPVDTPVSLFKINDKEEPELIEKIEKNEQVLKNADAVLQEHDLKLIRSAVTLTVSGELEEPIYDELEEDELDDESETYELLVSFNLLEQEYGLYIPLDPFFIVGKIIGKGASLIEDDEFDKVQPLIESELEKSSL

SEQ ID NO: 3902 - protein, 112 aa, Chlamydomonas reinhardtii
GGSVIVIDSKAAWDAQLAKGKEEHKPIVVDFTATWCGPCKMIAPLFETLSNDYAGKVIFLKVDVDAVAAVAEAAGITAMPTFHVYKDGVKADDLVGASQDKLKALVAKHAAA

SEQ ID NO: 3903 - protein, 461 aa, Mycobacterium sp. MCS
MSRTHSRVQHVSPAYTGRLAMAPVPSLRLPDEAMEPQAAYRFIHDELMLDGSSRLNLATFVTTWMDPEAEKLMAETFDKNMIDKDEYPATAAIEQRCVCMVADLFHAEDLRDDDPNSAIGVSTIGSSEAVMLAGLAMKWRWRQRLGGDAWKGRTPNLVMGSNVQVVWEKFCRYFDVEPRYLPMEDGRYVITPEQVLEHVDEDTIGVVAILGTTYTGELEPIGEICAALDKLAADGGVDVPVHVDAASGGFVVPFLHPDLVWDFRLPRVVSINVSGHKYGLTYPGIGFVVWRNAEQLPEELVFRVNYLGGDMPTFTLNFSRPGNQVVGQYYNFLRLGRGGYAQVMQSLSQTARWLGDELRDSEHFELITDGSAIPVVSFRLKGDPGYTEFDISQTLRSYGWQVPAYTMPEGAEDVTVLRVVVREGFSADLARALRDDMVTVLKHLDELKPGGHFDEVQPFAH

SEQ ID NO: 3904 - protein, 203 aa, Hypocrea virens
SNVFAGSDTTAIALRSIFLNLLRHPHVLSKLIAELEERRAAGRLSNTVTFQEAEACPYLQAVMHEALRIFSPAGFSFDRDVPKEGMIISGKFVPGGTVVGSSPWVIHSLPEVWGADFDKFRPERWLEGENSSELKRFFFAFGGGTRTCIGKNISWLEMEKLVATLLMRYDFELVEDENISDSCRWVMLSEPSYSRNSTWNVSH

SEQ ID NO: 3905 - protein, 450 aa, Glycine max
  misc_feature (119)..(119): Xaa can be any naturally occurring amino acid
EVYTLLNKHFGIYLQLKMESSCILAFLFLLILHSSTTKAAFSVGGGVGVGVGVGIGVGVGVGNGNGGSGGVVWVGGGINSPEPPRSSVPKLEGAYTALQAWKSAVTEDPLKILSSWIGXNVCAYKGVFCAANPQDETVGASAAFPVVVAGIDLNHANLKGTLVKELSLLSDLSLLHLNSNRFTGTVPETFRDLVFLEELDLSNNQLSGPFPSATLYMPGLIYLDLRFNYFSGSLPQELFSKNLDALFLNNNQFEGEIPQNLGSSPASVINLANNKLSGSIPASLGFMGSKIKEILFLNNQLTGCIPEGVGLFTEMQVLDVSFNSLMGHLPDTLSCLQDIEVLNLAHNKLSGELSDVVCSLRSLANLTVAYNFFSGFSHECSRLFFRNVGFDFSLNCIPDRDMQRPPPECSGIPGGSLSCLRIPTPRPLVCGSMAVSKSKNIIDPTSSSPP

SEQ ID NO: 3906 - protein, 150 aa, Oryza sativa Japonica Group
MLKFLSKVVVEYCPLDPRKAAVVELLAQCNGRKAKDSNPACSVELRRLPSPPPADAAAAGEKNAHPPPRVLVTYFNGVEESFVAAEGATAQGIRDQILDRGRLLDTEQLFRDGGEKWPVLIPEEELTMSFPGIKFHLIEHLVGDTTYRIR

SEQ ID NO: 3907 - protein, 120 aa, Brassica napus
MSRTRTAASEAHDSMESEERVDLDPEETLEEEYEYEEVEEEEEVEEEIEEEVEVEEDEDEEEEEEEEGGEKKKHDELLALPPHGSEVYLAGTPTDASEGDLKGFCESIGEVTEVRIMREK

SEQ ID NO: 3908 - protein, 390 aa, Rickettsiella grylli
MDHSFVFSIFVIFTGAAVLATIALYTHQSLLVAYILLGLILGPSCLKLVPNLSLARGIGDVGIIFLLFLVGLDLTPQEFYRSLRKTAIVTLVFSALFTTIGFAVGYLFSFTLLESLLIGASLIFSSTIIGLKLLPTLALHHKPIGETMISVLLLQDLLAIGMLLFVHGANMTGSKIADLGLTLITFPSLLAFAFVVQRYFISKLFIRFDRVQEYLFLVALGWCLGLAELSRALGLSAEIGAFLAGVSIAEGPIAVFIADNLKPLRDFCLIMFFFAIGASFDLRYLPEVFIPALLLAGLVLLIKPWLFQVLLQMSGEKKYIAREVGVRLGQASEFSLLIAYLAAETTPALIGGKANYLIQAVTILTFVGSSYWVVLRYPTPLALNEKMRVD

SEQ ID NO: 3909 - protein, 419 aa, Solanum tuberosum
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDNRQLIIKPQPGEVVKPDQFKAINDEGMPMYQRPFMRGKLYIHFTVEFPDTLSPEQCKNLEAVLPPKPKTQMTDMELDECEETTLHDVNIEEEMRRKQQQAQEAYDEDDEDMHGGAQRVQCAQQ

SEQ ID NO: 3910 - protein, 566 aa, Ustilago maydis 521
MGAWTNFVDGFKPEVTDESASDSVPAYAEKDSKDFETNAVAGFKDPKDETGLKRRLTGRHVQFIALGGSIGTGLFIGSGGALATGGPGFLMIDFILIGIMLLMVVMALGELGAIFPVAGSFAAYSTRFIDPAVGFAMAYNYWLQWLIVLPLELVAASIVIVFWDPNETVPKGVWIAVFLIIITIINLFGVRGYGEFEFFGSLVKVLAVIGFIIAGVVINVGGGPDGKYYGTETWRNPGAFNNGFKGFSSVFVTAAFAFAGTELIGLAAAETANARKEIPKAAKQIFMRVTIFYVVSLLVVSFLVPYTNPALLGGSYDARASPFVIAVANARISVLPSILNAVILISVLSVGNSAVYAASRTLQAMSTIGQAPRYFSYIDRQGRPLPAVILSLIFGLLGFLIYAGDDARGLVFSWLLAISGLSTIISWLCICISHARFRQAWTRAGHTLEELPWKSPFGIWGSLYGAFFNVLVIIVTFYVSAFPIGEGEMSATERANAFFQSFLSVPVVVFVFYLPYKFFMRSKYVDIDDIDISTGRRDPVPVEVLRREREEAAALPMYKKVWHFLF

SEQ ID NO: 3911 - protein, 413 aa, Neorickettsia sennetsu str. Miyayama
MQQIQKVKAREIFNSRGWPTIEVEVTTSCGRVGCAIAPSGASKGVLEACELLDGDKARLSGRGVLRAVENVHTIIAPALMGKSVAAQAEIDSLLIQLDGTTNKSVLGANAIVAVSLAVAKANASVRGVPLCIVFHNLLTSEGDDFVYVPPVPMLNVINGGVHADNRLAIQEFMICPVGRRSFRESMEKAADVFHRLKGLLKQYGKSTNVGDEGGFAPDLSSTEETLGLLSEAIGDSKESVKIALDAASSTFYKDGKYSIDGKLLNVNEMVDFYAAIIEKYDIVSIEDPLYESDWESWQVMTRKLSDKIHIVGDDIFVTNPKIIKKGIKTGVANAVLVKINQVGTVTETIESIKLARKAGYKVVISHRSGETEDLSIAHLAVACGGAFLKAGSLSRSERVAKYNEVLRLEEVFV

SEQ ID NO: 3912 - protein, 503 aa, uncultured haloarchaeon
MGYSSESTGIYDRHLSKHDEVTAQSEFSSWVDGEQYTTANSQPIQDPVIDQPIVDIPKCDVRDVDLAVDTAWTAFETRWEDTTASDRSARLFEWADTLKDHQDELVTLECLDCGKPLSQARGEVEGAIETIEFYASVCRAQRGSEIPAQKDLHLYTTQEPYGVVGQIVPWNYPLWAATWKLGPALAAGNACILKPSLETPLSTIRAAQLSQGIFPDGVLNVITGSGSDVGRAVAEHEEVRKVSFTGSTQVGRSVMHSAADRVAPVTMELGGKSPFIVFPDADLDKVVTAVADGIFYSTGEICDALSRALVHESIVDEFTSRFVDAAESYVLGDPLSEETTMGPLTSQSQFKTVTNYIETGRKEATLLCGGGKPDNAALSDGWYVEPTVFAEVTNEMTIAREEIFGPVQTIMTFEDYDEAIELANDTQYGLASGIGTESTSLVHQTADDLDAGLVYVNEYGPILPDAPYGGFKQSGFGKDLGLEALDHYQRQKSVYVNLDEPSL

SEQ ID NO: 3913 - protein, 389 aa, Anabaena variabilis ATCC 29413
MKAMILAAGKGTRVRPITYTIPKPMIPILQKPVMEFLLELLRQHGFDQIMVNVSHLAEEIENYFRDGQRFGVQIAYSFEGKIDDEGKLVGEAIGSAGGMRRIQDFSPFFDDTFVVLCGDALIDLDLTAAVKWHKSKGSIATIITKTVPEEEVSSYGVVVTDENSRVKAFQEKPSIEEALSTNINTGIYIFEPEVFNYIPSGVEYDIGGQLFPKLVEIGAPFYAIAMDFEWVDIGKVPDYWRAIRGVLQGEIKNVQIPGHEVAPGIYTGLNVAVNWDKVDITGPVYIGGMTRIEDGAKIVGPAMIGPNCWICGEATVDNSVIFEWSRLGHGARLVDKLVFGRYCVDKTGAAIDVQAAALDWLITDARQTPPEHTPVERQAIAELLGTNAI

SEQ ID NO: 3914 - protein, 123 aa, Paxillus involutus
  misc_feature (18)..(18): Xaa can be any naturally occurring amino acid
  misc_feature (28)..(28): Xaa can be any naturally occurring amino acid
HSFYQLVHQGTKLIPSDXLAPATSHNPXADSKHHRILLSNFFAQPEALAFGKTEEEVRKELGSGASEALVKSKVFEGNRPSNSIMFPLMTPRTLGALIALYEHKIFTQGVIWGINSFGMLDVV

SEQ ID NO: 3915 - protein, 575 aa, Salmonella enterica subsp. arizonae serovar 62:z4,z23:--
MISGILASPGIAFGKALLLKEDEIVIDRKKISADKVDQEVERFLSGRAKASAQLEAIKTKAGETFGEEKEAIFEGHIMLLEDEELEQEIIALIKDKHMTADAAAHEVIEGQATALEELDDEYLKERAADVRDIGKRLLRNILGLAIIDLSAIQEEVILVAADLTPSETAQLNLQKVLGFITDAGGRTSHTSIMARSLELPAIVGTGSVTSQVKNGDFIILDAVNNQVYVNPTNDVIEQLRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAVRIAMDRKEILRDQVRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 3916 - protein, 83 aa, Triticum aestivum
  misc_feature (10)..(10): Xaa can be any naturally occurring amino acid
QKRGKIDDDXKLRNLYDKRISQEVVGDLLGEEFEGYIFKIMGGYGQGGGGGYGQGGGGYGGQRGGGGYGGGGGRYGGRCRGPH

SEQ ID NO: 3917 - protein, 323 aa, Salmonella enterica subsp. arizonae serovar 62:z4,z23:--
MSKIYEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPQKYLLLQQFSNPANPEIHEKTTGPEIWEDTDGQVDVFISGVGTGGTLTGVTRYIKGTKGKTDLITVAVEPTDSPVIAQALAGEELKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 3918 - protein, 123 aa, Paxillus involutus
  misc_feature (111)..(111): Xaa can be any naturally occurring amino acid
HSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVXWGINSFGMLDVV

SEQ ID NO: 3919 - protein, 451 aa, Mycobacterium smegmatis str. MC2 155
MTACQVINPATEQVLTTVELLDEAAVDDAVARATVAQRRWAALAPAERAAALRAFAAAVDAHIDELAALEVSNSGHPIGQAEWEAGHVRDVLNFYAATPERLSGKQIPVAGGLDVTFNEPLGVVGVITPWNFPMTIAAWGFAPALAAGCAVLLKPAEWTPLTTIRIGEIARESGLPEGLFQVLPGKGSVVGERFVSHPGIRKVVFTGSTEVGRRVMAGAAAQIKRVTLELGGKSANIVFEDCDLEKAAATAPYGVFDNAGQDCCARSRILVQRSVYDRFMEMLEPAVKGVVVGDPSVRDTEMGPLVSRPHWESVHSYVPDDAPVAFRGSAPDGPGFWFPPTVLTPSRDDRTVSEEIFGPVVTVLPFDDEADAIAVANDTAYGLSGSIWTDNVSRAIRVSRAIEAGNLSVNSHSSVRYNTPFGGFKQSGLGRELGPDAPLSFTETKNVFIAV

SEQ ID NO: 3920 - protein, 446 aa, Synechococcus sp. RS9916
MATHDIFMPALSSTMTEGKIVEWLKKPGEKVGRGESVLVVESDKADMDVESFNEGYLAAVLMPAGSTAPVGETIGLIVETEAEIAEAQAKAGSGGGAASAPAAAAPAAPAPAPAAAPAPAAPAPVAPPAPAVAAAPAAPAPVVNSGRLVASPRAKKLASQMGVNLASVRGSGPNGRIQAEDVERAAGRPVSVPRVGEGTPAAVVAGAGAAAPSAPAGNSFGAPGDTVAFNTLQAAVNRNMEASLAVPCFRVGYTITTDKLDAFYKQVKPKGVTMTALLAKAVAVTLARHPQVNAATTAAGMAYPADVNVAVAVAMEDGGLITPVLRQADRTDLYEMSRQWADLVKRSRSKQLQPEEYSTGTFTLSNLGMFGVDRFDAILPPGTGAILAVAASRPTVVAGKDGSISVKRQMQVNLTADHRVIYGADGAAFLKDLAELIETRPESLAI

SEQ ID NO: 3921 - protein, 640 aa, Oryza sativa Japonica Group
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPESLVHGANICAFLNIAQAMTDQGCV

SEQ ID NO: 3922 - protein, 328 aa, Synechococcus sp. RS9916
MSRVYADNSQAIGNTPLVRLNNVTKGCKATVLAKIEGRNPAYSVKCRIGANMIWDAEKRGALTADKTIVEPTSGNTGIALAYTAAARGYKLILTMPESMSIERRRVMAALGAQLILTEAAKGMPGAIAKAKEIAESDSAKYFMPGQFENPANPEIHEKTTGPEIWNDCDGAIDVLVSGVGTGGTITGISRYIKNSAGKAIESVAVEPSHSPVITQTMNGEEVKPGPHKIQGIGAGFIPKNLDLSVVDKVEQVTNEESIEMALRLAQEEGLLVGISCGAAAAAAIRLAQQDAYAGKTIVVILPDLAERYLSSVLFADVPAGIIEEPVAV

SEQ ID NO: 3923 - protein, 357 aa, Prochlorococcus marinus str. MIT 9515
MKKYKVVLLSGDGIGPEISEISSEILKKLSHKYSFDIEIKEEYFGGIAYEKYKDPAPKATLDQCKSSDAVLLACVGDLKYDSLPRELRPESGLLKLRSALNLFANIRPVKIRKSLLDASSLKKEIIEDVDLVVVRELISGIYFGQPRGQITNTKVKKAFNTMVYDTKEIERITEVAIKIANQRSKKICSVDKSNVLEVSQLWRDTVLDVASKNKDLSLSNMYVDNAAMQLVKDPSQFDVILTSNLFGDILSDLAAMITGSIGMLPSASLSNSGPGVFEPVHGSAPDIAGKNLANPIAMALSTSMMLKIGLNEEKAADDIEIAIDNVLSKGYRTSDLDNGDCNVLSCSEIGEKIIQEI

SEQ ID NO: 3924 - protein, 387 aa, Arabidopsis thaliana
MAKDGPNWDGLLKWSLSHADGTRPTRQLSLGICVAMIELSLEEMNLMSEFESGEEDRKWFMEAMQSQTVDVVKRMKEITLVMQTPEQVLVEHGVTPEDIQDLLDELQEHVESIDMANDLHSIGGLVPLLSFLKNSHANIRAKAADVVSTIVQNNPRSQELVMETNALESLLSNFTSDTDIHARTQALGAISSLIRHNKPGVTAFKLANGYAGLRDALASDSVRFQRKALNLLQYLLQEDDSDRSIATGLGFPRVMMHLASSDDAEIREAALRGLLELSREKNDGSSSIDKSDEKLRQLLEERIKGITLMSQEDLETVKEERQLVDLLWSICYNEPSSLREKGLVVLPGEDALPPDVASKLFEPPLRASAANRNATEKKDEPMKLLGP

SEQ ID NO: 3925 - protein, 299 aa, Prochlorococcus marinus str. MIT 9515
MSKRHPVVAVTGSSGAGTSTVKRAFEHIFAREDIIPAVVEGDSYHRFERMPMKKAMAEALSKGENFSHFGPEANLFDKLEELFKVYGETGGGKKRYYLHSTEEAQEHNERLGTSLEPGQFTPWEDIPNGTDVLFYEGLHGGVEGEGYNVSSFADLLVGVVPITNLEWIQKIHRDNAERGYSAETIVDTILRRMPDYINHICPQFSKTDINFQRIPTIDTSNPFICRNIPTPDESFVIIHFRKGAREKWGIDFQYLLGMIHDSFMSSPTSIVVNGGKMGFAMELILTPIIHKMIEEKKHA

SEQ ID NO: 3926 - protein, 347 aa, Triticum aestivum
  misc_feature (139)..(139): Xaa can be any naturally occurring amino acid
  misc_feature (323)..(323): Xaa can be any naturally occurring amino acid
RHVARHFCGDMIRRLVFGKRYFSNLPASSTSGPGHDELAHVAALFTLLNHVYSFCVSDYFSALQGLDLEGHEMVCRDVMRTINLLHDPIIEDRIRERSNSLHSRAEKKEARDFLDVLVYLEDAQGQPLLSLEDIRAHLXEIMFAIIDNPSNAVEWALAEMINRPEVMQKAIDELDTVVGKERLVQESDISQLNYLKSCIREAFRIHPYHAFNPPHVAMADTTVAGYTIPKGSHVILSRFGLGRNPKIWVEPLEFRPERHLNAANVLLTEPGLRFISFSTGRRGCPGISLGTSVTMMLIARMLQGFTWTKPPGVHSIDLQESKXGLALAEPFVLRAKPRLPAHLYGAK

SEQ ID NO: 3927 - protein, 355 aa, Prochlorococcus marinus str. MIT 9515
MALNYYKNELKENAQLLASKGKGILAVDESTKTVGKRLAGIGVENTEENRKAYRGMLFTTEGLGKYISGAILFEETLFQNHQDGESMVKKLNDLGIIPGIKVDKGLNPLPGGGDVETFCSGLDGLVERAAKYYEQGARFAKWRAVLQITEDGCPSKLSIQENAWGLARYARSVQESGLVPIIEPEILMDGNHTIEKTAEVQEEVIKQVYIACQANGVFLEGTLLKPSMTVNGAECPTKADPMKVAEMTIRTMERCVPASVPGIVFLSGGLSEEAASVYLNNMNTLYRKALWNVSFSYGRALQHSCLKAWKGSEIEAGQKALIARAQANSEASTGSYVAGSQPSSDEQLFVAGYTY

SEQ ID NO: 3928 - protein, 182 aa, Salmonella enterica subsp. enterica serovar Typhi str. CT18
MQFNIPTLLTLFRVILIPFFVVVFYLPFAWAPMVSALIFCIAAITDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNIWVEYAGIALFFVAAVLTLWSMLQYLSAARGDLLDQ

SEQ ID NO: 3929 - protein, 218 aa, Solanum tuberosum
MATFLSLYITILTVMGLKRSDSLCSSVGIQGIAWAFGGMIFALVYCTAGISGGHINPAVTLGLFLARKLSLTRSVFYIVMQCLGAICGAGVVKGFMVGPYQRLGGGANVVAPGYTIGSGLGAEIIGTFVLVYTVFSATDAKRNARDSHVPILAPLPIGFAVFLVHLATIPITGTGINPARSLGAAAIIFNDKHAWRDTGSFGLDQLLELFLLLLQHQV

SEQ ID NO: 3930 - protein, 182 aa, Neorickettsia sennetsu str. Miyayama
MKDLPNLLTALRIAIIPVFCLSFYIQSRFSWVITVGIFSIASLTDFFDGYLARTLKAQSKLGKLLDPIADKMIVSTAIVMLVHMQYITGVQLIPAIMIICRELFIAGLREYLARDSVAFPVNRFGKLKTISQMVAILLYLLNKEWIPDILPTFFIWIAGLTSMASAYLYLHENKEELLKSLS

SEQ ID NO: 3931 - protein, 114 aa, Oryza sativa
  misc_feature (23)..(23): Xaa can be any naturally occurring amino acid
DALCHTCSKTGHLARDCPSSGSXPGHIARECTNEPVCNLCNVSGHLARNCQKTTISSEIQGGPFRDITCRLCGKPGHISRNCMTTMICGTCGGRGHMSYECPSARMFDRGLRRF

SEQ ID NO: 3932 - protein, 328 aa, Salmonella enterica subsp. enterica serovar Typhi str. CT18
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIVQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLANLEGVLLDPVYTGKAMAGLIDGISQKRFNDDGPILFIHTGGAPALFAYHPHV

SEQ ID NO: 3933 - protein, 149 aa, Anabaena variabilis ATCC 29413
MERTFLAIKPDGVQRGLVGEIIRRFETKGFTLVGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 3934 - protein, 476 aa, Rickettsiella grylli
MKRFKRTKIVATLGPATDSVAVLQKMIAAGLDVVRLNFSHGKADDHIKRADYVRKYAKAANREIAIMADLQGPKIRISCFKKGAIFLKKNALFILDADLDEEEGDECVVGIDYKELPRDVHSGDSLLLDDGRIVLKVKKIQKNKIFCRVEVGGKLSDNKGINRKGGGLSAIALTEKDKKDLKIAVKLDADYIAISFPRSAADINLARSLLKKAKGHAGLIAKIERSDAIPVIDEIIRASDAVMVARGDLGVEIGDAELPAVQKHIIQRARSLDKAVITATQMMESMIHSAIPTRAEVFDVANAVLDGTDAVMLSAETAIGDHPALVVEAMARICLGAEKQAKTRISRHRVECQFSRPDEAIAMAAMYTANHYDIKAIIALTESGATPLWMSRIRSGLPIYGLAHNLKTTRRLALYRGVYPLYFNIDELCPENIAHLAIKELKKHKILKKGEHVLITYGDLLKTTGGTNTLKILEVD

SEQ ID NO: 3935 - protein, 626 aa, Zea mays
  misc_feature (371)..(371): Xaa can be any naturally occurring amino acid
MDSCESLLINASLVLWHERALVVHLTTLSVSPLSLLQLLWFLTSLDAVATFFFFLYGTRHGYFLKRRGRSESVGSRDGVFKDSWPRPSSAHRHTNTSRRRQRASLLSHASRQGRERDRRSPSRRRWCGCPPSSSEICLVTDLSDKMVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQXRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 3936 - protein, 416 aa, Picea sitchensis
MAALSRFFPALRRELGRLSAGSASQGRFLSSDASGYHLGNGPSSMRAAVFWEPGRPLSIEDFHMPRPKAGEVLIKTKACGVCHSDLHVMNGDLPFARPCVVGHEITGEVVEHGVHTESGIIKRFPIGAHVVGAFIMPCRNCFYCVKGQEDLCEPFFTYNRAKGTLYDGETRLFLRSNGKPVYMYSMGGLAEYCVVPATALAVLPASLPYTESAILGCAAFTAYGAMRHAADMRAGETVAVIGIGGVGSSCLQIAKAFGGSKIIAVDVQDEKLENARKLGATHTVNASKVNVVDTIKEITGGRGVDIAVEALGKPETFMQTALSVMDGGKAVMIGLAASGAKAEIDITRLVRRQIKILGSYGGRARQDLPILVGLAETGIFNLEAAVSKKCTFDEAGAVYDALNRGEIVGRAVVEIM

SEQ ID NO: 3937 - protein, 409 aa, Sulfolobus tokodaii str. 7
MLYKEPEDGEKIKFDKGKWIVPNKPVILYIEGDGIGPEITNAAIKVINKAVERAYGSSREIKWLEVYAGEKAEKLVNDRFPKETQEMLLKYRVVLKGPLETPIGKGWKSVNVAIRLMLDLYANIRPVKYIEGLESPLKHPEKVDMIIFRENTDDLYRGIEYPFNSEEAKKIRDFLRKELKVEIEDDTGIGIKVMSKYKTQRITRLAIQYAIEHKRKKVTIMHKGNVMKYTEGAFREWAYEVALKEYRDFIVTEEEINQGKPDQGKIILNDRIADNMFQQIIIRPEEYDIILAPNVNGDYISDAAGALIGNIGMLGGANIGDEGGMFEAIHGTAPKYAGKNVANPTGIIKAGELMLRWMGWNEAADLIEKAINMAIRDKKVTQDIARFMGVKALGTKEYADELIKIMDTI

SEQ ID NO: 3938 - protein, 453 aa, Nostoc sp. PCC 7120
MTVTQNLPNGPRIPRLLRLFKFITQPIQYVEDFAKVYGDNFTIWGSGESYFVYFSHPQALEQIFTNVSCFESSGGGSPLLELLLGKNSLILLEGDRHQRQRQLLTPPFHGERMRAYGQTIREITQQVTQAWQMGKPFNIRASMQEITMRVILRVVFGVDEGELFQELRQLLTTLLDFMGSPLMSSTFFFSFTQKDYGAWSPWGRMVRLIKKIDQLIYALIAQRRAEFGENRQDILSLLISARYDDGQPMSDVELRDELMTMLVAGHETTASALTWAFYWIDSVPEVREKLFQELDTLNDDSEPSIIAKLPYLTAVCQETLRFYPIVLNAFFRRTKNPMEIMGYKLPKATLVVPSIYLAHHREEVYPQSKQFRPERFLEKQFSPYEYLPFGGGNRRCIGLAFAQYEMKIVLATILSQFQVSRLSKRPVQPVRRGLTLAAPGGMKMVANKRMRNS

SEQ ID NO: 3939 - protein, 123 aa, Paxillus involutus
  misc_feature (66)..(66): Xaa can be any naturally occurring amino acid
HSFYQLVHQGTKLIPADFLAPATSHNPIADSKHHRILLSNFFAQPEALAFGKTEEEVRKELGSGAXEALVKSKVFEGNRPSNSIMFPLLTPRTLGALIALYEHKIFTQGVIWGINSFGMFDMV

SEQ ID NO: 3940 - protein, 123 aa, Paxillus involutus
  misc_feature (30)..(30): Xaa can be any naturally occurring amino acid
HSFYQLVHQGTKLIPADFLAPATSHNPIAXSKHHRILLSNFFAQPEALAFGKTEEEVRKELGSGASEALVKSKVFEGNRPSNSIMFPLLTPRTLGALIALYEHKIFTQGVIWGINSFGMLDVV

SEQ ID NO: 3941 - protein, 363 aa, Mycobacterium smegmatis str. MC2 155
MKIRGAVLERIGAPRPYAESRPLTISELDLADPGPDELLVRIESAGLCHSDLSVVDGNRVRPVPMLLGHEAAGVVETPGADLETGQRVVMTFLPRCGSCPACGTDGLTPCGPGSVANGAGTLMNGDIRLRRDGEPVFHHLGVSGFATHAVVDRRSIVPVPDDVPATVAALLGCAVLTGGGAVLNVGRPKPGQTVVVVGLGGVGMAAALTALAHDDVRVVGVDQLSDKLARAAELGVHETFTPEQAADLRAEVVIEAAGHPAALETAIGLTGPGGRTITVGLPRPDARITVSPLGFVAEGRSLIGSYLGSAVPSRDIPRFVELWRAGRLPVESLVSSTIALDDINAGMDELAEGRAVRQVIDFA

SEQ ID NO: 3942 - protein, 557 aa, Mycobacterium smegmatis str. MC2 155
MAEFIYTMRKVRKAHGDKVILDDVTLNFLPGAKIGVVGPNGAGKSSVLRIMAGLDQPNNGDAFLAPDATVGILMQEPQLDETKTVRENVEDGVAIKGKLNRYNEVAELMATDYSDELMEEMGKLQEELDAADAWDIDSQLEQAMDALRCPPPDEPVTHLSGGERRRVALCKLLLSKPDLLLLDEPTNHLDAESVLWLEQHLASYPGAILAVTHDRYFLDNVAEWILELDRGRAYPYEGNYSTYLEKKAERLEVQGKKDQKLQKRLKEELAWVRSGAKARQAKNKARLDRYEEMVAEAEKTRKLDFEEIQIPTPPRLGSVVVEVEHLDKGFNGRTLIKDLSFTLPRNGIVGVIGPNGVGKTTLFKTIVGLEQPDSGTVKIGETVKLSYVDQTRAGIDPKKTVWQVVSDGLDYIEVGQNEIPSRAYVSAFGFKGPDQQKPAGVLSGGERNRLNLALTLKEGGNLILLDEPTNDLDVETLSSLENALQQFPGCAVVISHDRWFLDRTCTHILAWEGDDDNEAKWFWFEGNFGAYEENKIQRMGAEAARPHRVTHRRLTRD

SEQ ID NO: 3943 - protein, 137 aa, Physcomitrella patens subsp. patens
MLLGYVYPAYECFKVVEKNRPNLEHLRFWCQYWIIIAALTVFERLGEIMISWVPMYNEAKLAFIIYLWYPKTLGTSYVYFTFLRPFVVKHESEIDRQLNELTTRAGDLAFFWWHRSSGYIQAQFYQLLAYVASQSNR

SEQ ID NO: 3944 - protein, 153 aa, Oryza sativa
MSNIEEQTYIMTKPDGVQRGLVGEIIKRFEQRGYHLSALKLTQPTETLLQEHYKDLSARPFFPGLVKYMASGPVVCMVWTGLNAVKAGRAMLGETNPQESKPGSIRGDFCVQTGRNICHGSDSVESAQREIALWFKPEELIKWKSANQSWIYE

SEQ ID NO: 3945 - protein, 219 aa, Arabidopsis thaliana
MQIGQALAAAKEGESQMIVMMGNNLSLTSIILNGDPSIEHKGKLTCLDEQVKISQFYHCEGLLLCILKDDSRFVVCNPYLEQTRWIEPRYSHRPYGMDRFSYALGYVNTDSCRSYKLLRFIDYYYNAPEKQFFWYEVYDFDSDLWTTLDVTPHWRIAFCNTGVPFKGNTYWCAAERNVDVDEVLANRLICFDFTSERFGPLLPLPFSGGHHDYTTLSCV

SEQ ID NO: 3946 - protein, 419 aa, Salmonella enterica subsp. arizonae serovar 62:z4,z23:--
MFLRQKMTDNRVENSSGRAGRKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFRLILGVSLLQGAVLTGIATFLILMLQRRGQKPLEKVIGGLLLFVAAAYIVELFFSQPDMAQLGKGMVIPALPNSEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVIFMGLDPTRILVMSQVLLSFGIALALVPLLIFTSNSTLMGELVNTRRVKQVGWIIVVLVVALNIWLLVGTVMGLS

SEQ ID NO: 3947 - protein, 550 aa, Salmonella enterica subsp. arizonae serovar 62:z4,z23:--
MQTPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFHHFYRMSQAISAGSAILNEQNACFEIDRVLGEMVAARRPGYIMLPADVAKKTAIPPIEALTLPAHETQNGVETAFRYRARQCLMNSRRIALLADFLARRFGLRPLLQRWMAETSIAHATLLMGKGLFDEQHPNFVGTYSAGASSKAVRQAIEDADMVICVGTRFVDTLTAGFTQQLPAERTLEIQPYASRIGETWFNLPMAQAVSTLRELCLECAFAPPPTRPVCQPVQIEKGELTQENFWQTLQQYLKPGDIILVDQGTAAFGAAALSLPDGAEVVVQPLWGSIGYSLPAAFGAQTACPDRRVILIIGDGAAQLTIQEMGSMLRDGQAPIILLLNNDGYTVERAIHGAAQRYNDIASWNWTQIPQALNAAQQAECWRVTQAIQLAEVLERLARPQRLSFIEVMLPKADLPELLRTVTRALEARNGG

SEQ ID NO: 3948 - protein, 608 aa, Mycobacterium smegmatis str. MC2 155
MDATPFGHYQLQKLIGRGGMGEVYQAYDTKTQRIVALKVLPPHLAQDASFQDRFRRESHAAAGVNDPHVVPIHGFGEIDGRLYLDMRLIEGRNLGTMLTRADKPLDPTFVVDMIEQVAMALDAAHQAGLIHRDVKPSNILITDNDFVYLIDFGLARSAGESGMTTAGSTLGTLAYMAPERFDAGKVDPRSDIYALACVLYECLTGARPYPADSLEQQIAGHMVSPPPRPSDKDPRLAAFDDVIAKGMAKKPAKRYQTAGQLAAAAREALTTPVLRTSGRSGRHSAQRVHRLTTAQRTRARVPRRVAVIAGATVLVAALLSVGMWQLRDGNSAGREPALADTASTTGPVEAPTGAVPEIAATVPAHIRETGRLVIGVNVPYAPNEFKNSDGEIVGFDVDLMKAVTRTLGLVPDIRETGFEGILPSVRDGSFNVGMSSITDTAEREELVDFVTYFQAGTLWAQRTGSSVDPDAACGLRVGVAYSTIQETEEIPAKSDACVAAGLPPIEKVVRTHQDEVTAALIAGEVDAMTADSPVTGFAIKLSGGALAPAGEVFDSAPYGWPVAKDSGLAEPLRLALEHLMDTGEYRTIATMWGVEKGMITQPVINGAF

SEQ ID NO: 3949 - protein, 144 aa, Legionella pneumophila str. Lens
MAHLIHSVLPVPPRKIAYIHPDDSVKECIKQMVEKDIGALVVFDNDAHLIGIVSERDILRCYFHKNLSLETAKVSDVVYNNVTILSPHDSVEKAMQVITETKRRHVLIQEEGELLAILSIGDLLYHVLEDKLRVIEHLENYIHS

SEQ ID NO: 3950 - protein, 472 aa, Prochlorococcus marinus str. MIT 9515
MSKAHFGLIGLGVMGENLVLNAERNGFSSVVFNRTYSKTEEFLKGRGLGKNIEGAKTLQEFVNKLERPRRILMMVKAGSPTDAVIDNISEYLEEGDLLIDGGNSQFKDTERRVKTLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMSEVFGIWNNTDELASYLVEITEICLNTKDEITGEDVVEKILDKAGQKGTGLWTVVSALELGVSVPTIYASLNARVMSSLKDQRSEIEKTLPIKAFNDFDLGDISNGMKPLFDAVVLATIASYAQGMDILSEASSVYKYDLNMPSIAQIWKGGCIIRSKLLRKIQDAYQKEPNLKNLIFDDWFNMEISSRIDNLANVVSSSTKAGIPVPCLSSTLDYLNSYRTNRLPQNLVQAMRDCFGSHTYERIDKEGSFHTEWMK

SEQ ID NO: 3951 - protein, 308 aa, Shewanella oneidensis MR-1
MVNVNRLFPLFALLGAVTAYLMPAWFVVFKNSIVPLLVVIMLSMGLTLDLQDFANAFKQKRAVITGLILQFTLMPLSALAISLLLGLDRELTIGMVLVGSVAGGTASNVICYLAKGDVALSITMTALSTLAGVVLTPLIIQLLIGEMVAIPLMDMLLSLVKIVLIPVTVGVVLNHFFKPQVAKLSPALPLISIVAIVMAISIIVALNAGQFAQVGPVILLAVFLHNGLGLTLGYLCCRLLGFSHTVCKTISIEVGLQNSGLATALCIKFFSPISAIPSAIFSIWHNLSGAMLAGYWASRVQKQTEALE

SEQ ID NO: 3952 - protein, 431 aa, Prochlorococcus marinus str. MIT 9515
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKSMAVDTSKFGLTKESALEKPYLASMGIYVFSRKTLFDLLNKFPNYTDFGKDIIPEALGRGDNLKSYVFDDYWEDIGTIGAFFESNLALTRQPKPPFSFYDEKFPIYTRPRYLPPSKLVDAQITDSIVCEGTILKSCSILHCVLGVRSRIESDSVIEDALVMGADFFESQEERVELRKGGGTPLGVGVGSTIKRAILDKNARIGDNVVIVNKDRVEEADKPELGFYIRNGIVVVVKNATIANGTII

SEQ ID NO: 3953 - protein, 68 aa, Brassica napus
MTTSKRLADRKIEKFDKNITKRGFVPETATKKGKDYPVGPILLGFFVFVVIGSSLFQIIRTATSGGMA

SEQ ID NO: 3954 - protein, 748 aa, Ustilago maydis 521
MSLTSRLAGIRTSASTYLTSATARLSSHHLHTTAPRFNANMRVRRFDILNLPLVPASERLTVNLLADPVTPEPRSIVSVPDSSPSLVRRSRPVGQGSHFSFLSPLPLSFPYDFPPEQEGEQSLGERHEEEREQDDRDDTQLSPEQKKQKGEQAHKKRMQEVEHMLQRYELQLADERDSAAADASVSPSGGLTGHVPPRRRHQHFPSARLLGVSPAALRDCLPHLDIGDALEWIQSHNMSSGPSSYSSGPIADVTLTDATSPEAAARKTLSDFVSGRLIGARIGASPDELVQDDRAGYGTRYMRLREKVINGQQHEEPSEERTLRRLAELEKKRASADSSDYAPWSLCYAGHQFGVWAGQLGDGRAFTLIETKNPETNERWEIQLKGAGRTPYSRFADGLATLTSSVREYLCSEAMGALGIPTSRALSIVSLPELHVVRERLNIAAITTRLCPSWLRIGSFQIHSSRNEWESVRVLGEYVSHDLFGFEDVVKGGHVGDGAQRPVWARRMVEEVATRNAKTIGLWQVYGFMHGVMNTDNIALTGHTIDYGPYAFMDLYDESQICNHSDGEGRYAYRLQPTMGVFAIRELLNAVAPVVGFELENNRAPAPGELLAASSAQIDEWRELCSDEYSAELENVFTNTLLEQWKQAYRARLGLQTEQADDKSALIDPLCLVLTDLDFSTTLRRLCQLPALLKARGASAGDEEKLKEVIDAFVAGDVNTGLEPWYDVSILPEYMRSQKETQVGTAIK

SEQ ID NO: 3955 - protein, 169 aa, Anabaena variabilis ATCC 29413
MDAIFIPQLTKAPERTEEVQVKEFLPGLETLTPVRGLVRVQHYGNYLQVSAKAEAIITCTCNRCLQQYNQRLAVDTQEVIWLDEAVEQEQNLPLEREVAMEDLLETLSPNGYFYPSEWLYEQMCLALPQRQLCDINCPGILTDNSAESSDQGIDNRWSGLKALKKHLPG

SEQ ID NO: 3956 - protein, 251 aa, Brassica napus
  misc_feature (174)..(174): Xaa can be any naturally occurring amino acid
RAALTSRNEVYTWGKGANGRLGHGDLEDRKVPTLVEALRDRHVKYVACGSNYTAAICLHKWVSGAEQSQCSSCRLAFGFTRKRHNCYNCGLVHCHSCSSKKAFRAALAPSAGRLYRVCDSCYVKLSKVSEISETTSRRNSVVPRLSGENKDRLDKSEIRLAKFGASNMDLIKQXLDSKAAKQGKKSDNFALGRNSQLPSLMQLKDAVQSNIGRSTPKLVQAPSGITLGRGSPFSRRSSPPRSATPMPSTSG

SEQ ID NO: 3957 - protein, 251 aa, Brassica oleracea var. botrytis
MPIRNIAVGRPDEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTADY

SEQ ID NO: 3958 - protein, 99 aa, Oryza sativa Japonica Group
MAVSASLPAATPAGRHAAAVYVAAVPLRGPKGPAQALMSAGYSLGLWDLQHFMVLLRPDPARAQALVFDFQPRDPEDALAAFAVLSRSEIPGASLQSPP

SEQ ID NO: 3959 - protein, 519 aa, Neorickettsia sennetsu str. Miyayama
MMPEIAIIDLGSQFTQLIARKLRENGCCSCIYNPSGFTFSNDIKGVILSGSHQSTSEYANYRDLIAMVLSLNSTHGIPVLGICYGKQLLSDFLGASVVSGKNREYGRARLQIVAESPIVSNISASDFTVWMSHGDAVVTLPCGFKCVAKTDDCQFALIADENRKIYGFQFHPEVSHTENGGVLLRNFISIAGVENTWDLQVFSEEEKRMVVATTGDAGVLAAVSGGVDSTVAAKFMHGAIGERLHCIFVDTGLLRKNEANEVKESFSSLGIPLKIVFAADRFFKKLAGVADPEQKRRIVGETFIQVFEEEALKIQGVEFLLQGTLYPDVIESGGGGSHTIKSHHNVGGLPKKMGLKLLEPFRLLFKDEVRAIGRQLGVSEVLLMRHPSPGPALAIRILGEVTQEKVAVLQDIDEIYISTMKEYNLYSHIWQAFSVLLPVCSVGVMGDKRSYNYVCALRAIVSHDGMTASAYPFEAHDDDKLRFLSFLNEVATKIPNRVSAVSRVVYDITSKPPATVEWE

SEQ ID NO: 3960 - protein, 213 aa, Zea mays
  misc_feature (26)..(26): Xaa can be any naturally occurring amino acid
MASAAHSRAHSLPPSPPSPPPPPPPXTSPTASDLTAFPPNPNGIFASDRPIDVDAATEAELRENGFRSTRRTKLVCTVGPATSRPDQLEALAVGGMNVARLNMCHGDREWHRAAIRAVRSLNEEKGFAVAVMMDTEGSEIHMGDLGGASSVKAEDGEVWTFSVRSFELPLPERTINVNYDGFAEDVRVGDELLVDGGMARFEVIEKIGPDVKC

SEQ ID NO: 3961 - protein, 307 aa, Nostoc sp. PCC 7120
MKGFDRLDTVDLSNWVTLAKTKTNCGRVVERIPKLAVADTAWFAVHICCQSGKFYSEGDTQCVFPLMSVIKPFTFLYLLEHMGVEKVLSWVGTKPSDAPFNSLEQLVADGGYPRNPMINSGAITLADKLPGEDADHRTRFFCKWLNQLAGSQIQLDESMLASVRLSRSPANQAIANYLAEKGYLEDLDVALDTYEQICCLSGTVEDLALLGKLLALESSSISPQHQQLVNSVMLTCGLYEASAEYAVTIGLPMKSGIGGGLLAIVPTAGAIACYSPALDRIGNPVGAIAFVEVLSRSLGLCGRFSHL

SEQ ID NO: 3962 - protein, 175 aa, Brassica oleracea var. botrytis
ANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLIGGGVAGLIYEVFFINTTHEQLPTTDY

SEQ ID NO: 3963 - protein, 247 aa, Bacillus clausii KSM-K16
MSIESEHDLIALQKIGRIVAMAREEMLSSVQAGITTAELDGIGKRVLDEHGAVSAPYITYGFPGTTCISVNEVAAHGIPGPRVLKEGDVVNIDVSAELGGYYADTGATTVVGSRSPHKEKLCQSSLRALHQGLKKAKAGARISGIGRAIHNEARKGGFTVIRNLAGHGIGRKLHEMPDSILNYYDPRDSRLLTNGLVLAVETFVSDGAEFVDEGADGWGLLLPEHHYAAQFEHTIVITKDKPLILTA

SEQ ID NO: 3964 - protein, 599 aa, Chlorobium tepidum TLS
MVYRKAPKHSGDAPDSSANPADRPASTGKERRYQGIGSAKGFAIGETYEFVRETIEHETADLSPENIEGEIERFMTALHRSEKELKKIERVTTRKIGRLYSDLFQAQIMLLKDPVLTGNITRRIRQELKPAHIVIEQEFGKLLEHFLNSDDVIFRERAADLHDLKERIIRNLHIRKLHSWVPEGSIVVSHHLSPADIILLSRSNIKGFATDTGGKTSHVSLICKSLNIPIVVGLGNFSQKAVSGERIILDGNEGLVITNPLDETVDTYLKKREEESKREADDSIMAHRHAFTRCGVRISVYSNIDFKEEIEHLDSMGAEGVGLFRTENLFLDDLKPPKEAAQQEYYRKMGEMLAPKPLVIRLFDIGGDKLIYSPVKEPNPNLGWRGVRILIDVPEILDAQLQAVIRANIHGNIDVLIPMISSVEEIMHIKQAVEEHYKHIRSLTTEPLDKPGIGAMIEVPAAVELIDEITQIVDFVSIGTNDLTQYTLAVDRNNLIVQDLFEKFHPAVIRQLHRVISTAQKNHCRVSLCGDMGSDPLATPYLIGCGLREFSIVSSDIPALKAMVGKYTVEECEALAAECLKLSSASAIKAHLEAFVKAH

SEQ ID NO: 3965 - protein, 1315 aa, uncultured haloarchaeon
MVNHEYGRAIVLFIILCLIAGNWYVIGSGSASTTNQSSITLDRSLYYENDNIRVTLDDANLSTDIDHFVSIFSETEGQTVVTENVPAGVSSYTTKAPVGERINSTRISESDAEFDYTPDVGTEDDVINKTKYNDNNTVTFFFDKPANSEGEVQIFSLETVTLSHAGDTVFTGTIDISQTDALGTLNAGDGDTITVQYDDMSVQEQRTDNASFSAQNSPTATPTATPTATATPTATSTPTATATATITSTPVSTSTPTPTPTPTPSPTPSPTPTPTQTPTPTPLPTPSPTPTPSPTPTPTQTPTPTLTPTSTPTPSPTPSPTPTPTPPATATPTPTPTSSPTPAPTNTPPPTSAPTPTATPTPTPTPTPTPTATPTPTPSPTPTTTPTPTATATSTPTPPSVEPTTPVDTEDENENESDSDSSSGSSTDSSGGSNSNNKPGKQSTPKAPTPTPTPTPIPSERPTVGSTAGVTTAVTANGEGASTHLELPFTEPVMSAVDGESLAIGQSVDIYIDDQIENDAFSLLQDGSATGQLLLSTYRQFGPETEIRVEVDAVQGTQTGGTLPSTVQSVRVYNHTIKTTADRRVIDTPGFVALQVGDAHSDNNDGVIGQSLRILDADETVIETVQTGVGSQIAIVDMGDYKTGIYTIIAEDGAETTMMVYNLGLDIVVDRQTVTVGSALRGHVAATIETPRVMTVTLITENDTPIAETTATITANGTGIFSINTTAVSNADTEAYRLLVTDPQTNLQVASEPVRFISSTGVGFTQATYADARGDIMEIPLSIGTEHAATVMIGNSSSNIQANVTVQDRTGDGIVTLRFNTDAAIASALDKSERAVFTVKPVSADDQSSGDNHDIIHSTNPTATMTARMADNAVPLSEKHYPVSIKSEATETAFTNNTAMIRIDSPTIETLQVYTAPRGMAFSSVEQITNAIDNEQMTPTGSVASGDVIIYALTAEGFEGRTEQAEEQTIRTFDRTATKHANRYQTPSLSVTYPNATPSISNQLNNSWVMSNTSNHQYYIGATAGTGTNTASEQRVNDSVGTHFTATLQPGTRIDDARPSGSITTPGERLDNSESSSVGKAQKEPSGDWTVQTAVVPQQIVFDTNQTRVAPVSDQYITGTTTVAPGSIMTITLRANASKRQSGGTYPLDKTIRTTIGINRTWSGAFDFSTFDIGQSFVIHSVISQSDSVITQNRMRGYIEVSPADADTVVAKEKTGASGGGGGGGITGILTGLLDSGNERINPEAQPSDTVYNGNTTDAGSVVDGIITGSFIDTELGRVVDNTVKSSIQTRLMNPVAAGFILILSIVSLLLYRRR

SEQ ID NO: 3966 - protein, 123 aa, Paxillus involutus
  misc_feature (30)..(30): Xaa can be any naturally occurring amino acid
  misc_feature (105)..(105): Xaa can be any naturally occurring amino acid
  misc_feature (108)..(108): Xaa can be any naturally occurring amino acid
HSFYQLVHQGTKLIPADFLAPATSHNPIAXSKHHRILLSNFFAQPEALAFGKTEEEVRKELGSGASEALVKSKVFEGNRPSNSIMFPLLTPRTLGALIALYEHKXFTXGVIWGINSFGMLDVV

SEQ ID NO: 3967 - protein, 624 aa, Cryptococcus neoformans var. grubii
MRGVVKLFFLSCSLVSLVSSEETGKSPTANYDHYMPKATATIDPSVFALSNDFEITDVPTTREYTFDITKALASPDGYEREVYVVNNMFPGPVIEANTGDTIIVHVNNHLEEGQSIHWHGLRQLGTAFMDGVPGITQCPIPPGSSFTYQFTVSHQSGTFWWHSHYSNSMADGIWGPLIIHSPNEPLQRGRDYDEDRIVFITDWVHDNSEVVIAALATPEGYKGSPAPPQGDAILINGRGQTNCTATGSSSCTYPPPPEIHVPVNCRVRLRFISATAHPMYRITIDNHPLEVVETDGTAVYGPTVHEISIAPGERYSAIINTSEGKEGDAFWLRTSVALGCMFGGIDQVGLAVVRYTGNGMVSTEEPQTTAWSDLAGATTPCAGLDQTYTLSPRESFSAPREFSQSHVFNSQRGAFVNVYGNTFQGYGFNNISYQNQIFNPLLSIVQRGGSCESTLVASTTFPDLGSGNIIINNLDGVIDHPYHLHGNEFQVIGRGTGALSLDNLTNIDFNLDNPVRKDTLWIQGGSWVVLRITTDNPGVWALHCHIGWHLTEGKLAVVVIQPGAIGHMEGPESWTNLCANTDPNAFGPARRSPSPSIQSSKTSTFQYLREVKGKVVKRRGAREA

SEQ ID NO: 3968 - protein, 566 aa, Physcomitrella patens subsp. patens
GEALISFKRGIQNANLSLWSWNESHSNPCLWSGVTCLPGSDRVHRLNIPNLNLRGFISPELGKLDQLRRLGLHENNLYGSIPREISNCTNLRALYLRGNFLTGNIPEELGNLQRLKILDISNNGLTGSIPESFGRLSELSFLNVSTNFLVGNIPTFGVLAKFGDSSFSSNPGLCGTQIEVVCQSIPHSSPTSNHPNTSKLFILMSAMGTSGIALLVALICCIAFLVFKKRRSNLLQAIQDNNLDGYKLVMFRSDLSYTTDEIYKKIESLCAVDIIGSGSFGTAYRLVMDDGGMFAVKNIVKQEMGSERFFERELEILGNLKHQNLVNLCGYYISASARLLIYDYLAGGNLEDNLHGRCLLHLTWSTRMRIAIGSAQGIAYMHHDCVPGVIHRGIKSSNVLLDNNMEPHVSDFGLAKLVEDDSSHVTTIVAGTFGYLAPEYMESGAATEKGDVYSFGVMLLEMISGKRPTDALLMMKGYNLVTWATYCVKMNQVEELVEESCLEEIPTEQIEPIIQIALQCVSPIPEDRLTMDMVVQLLEIHKLSKCTSDVSNFYHSPISAPEDRGR

SEQ ID NO: 3969 - protein, 831 aa, Salmonella enterica subsp. arizonae serovar 62:z4,z23:--
MLTIEFLCPLPNGIHARPAWELKEQCSQWQSDITFINRRQNVRADAKSSLALIGTGTLFNDSCMLNISGRDEEQAKRSLEVWLAHHFIDSDSVQPGPAELAARPLPRSLLRLNPDLLYGDVLASGVGEGMLTLWQSDNLEGYRTIPASAEDLTRLENSLATLAEQLNQQLRERDGESKTILSAHLSLIQDDEFAGNIRRLMVERHLALGAAIIANMEQVCSQLSASASDYLRERVSDIRDISEQLLHITWPEKQPRNALVLTRPTILVAEDLTPSQFLSLDLQYLSGMILEKTGRTSHTLILARASAIPVLSGLSAEAIGRYATRPAVLDAQCGVLAINPNSSVRGYYAVAEKLADKRQQRQACDAALLACTQDNQRIDIAANIGTALEAPGAFSNGAEGIGLFRTEMLFMDRDSAPDEQEQFEAYQQVLLAAGEKPVIFRTMDIGGDKNIRYLNIPQEDNPFLGYRAVRIYPEFSGLFRTQLRAILRAAVFGHAQLMIPMVHSLDQILWVKSELKKAIAELKEERLRHAQDIPLGIMVEVPSVCYIIDHFCDEVDFFSIGSNDMTQYLYAVDRNNPRVSPLYNPITPSFLRMLRQIIHVAHERGKWVGICGELGGESRYLPLLLGLGLDELSMSSPRIPAVKSQLRHLDSQACRTLARQACECRSAQEIEALLNQFAPEKEVRPLLALENIFVGEPLNNKEQVIQFLCGNLGVNGRTEHPFELEEDVWQREEIVTTAVGFGVAIPHTKSQWIRHSSISIARLAQPVDWQSEMGDVELVIMLTLGADEGINHVKVFSQLARKLVNKNFRQSLFAASDTDSILALLEAELTF

SEQ ID NO: 3970 - protein, 406 aa, Mycobacterium smegmatis str. MC2 155
MSTPGGLQRRLGTFDAVTIGLGSMIGAGIFAAIGPAAAAAGSGLLIGLALAAVVAYCNATSSARLAAIYPQSGGTYVYGRERLGEFWGYLAGWSFAVGKTASCAAMALTVGSYAWPEHANAVAVGAVVALTAVNYVGVQKSAVLTRVIVAVVLAILATVVVLLLGSGDADPARLSLGDDVSAVGVLQAAGLLFFAFAGYARIATLGEEVRDPARIIPRAIRIALGLTLVVYAVVAGAVLAVLGGTDLAGATAPLADAVAAVGAGQWQPLVRAGAAIAALGSLLALILGVSRTTLAMARDHHLPSALGAVHPRFGVPHRAEVTVGVVVAVLAAVADLRGAIGFSSFAVLLYYAIANASAATLGGRLVPAVGLVGCLVLAFTLPLSSVLAGLAVVAAGAVVYGVRRIS

SEQ ID NO: 3971 - protein, 412 aa, Salmonella enterica subsp. arizonae serovar 62:z4,z23:--
MADFRPDRRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLYEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 3972 - protein, 559 aa, Malus x domestica
MGSSGIDWKLPDHPKLPKGKVIGLIVLDGWGEANADQYNCIHVAETPVMDSLKKGAPERWRLVRAHGTAVGLPTEDDMGNSEVGHNALGAGRIFAQGAKLVDAALASGKIFEGEGFKYVKESFETNTLHLIGLMSDGGVHSRLDQLLLLLKGASEQGAKKIRVHILTDGRDVLDGSSVGFAEILENDLAKLREKGVDAQIASGGGRMYVTMDRYENDWSVVKRGWDAQVLGEAPYKFKNAVEAIKTLRAEPNANDQYLPPFVIVDDSGKPVGPIVDGDAVVTFNFRADRMVMIAKALEYADFDKFDRVRVPKIRYAGMLQYDGELKLPSHYLVEPPEIDRTSGEYLTYNGVRTFACSETVKFGHVTFFWNGNRSGYFNDKMEEYVEIPSDSGITFNVQPKMKAVEIAEKARDAILSGKFEQVRVNLPNGDMVGHTGDIEATIVACKAADEAVKIILDAIEKVGGIYVVTADHGNAEDMVKRNKTGQPLLDKSGNIQILTSHTLQPVPIAIGGPGLAPGVRFRKDLPSGGLANVAATVMNLHGFQAPSDYEPSLIEVVDN

SEQ ID NO: 3973 - protein, 435 aa, Prochlorococcus marinus str. MIT 9515
MQIVVVGLSHRTAPVEVREKLSIPDQAISESLKSLRAYSDILEVSILSTCNRLEIYGLVKDKNIGISSIKEFLSDYSQVNCEVLTPHLFDFRQEEAVLHLMKVSAGLDSLVLGEGQILSQVKKMMRLGQENQSTGPILNRLLSQSVSAGKKVRAETNLGTGAVSISSAAVELAQLKIGQDNGIDGLVSLKGEKVLVVGAGRMSRLLITHLKSKGCNKLTLLNRNIDRAINLSGDFPDIEIICKGLDELDKSITLSSLVFTSTASEKPFIDLERIKNISLNNKLKFIDIGVPRNISNDVKQHDLIEAFDVDDLEEVVSRNQEFRQKIAKEAESLVKEERIIFLEWWASLEAVPVINKLRSDLELIRKEELQKALSRMGPDFSARERKVVEALTKGIINKILHTPVTKLRSPQSREERQASLKIVEKLFSLMDDEQK

SEQ ID NO: 3974 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLERVGAEVVECACVIELPELKGRQRLKGKPLCMLVEYR

SEQ ID NO: 3975 - protein, 251 aa, Prochlorococcus marinus str. MIT 9515
MTESNSKNSYSVNRPIQIIPSVLPADWANMGGCVKDLEEAGVDRIQFDVMDGNFVPNLTFGPEMIAACRKYCKVPFETQLMVSQYNCETMLESYVNSTKGPNGEPGVVIAHAESNVHLHRILGRIRDLGGSPSVALNPHTPFEMIENIMDMVDHVLVMTVNPGFGGQAYIPTMLSKIRKIREFVIEKNLNIDIEVDGGIKANWTISQCAAAGANCFIAGSGMFAYPTLKEGCDELRSVAQDAQNGKIISEP

SEQ ID NO: 3976 - protein, 198 aa, Mycoplasma hyopneumoniae 232
MVKCKLFFWLISWFLKVKNGEKVWKFLKSCPENCYSEPQFAFIGRSNVGKSTLINALANKKIAKTSTKPGRTQLLNFYKNESEKLFVDLPGYGYAAVSKTKKHQIDRIIAGYFQKDQPISAVFLILDARVGFTNLDYIMIEYIIQQGFKLHILANKIDKTNQSTRAILLNQCKKLKLNCLLISAKNKNNLSKLQELLE

SEQ ID NO: 3977 - protein, 519 aa, Mycobacterium sp. MCS
MNSPSPRPVLVVDFGAQYAQLIARRVREARVFSEVVPHTATVEEIKAKDPQAIVLSGGPASVYADGAPQLDPALFDLDVPVFGICYGFQAMAQALGGTVTHTGTREYGRTELKVAGGELHSDLPAVQPVWMSHGDAVTEAPSGFEVVATSAGAPVAAFENRARRLAGVQYHPEVLHSPHGQQVLSRFLHEFAGIGAKWTPANIADALVEQVREQIGDGRAICGLSGGVDSAVAAALVQRAIGDRLTCVFVDHGLLRSGERAQVQRDFVAATGANLVTVDVADRFLQELSGVTNPEGKRKIIGREFISAFDDAVVDIVGDSGAPVEFLVQGTLYPDVVESGGGSGTANIKSHHNVGGLPADLKFKLVEPLRLLFKDEVRAVGRELGLPEDIVARQPFPGPGLGIRIVGEVTRGRLETLRHADAIAREELTAAGLDNQIWQCPVVLLADVRSVGVQGDGRTYGHPIVLRPVSSEDAMTADWTRVPYEVLERISTRITNEVPEVNRVVLDVTSKPPGTIEWE

SEQ ID NO: 3978 - protein, 192 aa, Corynebacterium efficiens
MDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 3979 - protein, 210 aa, Triticum aestivum
  misc_feature (73)..(73): Xaa can be any naturally occurring amino acid
  misc_feature (176)..(176): Xaa can be any naturally occurring amino acid
  misc_feature (194)..(194): Xaa can be any naturally occurring amino acid
AYLGDTIEQVCTKKQAGTGPEFPGYRRPTRPIVEPEILVDGPHDIDRCAYVTEIVLAACYKALNDQHVLLEGXTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLXRCKANSEATLGTYKGDAXLGEGASESLHVKDYKY

SEQ ID NO: 3980 - protein, 919 aa, Candida albicans SC5314
MKVVSNFIFTILLTLNLSAALEVVTSRIDRGGIQGFHGDVKVHSGATWAILGTTLCSFFGGLEVEKGASLFIKSDNGPVLALNVALSTLVRPVINNGVISLNSKSSTSFSNFDIGGSSFTNNGEIYLASSGLVKSTAYLYAREWTNNGLIVAYQNQKAAGNIAFGTAYQTITNNGQICLRHQDFVPATKIKGTGCVTADEDTWIKLGNTILSVEPTHNFYLKDSKSSLIVHAVSSNQTFTVHGFGNGNKLGLTLPLTGNRDHFRFEYYPDTGILQLRAAALPQYFKIGKGYDSKLFRIVNSRGLKNAVTYDGPVPNNEIPAVCLIPCTNGPSAPESESDLNTPTTSSIGTSSYSTAATESSVVSESSSAVDSLTSSSLSSKSESSEVVSSTTNIESSSTAIETTMNSESSTDAGSSSISQSESSSTAIASSSETSSSESMSASSTTESNTSIETDSGIVSQSESSSSALSSTEQSITSSPGQSTIYVNSTVTSTITSCDENKCTEDVVTIFTTVPCSTDCVPTTGDIPMSTSYTQRTVTSTITNCDEVSCSQDVVTYTTNVPHTTVDATTTTATSTGGDNSTGGNESGSNHGSGAGSNEGSQSGPNNGSGSGCEGGSNNGSGSGSDSGSNNGSGSGSNNGSGSGSNNGSGSGSGSTEGSEGGSGSNEGSNHGSNEGSGSGSGSQTGSGSGSNNGSGSGSQSGSGSGSQSGSESGSNSGSNEGSNPGAGNGSNEGSGQGSGNGSEAGSGQGSGPNNGSGSGHNDGSGSGSNQGSNSGAGSGSGSESGSNAGSHSGSNEGAKTDSIEGFHTESKPGFNTGVHTDATATGNSVANPVTTSTESDTTISVTVSITSYMTGFDGKPKPFTTVDVIPVPHSMPSNTTDSSSSVPTIDTNENGSSIVTGGKSILFGLIVSMVVLFM

SEQ ID NO: 3981 - protein, 349 aa, Mycobacterium sp. MCS
MTIRDNESAAPIPVFADVDTGVDDAMALVYLFASEDADVVGIASTAGNVGVDQVCHNNLALLDLCGTHDVPVSRGADGPIASALRTAEDTHGPEGLGYAHLPSSGSTVTTYDAAEAWVRAARAHPGELVGIAVGPLTNLALAVRAEPALPTLLRRLVIMGGAFDYRGNTTAVAEWNVSVDPEAAAEVFHAWSAPGLTPPIVLGLNLTEHIALTPTLLTRLAAAAQSPTRAMSVLDDRGTRSVAANPLIRVLEDALRFYFEFHFDQGEGYLAHLHDPLAAAVALDPDLVQYRAATVDVELTGTLTRGMTIADWNGRWGRPPNALVGIGVDAGVFFDRFIDRVGLFARRLG

SEQ ID NO: 3982 - protein, 400 aa, Yersinia pestis KIM
MTVYSLEDVLIKSALLVLEDGTQFHGRAIGAEGTAVGEVVFNTSMTGYQEILTDPSYSRQIVTLTYPHIGNVGTNASDEESSAVHAQGLVIRDLPLIASNYRNEEGLSEYLKRHNIVAIADIDTRKLTRLLREKGAQNGCIIVGELSDAALALEKAKAFPGLKGMDLAKEVTTKEMYQWLQGSWTLEGDLPAAKQPEDLPFHVVAYDYGVKRNILRMLVDRGCRLTVVPAQTPAEDVLKLNPDGIFLSNGPGDPEPCDYAITAIKRFLETDIPVFGICLGHQLLALASGAKTVKMKFGHHGGNHPVKDLDASCVMITAQNHGFAVDETSLPSNLRTTHVSLFDGSLQGLHRTDKAAFSFQGHPEASPGPHDAAPLFDHFIELIEAYRASSVSLNCSNSHK

SEQ ID NO: 3983 - protein, 94 aa, Triticum aestivum
AMSLADRTGMFACPHTGVALAALFKLREEGTIGANDRTVVVSTAHGLKFSQSKIDYHDQKIEDMACKYANPPVSVKADFGAVMDVLKKRLKGKL

SEQ ID NO: 3984 - protein, 468 aa, Neorickettsia sennetsu str. Miyayama
MTNNRAASILEFVAKNEIRFIDFRFTSITGKFLHITRHSDSITADALTHGISLDSSLIQGWHDVDRSDVVLVPDLESCSSFLDPFAAQPTLCVVCDIVEPHGRGSYEHSPRATTKKAMEFLRSIGIADKAFFGLEMEFFVLDDARFAVKENGAFFELDSSEGIYNSGRRYEYNNHAHREGSRNCYLASQPSDSLNDIRAEILETLREVKIKPLLHHHGAASSQCRICFHHGEALETSDNMQKCKYITRNVASSYGKSATFMPKPFKDYNGNGMRLHVSLWKDEQNLFVPQDPREEISQLCKYYIGGIIKHRKALNAILNPLANSYKRLADIHNASYGLGYSPENRLAVVRIPHCRKGNPSGKRIEIRFPDAGTNPYIGTAALIMAGIAGIREKVLPEAAVELEKSSKVSLCRSLEEALLALDTDRQFLTEGDVFTNDQLDTYIKLLSDDSEEVSKHPVPIEFIKYYNV

SEQ ID NO: 3985 - protein, 146 aa, Triticum aestivum
AGRAGSSQTLPMDAYDGLAHLVVNETEAAILAECNEPELDTPAGLERVGRVFIDRGVHNVIITLGGRGVYFVNKQGQSALLPATKTTVVDTTAAGDTFVGSYSLAAVAARGGQFDIEAAVTAANRAAALTVARKGAQISIPWKDEL

SEQ ID NO: 3986 - protein, 400 aa, Bacillus clausii KSM-K16
MKAYEQTVTVSDKVAVRLKKGHPLFHKDDFHLPADVREGTILRVTDSGGRFLVRGYYGKQNVGQGWVLSTNKDESIDVRFFKGKIETALNKRAGLFVNEETTAFRVLNGEGDGVGGLTIDYYEGFFLVTWYSKGMYSFRSQVLEALTACTAYKGIYEKKRFASEGQYVEDDDFVCGERGQFPLLVKENGMYFAVYLNDGPMTGIFLDQRHVRKQIRDQYAPGARMLNLFSYTGAFSVAAALGGAANTTSVDLANRSRSKTEEQFLINGIAVEDQHIVVMDAFRYLSYAEKNRLEFDLVVLDPPSFARSKKRTFSAAKDYTLLLEKALSVTAPNGIIVASTNAANVERRRFKQFVDQACTAKNCSYELLEEHRLPEDFATSPAYPQGQYLKVLIIRITGKE

SEQ ID NO: 3987 - protein, 502 aa, Aspergillus oryzae
MSDVTVQLTAPNGRKYAQPIGLFINNEFVPSKSGEKFATINPADEKEIASVYAAGEEDIDIAVKAARKAFKDPSWKLLPPTDRGALMLKLADLIEQHREILATIETWDNGKPYSVSLSSDLGEVINTLRYYAGWADKVHGQTISTTPDKLAYTLRQPIGVVGQIIPWNFPLAMAAWKLGPALACGNTIVMKPAEQTPLSILYLATLIKEAGFPPGVINIVNGLGRVAGSALVTHPDVDKVAFTGSTLTGREVMKLAAGTLKNITLETGGKSPLVVFGDADIEQAAKWAHIGIMYNQGQVCTATSRILVHESIYDKFIELFKQEVASVSKVGDPFADDTFQGPQVTKAQYDRVLSYIEAGKSEGATLVAGGEPYKNVGDGKGFFIAPTIFTNVKDNMRIYREEVFGPFVVISSFAAEDEAVTRANDTTYGLGAAIFTKDIERAHRVASEIEAGMVWINSSNDSDFRVPFGGIKQSGIGRELGEAGLEAYSQVKAIHVNLGSKL

SEQ ID NO: 3988 - protein, 263 aa, Triticum aestivum
  misc_feature (47)..(47): Xaa can be any naturally occurring amino acid
MAANFWTSSHSKQLLDPEEVDVVPAADRERGVTPVEFRLVKIHMSFXHLIISDIWRLAQQVKVRQRVIATAITYFRRVYTRKSMTEYDPRLVAPACLYLASKVEESTVQARLLVFYIKKMWGSDDKYRFEIKDILEMEMKLLEALDYYLVVYHPYRPLLHLLQDAGVTDLTQFAWGLVNDTYKMDLILVQPPYMIALACIYIASVLKDKDTTSWFEELHVDMNIVKNISMEILDFYETYKVDPQRGLSDEKISPIMNKLPAKA

SEQ ID NO: 3989 - protein, 225 aa, Aspergillus oryzae
MAQERAAPIRLGSTAPNFDADTSNGPISFHDYIGNSWAILFSHPDDFTPICTTELGAFAKLEPEFTARGVKLIGLSANGTDSHKLWIKDIDEVTGSKLTFPIIADPERKVAYAYDMVDYQDTTNVDSKGLALTIRSVFIIDPNKKIRLIMSYPASTGRNTAEVLRVVDALQTTDKHGVTTPINWLPGDDVVIPPPVSTEDAQKKFGEIRAVKPYLRFTNLNNKKE

SEQ ID NO: 3990 - protein, 178 aa, Triticum aestivum
  misc_feature (76)..(76): Xaa can be any naturally occurring amino acid
  misc_feature (102)..(103): Xaa can be any naturally occurring amino acid
  misc_feature (107)..(107): Xaa can be any naturally occurring amino acid
  misc_feature (111)..(111): Xaa can be any naturally occurring amino acid
  misc_feature (139)..(140): Xaa can be any naturally occurring amino acid
  misc_feature (161)..(162): Xaa can be any naturally occurring amino acid
RTRACCEACANLKGAFLVAVLFLAFCLVITVIFAKEIPYKAIAPLPTKANGQLKSEPTGPLAVFKGSKNFPPGNAXSVLLRHWLNWLSWFPFILYDTDWMVXXIYNXDPKXNPEQGNAFQASVKGPGVSAAINSVLLGXXSFLINRCQKVSPRCVGVQKSXXLRNCTKGGTKIQGLSI

SEQ ID NO: 3991 - protein, 342 aa, Gluconobacter oxydans 621H
MPRSLRKAREGGSLPENPYNAGERIVSTTAATLTPRHFLDLRDFSPEVIRQIIDLSAKVKALQNGRRQPLHPDRPLEGRSLGLILAQPSTRTRVSFEVGMGQLGGSVSVLSPGDMQLGRGETVADTARVLSRFLDVIVLRTGNDANLRELAKWSSVPVINGLTPVSHPIQILAGVLTFEEHRGPIRGKTLAWIGDGNNVATSLMEGAALLGFNVRLATPEGFAPNPDAVAWARAHGATIEIFRDPAEAVAGADAVLTDTWVSMGDKDREKRLKVFQPYQVDGALMAKAAPDALFLHCLPAHIGEEVTSEVFEGPASVVFDEAENRLHTQKGLLLWALGKENG

SEQ ID NO: 3992 - protein, 507 aa, Rhodococcus erythropolis
MTVYARPGTADAIMSFQSRYDNWIGNEWVAPVKGQYFENPTPVTGQNFCDVARSTAEDIELALDAAHAAAPAWGKTSVAERAIILNKIADRMEENLESIALAESWDNGKPIRETLNADIPLAIDHFRYFAGAIRAQEGSLSEINSDTVAYHFHEPLGVVGQIIPWNFPILMAVWKLAPALAAGNAIVLKPAEQTPVSILHLIGIIGDLLPAGVLNIVNGFGVEAGKPLASSPRIKKIAFTGETTTGRLIMQYASQNLIPVTLELGGKSPNIFFSDVLASNDDYQDKALEGFTMFALNQGEVCTCPSRSLIQEDIFDEFLAMAAIRTKAVRQGDPLDTDTMIGAQASNDQLEKILSYIEIGKAEGAKVITGGERAELGGDLSGGYYVQPTVFTGNNKMRIFQEEIFGPVVSVTSFKDYDEAIEIANDTLYGLGAGVWSRDGGVAYRAGRDIQAGRVWTNTYHQYPAHAAFGGYKQSGIGRENHLMMLSHYQQTKNLLVSYAQKAQGFF

SEQ ID NO: 3993 - protein, 699 aa, Rhodopirellula baltica SH 1
MIQRSVYIGTNGNATGKRMVALGMMELAARRFGRVAFFRPVVHVGPNEDQSIRMMRSRYGIVTPADEMFGVTRAQARQMLADDRYSNLIQLIQQRFKSLEAKADFVVVEGTSYQGLAPELEFELNADIAANIGSRVLSVYAMGDRSVDECVQSVLIGNESFVDRGAQLIATIINKVPDDQSTALNAAIKTSKLDSKAPLYFLPDEPLLRQPTVREIQSGIGAKLVSGDESSLDREVAVRKVAAMQLPGFLERLSNAALVMTPGDRSDILVGCVLACSQPDGPSPAAVVLTGGILPPPSIRRLVENANALPILVAIEDTYTVASKAAEVRAEIGDHSPRKIESAIGVFERHVDTDSLADRLQAPIVPRITPMLFEHSLIQRARQQRVKIVLPEATEPRILQAVDVLRRRDVTDVVLLGDPNLIAAAAARAGVMLPNDGLEIIDPATSPLRNSFASEYYQLRKHKGVTTDIAHDRMIDVTYFGTMLVHRGLAGGLVSGAVHTTANTIRPAFEFIRTRPDVNVVSSVFLMCLKNGVLVYGDCAVIPNPTAEQLTEIAISSAETAVQFGIEPRIAMLSYSTGESGHGEDVDKVREATAMVRKRRPDLLVEGPLQYDAAVDPDVAATKMPGNPVAGQATVLVFPDLNTGNNLYKAVQRSAGAIAIGPVLQGLNKPVNDLSRGCTVTDIVNTVAITAIQAQTVAS

SEQ ID NO: 3994 - protein, 255 aa, Escherichia coli O157:H7 EDL933
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 3995 - protein, 596 aa, Prochlorococcus marinus str. MIT 9515
MIKVEKVKKKKKIEKQETVCLANGLEVSKFENFKKGSEFLKEPLASELKNESDHFTNDAVQLLKFHGSYQQDNRENRKPGKGKDWQMMLRLRSPGGEIPGKLFLSLDELSDKLGNGTLRITTRQAFQMHGIRKDNLKKVIKSIVNSMGSTLAACGDINRNVMAPAAPFETSEYITARTLAVKVADLLTPVAGQGTFLELWADGDLEYTIKPDKEIEENRKLQFKENVFSGSKKEPLYGSTYLPRKFKCAVTVPGDNSVDLLTNDIGIVAFTSKEGEFEGCNFYIGGGMGRTHNNEETFARIADPLGYVDKKDIYELIQSIVAIQRDYGDRKSRKNSRMKYLLHRKGIKWFKKILLDKYFRKEIKPLRKEPENKLIDYLGWHKQNEDYYFVGLPLLSGRLYGKKKSLIRNIVKENNLDLRLTPNQDILLCNIPKKNKREIQKALKSIGYDNLHDINEIQRHALACPALPLCGLAMTEAERILPEVLSRIENLLNDMNIEKTILFRMTGCPNGCTRPYMAELALVGSGQNKYQLWLGGSKNLQRLARPYLQRMDLDDLEKTIKPLLEFWKKSNPEKDFGDFINNETDSSINNLLIEFD

SEQ ID NO: 3996 - protein, 499 aa, Legionella pneumophila str. Lens
MIRNSMKSHTELLSWSLLQKEAKRVRLNSDSQPRVVPDSNNYESRKQINCIVYDYSRQRVNRTIIDLLIDLANEVKLPEKIDNLINGKKINISENRPALHTALRDLSNKSILIDGLDIMSEVVSTREKIRMISNRIREKKWLGYSGLPITDVVNIGIGGSDLGPRVCIHALSNYVSKEFNYHFISDVDPASFNDVIVKINPETTLFIVSSKSFTTKETLLNARKAFALYEDRASIDQHFIAVTAHPERAHQIGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGRMVGYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSEL

SEQ ID NO: 3997 - protein, 291 aa, Legionella pneumophila str. Lens
MKGIILAGGFGTRLYPLTKSISKHMIPVYDKPMIYYAISTLMLANIREILIISTEEHLPLYQNLLSDGSQWGISFAYLVQNEPRGIAEAFILGEKFIGNDSVCLVLGDNIHQGRGFSELLQNAKSKLNGATVFAYYVDKPQAYGVVEFNEKQQVLSIVEKPAQPKSNYAVTGLYFYDNQVIEIAKSLKPSGRGELEITDINQFYLYENKLDVQILGRGFVWLDMGTPETLLSASNYICTIEQRQGLKIGCPEEIAWRMKFISDDELLCRARELNKSSYGQYLAELLNHKRY

SEQ ID NO: 3998 - protein, 501 aa, Burkholderia pseudomallei K96243
MNLAALSTQHQRQSGFLARRQFGNWIDGRAAEPRSGCYLPVVDPATEMTIAEVAASDARDVDAAVAAARRAFDSGDWPRMRPASREKLLHQLAERLERYADELAALETLETGKLIGVARAIDVLGGAEYVRYMAGWATKLEGSTLDTSIAAPAGAEYFAYTRREAVGVVGAIVPWNFPLAIALWKVATALACGCTVVLKPSEETPLTALRLGELAQEAGLPDGVLNIVTGAGAEAGAALAAHPGIDKITFTGSVGVGRAIGHAAVERMARFTLELGGKSPLIVLDDADPDFAAHGAAQGIFFNQGQVCTAGSRVYVQKRLFERVVAGIAAAAEAMKIGSGFDPNTQIGPLVSKRHFERVLGHVDAAKEEGATLVTGGTRALDGGYFVKPTVFVDAAPAMRIVREEVFGPVVTVTPFDTVDDAVRLANDTDFGLAASVWSQNLSHVHRVVPRLKAGIVWVNTHNMLDPNLPFGGFKQSGYGRELGRAALEQFTELKSVCIAH

SEQ ID NO: 3999 - protein, 239 aa, Zea mays
MAKPAAARKPSAASTVALTLVLALASAVLLFLLLRFSPSSPSPNPHPHRRLRLRPRAHAHHHQIPFDPVVADIERRLEDREWERLAAAGLHAPGMEAAPVPEDLTDGEVDADEDYINDAARFNVTLRVEALFPKIDVDPADGAVTGAELAAWNLANARREVLHRTARELELHDRDHDGRVAYGEYERPSWAWRFDDHNSTDDGVGWWKEEHFSAADMDGDGFLNLTEFNDFLHPADTTN

SEQ ID NO: 4000 - protein, 463 aa, Ustilago maydis 521
MPAKLPFLDASESLQQRWREATSPTRISAQIYVFLLLITIGLLRQYLFPSKRSNHTYGSSLASTEPGAKDETLGEISEIFIYPIKSCAGVSVSKAQLTEQGFDLDRRWMVVRTNKQGKLEKISLREEPRLTLIQPEIDELANTLALRLTDVGRQQETARNLGETGTPLRPSAIQLKAWKQVASVEMYGDYADGRVAALAEGGKHKFSPSEWISEFLGYPVLLLHFDTTSTTTRNAFPIFKPPTDSFTWSSHDRSELYRKRRIEFQDEYPLLVASAESLDFVRSQLSSALTCTDGDGRGGRAITGIDATKWSDPTTLSIARFRPNIVVKGNGGFGAFSEDSWERIWILSPSSEQSSKPKAMLQLVARCQRCLLTAVDPISAEKDPSVPLKLLSRSRMRVKKVAGVQGGNGRAGPCFGMYAIPLPLGRDVEDKDKYGGLVKGDAIRVRWRPFELDDEPDRQCLTE

SEQ ID NO: 4001 - protein, 259 aa, Mesorhizobium sp. BNC1
MSTSSFDDRAGHPSGFLRPGLFEGRQVLVSGGTSGIGAAIAEAFAALGADVLATGATEAEVGAAENMVKCEGVRFARLDVRDRAAVDALVAGLPRLDHVVNCAGVIRRNDELDPDVFADTVDINLNGSMRICAAARPRLAETRGTIVNTASMLSFFGSGISPGYSSSKGGVAQLTKSLAIAYAADNIRVNAIAPGWIATPLTRALRQDPARETAILARTPLGRWGEPSDLAGGVLFLSSPLASFVTGAVLVIDGGYLIT

SEQ ID NO: 4002 - protein, 458 aa, Acinetobacter sp. ADP1
MTDQHAHELKKGLSNRHVQLIALGGAIGTGLFLGISHTIQLAGPAVLLGYAIAGMIAFLIMRQLGEMVVEEPVSGSFSYFAHKYWSSMAGFMSGWNYWVLYVLVSMAELSAIGIFVQFWWPQIPTWLTALVFFVLINAINLINVRFFGELEFWFSCIKIIAIISMIGFGAYLLLSGTAGAHAGIANLWQHGGFMPNGWTGLIIAMAFIMFAFGGLELVGIAAAETKNPTQTIPKATNQIVYRILIFYIGAIAILLSLYPWNQVAQGGSPFVMIFQSLNNTGVAHVLNMVVLIAAISVYNSCVYSNSRMLLGLAEQGNAPKLLKRVNARGIPVYAVYASVMVTALCVLLNYVMPEKAFNLLMMLVVAALVINWLMISITHLKFRQYMLEAGRKPIFRSLGAPFTNYITIAFVFFILLIMSYTSEMRIAVFLVPVWLGILYIFYRFKAPASKMTESVLDQ

SEQ ID NO: 4003 - protein, 219 aa, Oryza sativa
MGFTMNSLSNGLLKGLRRVLEQQRKPIGGLFFMFLLNFYRKSQAWSSTVSFSDIDEKSEMGGDDDYTDSRRELEPQSVDPKKGWGFRGVHRAIICGKVGQVPVQKILRNGRTVTVFTVGTGGMFDQRVVGDADLPKPAQWHRIAIHNDQLGAFAVQKLVKNSAVYVEGDIETRVYNDSINDQVKNIPEICLRRDGKIRLIKSGESAASISLDELREGLF

SEQ ID NO: 4004 - protein, 427 aa, Gluconobacter oxydans 621H
MKPCSGQPEQGFAIPHKPFRFQPDIQRSIMIPALMPNYKRADLAFEQGEGVWLTATNGRRYLDFGAGIAVTSLGHAHPKLVKTIAEQAAKVMHVSNLYRIPQAEKLAELLVQNTFADSVLFCNSGAEANEGMVKMIRRAQFENGHPERTNILCFDGAFHGRTLAMISATGNPAYQKGFGPVVEGFDHAPFNNTNTLRDAITPHTAGIVVEPVQGESGIKPATREFMEGLRAVCDEFGLYLGFDEVQTGVGRTGKLFAHEWYGVRPDVISVAKGIGGGFPLGAVLATEELARHLTPGSHGTTFGGNPLACAAGVTVLEEILSPGFLEHVRSVGDAFGKMLEDVVSRSEGVFDNVRGIGLMRGLHCVPPVADVMQAVLNQELLTVSAGDNVLRLVPPLVVTEAECREACERLVKAAHSLKTPTTQENAS

SEQ ID NO: 4005 - protein, 321 aa, Triticum aestivum
MAASLLHAAASSPLAGPSPAARAAFRPLASSPFLRLARSSPDRRARLDAPLRALSGGARLAAPRSRRFVAALAGEEPMSSELGDDKEKETEKIEIEPEEAQEVWREMLKQFKAEAIRMQALTTQAYDVYSKRAREVLLEASEKLRIQADKAQKDLTIIAAEVGEEGQEYLQLAAKNSPDSIKDITETINAVGNLNGPSDYKDYHVGISFGTFLTVGGFLNFMLTGSTSAIRFGFVLGFALLALGISSLRSQRAGGRQPRLLLKGQAAIASVIFFKDLSVFFRYGWFPNVFAVLLSGMVATFYIHRIVTGGHNGRTESSSDN

SEQ ID NO: 4006 - protein, 458 aa, Anabaena variabilis ATCC 29413
METADVIVIGSGQGGIPLAADFANEGRKVVLFERDALGGSCINYGCTPSKAFLAAAHTAGRANQGKKLGIHTEVEVDFPAVMERVREIRSSFNQGIRQRLESAGVKVICAEASFVGERTVKGGDVTLQAPLVIINTGTSSLIPDIPGLAGTPYLTNRNFFDLNTLPARLLVIGGGYIGLELGQGLARLGSQTHLIVRGDRVLGQEEADVSEVLAEALKQDGIGLHFGVNVNHVAHENNVFKLTLSSGEQLQGEALLVVIGRKPNTGALNAANSGIELDDKGFVKIDDQFHTTCSGVYAIGDAAKQPAFTHVSWEDYRRLKAILCGENRTRSDRVLGYAVYTEPQVGRVGMTLEQAQKQGINACAVTLPMSQIARAIEWGHDLGFYRMVIDSDTDKILGATLVGYETAELVHVFLSLIEAGATWQLLERSVHIHPTYGEALPSLARLLLGDNMPGCPNM

SEQ ID NO: 4007 - protein, 563 aa, Photobacterium sp. SKA34
MLLFHALSQAWKDGYSFSKLRADIVSGITVGIVAIPLGMALSIAVGVPPQHGLYTVIVAGFLAALLGGSRFNITGPTAAFVVILLPITQKYGLSGLMLATMMSGIILLLMGIFRLGQLVAYVPYPVTTGFTAGVGFVIAFLQLKDLLGLHIQGSPIHFPEKVMSYAHALPTANYADAIVGVVTIFVFIGWAKLKTRIPPHLVSLLVGTVLALAVNKVGPEHVTLLGEKFSYTIGSLVGHGIPQEAPQFIALWKSNTFNWATVIELMPSALTIAMLGCIESLLCAVVADGMTSKKHNPNAELVGQGIANMVVPFFGGIPATAAIARTATNIRSGAFSPISGMTHALFVLAAMMVLAPVLSFVPMSALAGLLIMVAWNMSEAPHFVHTLKVAPRRDVAVLMTCFILTVAFDMVVAVIVGLLLAGVLFIQRIATLTTVTITHDEHPHLYLGHDVVVYDINGPLFFAASEKAFSVIEHATIETRAVVLDFSDVSTIDITAIHAFDMALERLSELPVYLLGAQPHVERKLYHAGIFEAENVHLAHSISHLQQVLLINSHNDSDQESTL

SEQ ID NO: 4008 - protein, 319 aa, Magnaporthe grisea 70-15
MTATKLLRTSMSVLWRPRQVRTSAVTYSICNLATRRAVHSSSKPLWAVVPRRPKLQTQQLRGGISGGADSRRTIFIQTEPTPNSDALKFLPNHRVLPEDISTPFIEYLNPRSTIAPPYPSPLAAQLMNIDGVQSVFYGADFITVTKASDANWAHIRPEIFSLITEAITSGQKIVNIVERTDASGEDGQETSGEVDSLSYNENDSEVVGMIKELLETRIRPAIQEDGGDIEFRGFEDGNVLLKLRGACRTCDSSTVTLKNGIEGMLMHYIEEVQGVIQVMDPEEEIAAKEFAKFEEKLRAQKGEAPPSTVGKGSLDTVSG

SEQ ID NO: 4009 - protein, 432 aa, Chlorobium tepidum TLS
MDKTRIALIGLGYVGLPLAVEFAKKFPVAGFDIKQERIEELNNGCDSTLEVDAEALGAVLTASNPLTADGDKGLFVTSSIAEIAKANIYIVTVPTPTDKHNRPVLTPLIRASETVGQVLEKGDIVIYESTVYPGATEEDCVPVLERVSGLTFNRDFFVGYSPERINPGDKEHTVTKIKKVTSGSTPEAARKIDELYASVITAGTHLASSIRVAEAAKVIENSQRDINIAFVNELAMIFNRMGIDTLDVLRAAGTKWNFLPFRPGLVGGHCIGVDPYYLAQKAQEYGYHPEIILAGRRLNDNMGRYVASEVVKLMISRDLKVKGSKVLMLGITFKENCPDIRNTRAVDIVAELREYGAQVHIHDPWANPEEVRHEYGLDCIDAPVEGGYDAIILAVAHAAFAEMAIGKLRSGDNAVIYDVKGVLPTDAIDGRL

SEQ ID NO: 4010 - protein, 290 aa, Mycobacterium smegmatis str. MC2 155
MTQWTSADLPSFRGRTVVITGANSGLGLVTARELARVGAKVIVAVRNLDKGTAAAETMPGGIVEVRKLDLQDLASVHEFADTVETVDVLVNNAGIMAVPLARTVDGFESQIGTNHLGHFALTNLLLPKISDRVVTVSSMMHWIGRINLRDLNWKARPYSAWLAYGQSKLANLMFTSELQRRLVASGSSVRALAAHPGYSATNLQGHSGNRFGTAAAALGNRHLATDVTFGARQTLYAVSQDLPGDTFVGPRFGQWGPTGSVGRSPLARRTDTQRALWELSEQLTGTTYPL

SEQ ID NO: 4011 - protein, 350 aa, Chlorobium tepidum TLS
MKILVTGAAGFIGFHLCERLASRGDDVVGIDNINDYYDQRVKYGRLAYSGIAESAIEYGKTVQSSKYPNYRFVKLNLEDKEGIDNLFKAEKFDALCNLAAQAGVRYSLTNPASYVSSNIVGFVNLLEAARHNSLGNFCYASSSSVYGLNERQPFSVHDNVDHPVSLYAASKKSNELMAHTYSHLFGIPTTGLRFFTVYGPWGRPDMALFLFTKAALEGRPIDVFNYGNMQRDFTYIDDIVEGVVRVLDHPAQPNPDWSGAAPDPGTSSAPYRVYNIGNNKTVKLMDYIEALENALGVTIEKNLLPIQPGDVPSTWANVSDLVKDFDYKPETTVQEGVNRFIAWYREFFKV

SEQ ID NO: 4012 - protein, 165 aa, Triticum aestivum
HYRTSLYKKAGWYRSGIPGISSTHASEAPNPTPAPKKASRAFSTFPSLAMAAKAPALAAALLLLAAAALLLARGAEAGATEVPLSWELGVEDVADDGFGFAGAGGDEAVAARRVLQSGNGYISYGALRRDNVPCSVRGSSYYNCRPGGQANPYSRGCSAITRCRG

SEQ ID NO: 4013 - protein, 714 aa, Salmonella enterica subsp. arizonae serovar 62:z4,z23:--
MTTSAFTLNVRLDNVAVVSIDVPGEKVNTLKAEFAAQARAILKQIRENKVLQGVVFISAKADNFIAGADINMIGRCQSAQEAETLARQGQQLMAEIQALPVPVIAAIHGACLGGGLEMALACHRRICTDDVKTVLGLPEVQLGLLPGSGGTQRLPRLVGVSTALDMILTGKQLRARQALKTGLVDDVVPQTILLEAAVELAKKDRLAQRTLPVRERILAGALGRTLLFRLVRKKTAQKTQGNYPATERIIDVIETGLAQGSGNGYDAEACAFGELAMTPQSQALRNLFFASTQVKKDPGSDAPSGPLNSVGILGGGLMGGGIALVTACKGGLPVRIKDINAKGINHALKYSWDQLETKVRRRHIKASERDKQLALISGSTDYRGFSHRDLIIEAVFEDLSLKQQMVAEVEQNCASHTIFASNTSSLPIGDIAAYAGRPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDGRKGRKNGRGFYLYGEKGRESKKKVDNAIYKVIGVQGQSRLSAHQVAERCVMLMLNEAARCFDEKVIRSARDGDIGAVFGIGFPPFLGGPFRYMDALGPGEVVATLQRLAALYGPRYAPCEQLMRMAERGEHFWMNEETDQGN

SEQ ID NO: 4014 - protein, 375 aa, Brucella melitensis 16M
MKFKAAVLDRHGVERPYNQTKPLVIREVELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 4015 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 4016 - protein, 393 aa, Glycine max
MASSLLQPSSSSSLFAGTLRTLDFVDHSRARISAPYTVKCDMSESSNFVNGKPIIPVLNERTLPKFMESAREAKAVSRNSNRLKLFSGTANPTLSQEIARYMGLELGKISIKRFADGEIYVQLQESVRGCNVYLIQPTCPPANENLMELKIMIDACRRASAKNITAVIPYFGYARADRKTQGRESIAAKLVANLITKAGADRVLACDLHSGQSMGYFDIPVDHVHCQPVILDYLASKTISSSDLVVVSPDVGGVARARAFAKKLSDAPLAIVDKRRHGHNVAEVMNLIGDVKGKVAVMVDDMIDTAGTIAKGAALLHEEGAREVYACCTHAVFSPPAIERLSGGLFHEVIITNTIPVAEKNYFPQLTILTVANLLGETIWRVHDDSSVSSIFQ

SEQ ID NO: 4017 - protein, 561 aa, Ustilago maydis 521
MRKRSHPEDEEEPKIKRVHIDDADLDDLEDGSDDDDQGMVDGNAAKSSAASLNGEQGSTNGIPLGRNAVQPAAERDQAEVDELDLTNTTSVRNVASLLENGSKVKQVLEQIDHFMALAEPDLAGVLEDSPEYHLIVKANNVAVDVDNEVMVVHKFIRDHYSPRFPELESLIPNPWDYVQAVKAIGNYDTIPTSSLEGVLPHGTVVVISMAASTTTGQTLPVSEWHAVQEGLEMVLELESVRSRILAYVESRMAFVAPNLSAVVGTRTATKLLGVAGGLDGLSKIPACNLHLLGAAKKHSMGLSSVHGGSARSTGFIVQSDLVANTPDDYKRQAIRMVSAKALLAARMDAGKTTSRDGSYGVKLHEELLKKIEKLLEPPPQKLEKVLPIPKEGGGKKKRGGRKARKAKERNGMTELRKMQNRMEFGKQEEEAMSYDESVGLGMIHSSASGRIRAQGAEDRSKSRMSKANKNRLAALKTASGAGGMSSVLRGGLVDGTASSLSFTPVQGIELVDPSRQSTAGRAQGVENAKWFKQGQFSLLRGAKANLPRTMGPPPPPFTGGS

SEQ ID NO: 4018 - protein, 489 aa, Vibrio sp. Ex25
MGKPTGFLEHGRELPQKIDPAERIKNNKEFVLNEEFGDKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKTIAIIGSGPAGLAAAEQLNSAGHTVTVFERDEKVGGLLRFGIPDFKLSMEVIDRKINLMAEAGVEFKVNQHVGVDVNAQQLRQEFDVVLLTGGSTVPRDLPVPGRELKGVHFAMEFLGQNNRRANNMDLKTEEIHAKGKHVVVIGGGDTGSDCVGTSNRHGAASVTQVEIMPIPPEKRPANMPWPQYPMILRTSTSHEEGVDRHWNILTKEFIGNDKGEVTGLRLADIVWQDAKPGERPSFKEVEGSERVIPCDMAFLAMGFLHPEPTGVLAQLDIALDDRGNVATQGFATNQEGVFAAGDMRTGQSLVVRCINEGRECARAIDDYLMDGTNLEAKADSLMLSA

SEQ ID NO: 4019 - protein, 161 aa, Triticum aestivum
MEPVEVESRRPKDTPFRQQRLKACQPILTPFVVIGVFLGVGILMFVLGFIMWHYNAQVVEATVRYDSVCTNPEVVPVSQSNPCTVTFIVDKNIPAPAFFYYRLTNFDQNHRRYVSSRSDTQFAGQSPQSASGLSDCTPIISVNNNATSSPGFYNPCGLIAN

SEQ ID NO: 4020 - protein, 429 aa, Glycine max
  misc_feature (150)..(150): Xaa can be any naturally occurring amino acid
  misc_feature (378)..(378): Xaa can be any naturally occurring amino acid
MMKLAGYSLAVSFAPISSNVVKSNKRFTVGISHRNRCSYRLFSTHAQKHQLHEKPGVVARYHLPPWFSVAPMMDWTDHHYRTLARLISKHAWLYTEMLAAETIVHQKDNLDRFLAYSPDQHPIVLQIGGSNIENLAKATELANAYCYDEXINLNCGCPSPKVAGRGCFGVRLMLDPKFVAEAISLIAANTNVPVTVKCRIGVDDHDSYNELCDFIYQVSSLSPTKHFIIHSRKALLKGLSPAENRSIPPLKYEYFYGLLRDFPDLSFTINGGIASIDEVNGALKAGAHGVMVGRAAYNNPWHILGHVDTAIYGASSSGLTRRQVLEKYQVYGDSVLQRYGLGPSLRDIVKPLLGFFHSEPGNGLWKRKADSAVQTCTXIKSFFEETLVAIPDSVLDSAVVKPQSGRGDIFANIYSSLPPPYRTREEDVI

SEQ ID NO: 4021 - protein, 470 aa, Vibrio sp. Ex25
MSQNVYQFIDVQRVDPAKKPIKVRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRVFTEMGVEFRMNVEVGKDVQMQDLIDEYDAIFLGVGTYKYMRAGLENEDAPGVYDALPFLISNTYKVMELENNQPFIDMAGKKVVVLGGGDTAMDCVRTSIRQGASNVICAYRRDEANMPGSRREVKNAKEEGVKFMFNLQPLGVEVDASGNVSGVKVVKTALGEPDDAGRRRPEPVEGSEHVLPADAVIMAFGFQPHKMDWLEPYGVDLDQWGRIKAPIEQAFMYQTSNAKIFAGGDAVRGSDLVVTAIDEGRKAAEGILDYLEV

SEQ ID NO: 4022 - protein, 334 aa, Acinetobacter sp. ADP1
MATVDLFAIGNALIDQEFKVTDQFLGEAGLQKGTMQLTDGETQAALYEKLQATQDYKGQASGGSAANTTVAFSSLGGSAFYGCRVGNDELGAIYLNGLNDADIVTSEKSLTTGTTGTCMVLISPDTERTMHTYLGITTELSEQQIDYTSLKTAQWLYIEGYLSTSPTARQAVKQARKIAREHGVKIALSLSDPAMVQYAREGLDEMIDDGVDVLFCNEQEALMYTETQTLDEAFSRLKQKNHTVVVTQSAKGASVSNPHTHFHLSGRRVTAIDANGAGDAFAGAFLFALNHGMSLEDATQLSILISSEVVSQYGPRLAVESYATLLRNFLTECA

SEQ ID NO: 4023 - protein, 460 aa, Ustilago maydis 521
MTGVITFCFSFCSALLKPTSLPPLSFAPLRFYHIMLFNALRTRASMARTMVRGGQAAAQKRYLSIHEHLSMDILNKYGIATPKYIAAKTPEEAYKAAQSFGGKEIVIKAQVLAGGRGKGHFDSGLKGGVHLIKTPEEARDLAAKMIGNHLITKQTGAGGRLCNAVMIAEARPPHHEYYVAVLNDRATQLPVLIASNQGGMSIEEVAAENPDAIITTPIDFEKGLSNQDALGIAKKLGFTGAKQEQQAAETFQKLYKLFDEKDATQVEINPLAESKDGEVLCMDAKLGFDENADFRQADIFELRDTTQEDPDEVDAAKYGLNFIKLDGNIGCLVNGAGLAMATMDVLKLNGGNPANFLDVGGTASAASVKKAFELLLNSKEVKGIFVNIFGGIVSCKKIAEGIIQATQELDMSIPLVVRLQGTHEKEAKELIKNSNLKIFAFDGLDEAAAKAVESAQKGTL

SEQ ID NO: 4024 - protein, 338 aa, Neorickettsia sennetsu str. Miyayama
MVEQMRIAINGFGRIGRAVLRILIGSPCDELEIVAVNTPSAVESCLHLLRYDSVHGKFECSMSLAEDNVAILNGVPVRFSSKTDISLLDWRAIGVDIVLECSGVFNSHTKASGHLKVGAKAVLVSAPVLDADSIIIYGVNQHALTPSDRIISVGSCTTNCLAPLIEVVHKNFGVEAAFMTTIHSYTNDQNVVDNSHRDLRRGRACGTSIIPTTTGVTKIVGKIFPELAGKIDGVAVRVPTPNVSMVDLTVTTSRSVTVDEVNSAFIKAESSYLGGVLSTCAEPLVSVDFNRDPHSAIVDLTGTYVVEGRLLRLGAWYDNEWGFSARMLDVARFISTKL

SEQ ID NO: 4025 - protein, 512 aa, Acinetobacter sp. ADP1
MLSRLVRQILQATVYDVAIETPLEAAPRISEKLNNNIRFKREDLQPVFSFKLRGAYNRISQLPKSQLERGVITASAGNHAQGVALSGQKLGIRAIIVMPKTTPDIKVQAVKRLGGEVVLHGDSFDVANKYAIQRAQDEGMTFIPPYDDELVMAGQGTIANEILRQWRDVEYVFVAVGGGGLIAGVAAYLGDVAPHVKIIPVEYDESACLKAAFEHNERVILPQVGLFADGTAVAQIGEKPFEVIQLQKSDNSGPIVERDVILVNTDEICAAIKDTFDECRSIVEPSGAMALAGIKKYIEQHQITDKNIVSIVCGANMNFDRLRYIAERTELGERKEAIFAVTIPEQKGAFLNFCRALHGRNITEFNYRASDSDDAQVFVGISLKSGEKERHDIHELLKSQYNVDDLSDDEVAKLHIRYLIGGHANIENERLFRVEFPERPGALLTFLERLGPSHNISLFHYRNHGAAEGRVLVGLQATDTQENPDVLIETLENITYPYEEITHNVGYKRFLQ

SEQ ID NO: 4026 - protein, 223 aa, Acinetobacter sp. ADP1
MSLYATQDEKKQAAAKAALKHLPKGGILGVGTGSTVNFLIELLPELQLEAAVASSEATAKRLKELGIEVVDMNHVGGLDAYVDGADEIDRHMHMIKGGGAALTREKIVASIAKKFVCIVDDSKWVEQLGRDFPLPVEVIPMARSAVARKLVSLGGDPVYREGVVTDNGNVILDVYNLNILNALELEKTINDIPGVVTNGIFALNAASIAIVATNNGIEERTAV

SEQ ID NO: 4027 - protein, 675 aa, Ustilago maydis 521
MSQNIASRRIPLRTRSTASASGAQAKENAGVTSVSSRGARYRHDGAAADAGPSKPASTATAATKASVASAASGVLGTRKRAALGDLTNANRTRSAMAGNDDKGKAALKDAIKPRATTSASTSSRSAVGTAASATTTGTGAARRVVRTRPTTASSTTASTTVTDAASDRPFRASRRVAGTTASTASGIPSATSRPTSTTTATSAVTAARKASMVRASSAGSQTDVRRDVSNTSAVTTNTTAPITAASRSSKVQLNEVHDTDDKMEAPQAKRLKTEQTNKPAKDEGWEDLDAEDADDPLMVAEYVNDIFEYMKELEIINMPNGDYMANQKEINWDVRAILIDWLVDVHAKFRLLPETLYLAVNIIDRFLSRRTISLSKLQLVGVTAMCIASKYEEVMCPSIQNFCHLADGGYTDVEILRAERYMLKVLDFSMSYANPMNFLRRISKADNYDIQTRTVAKYFMEISLLDYRLMEHPPSLIAAASVWLAREVLERGEWTPTLVHYSTYSEQELLGTAEIMLDYCLRPIAHQFFHKKYAHKKFMRASTYVIEWAHKAFPEGVVGVDEQQDLNVLRIDLYERNEIERPEMSPVSSSRATSPVSMHGQAHFEVEPSQNVDGDDTVSYAHDDDHEEEDDLVDDAQEIEGDVQLLDDVKAAAQRQDTRQVLRDVTNAYEATETF

SEQ ID NO: 4028 - protein, 511 aa, Glycine max
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 4029 - protein, 2152 aa, Saccharopolyspora spinosa
MTVTTSYEEVVEALRASLKENERLRRGRDRFSAEKDDPIAIVAMSCRYPGQVSSPEDLWQLAAGGVDAISEVPGDRGWDLDGVFVPDSDRPGTSYACAGGFLQGVSEFDAGFFGISPREALAMDPQQRLLLEVAWEVFERAGLEQRSTRGSRVGVFVGTNGQDYASWLRTPPPAVAGHVLTGGAAAVLSGRVAYSFGFEGPAVTVDTACSSSLVALHLAGQALRAGECDLALAGGVTVMSTPKVFLEFSRQRGLAPDGRCKSFAAGADGTGWGEGAGLLLLERLSDARRNGHEVLAVVRGSAVNQDGASNGLTAPNGSSQQRVITQALASAGLSVSDVDAVEAHGTGTRLGDPIEAQALIATYGRDRDPGRPLWLGSVKSNIGHTQAAAGVAGVIKMVMAMRHGQLPRTLHVESPSPEVDWSAGTVQLLTENTPWPRSGRVRRVGVSSFGISGTNAHVILEQPPGVPSQSAGPGSGSVVDVPVVPWMVSGKTPEALSAQATALMTYLDERPDVSSLDVGYSLALTRSALDERAVVLGSDRETLLCGVKALSAGHEASGLVTGSVGAGGRIGFVFSGQGGQWLGMGRGLYRAFPVFAAAFDEACAELDAHLGQEIGVREVVSGSDAQLLDRTLWAQSGLFALQVGLLKLLDSWGVRPSVVLGHSVGELAAAFAAGVVSLSGAARLVAGRARLMQALPSGGGMLAVPAGEELLWSLLADQGDRVGIAAVNAAGSVVLSGDRDVLDDLAGRLDGQGIRSRWLRVSHAFHSYRMDPMLAEFAELARTVDYRRCEVPIVSTLTGDLDDAGRMSGPDYWVRQVREPVRFADGVQALVEHDVATVVELGPDGALSALIQECVAASDHAGRLSAVPAMRRNQDEAQKVMTALAHVHVRGGAVDWRSFFAGTGAKQIELPTYAFQRQRYWLVPSDSGDVTGAGLAGAEHPLLGAVVPVAGGDEVLLTGRISVRTHPWLAEHRVLGEVIVAGTALLEIALHAGERLGCERVEELTLEAPLVLPERGAIQVQLRVGAPENSGRRPMALYSRPEGAAEHDWTRHATGRLAPGRGEAAGDLADWPAPGALPVDLDEFYRDLAELGLEYGPIFQGLKAAWRQGDEVYAEAALPGTEDSGFGVHPALLDAALHATAVRDMDDARLPFQWEGVSLHAKAAPALRVRVVPAGDDAKSLLVCDGTGRPVISVDRLVLRSAAARRTGARRQAHQARLYRLSWPTVQLPTSAQPPSCVLLGTSEVSADIQVYPDLRSLTAALDAGAEPPGVVIAPTPPGGGRTADVRETTRHALDLVQGWLSDQRLNESRLLLVTQGAVAVEPGEPVTDLAQAALWGLLRSTQTEHPDRFVLVDVPEPAQLLPALPGVLACGEPQLALRRGGAHAPRLAGLGSDDVLPVPDGTGWRLEATRPGSLDGLALVDEPTATAPLGDGEVRIAMRAAGVNFRDALIALGMYPGVASLGSEGAGVVVETGPGVTGLAPGDRVMGMIPKAFGPLAVADHRMVTRIPAGWSFARAASVPIVFLTAYYALVDLAGLRPGESLLVHSAAGGVGMAAIQLARHLGAEVYATASEDKWQAVELSREHLASSRTCDFEQQFLGATGGRGVDVVLNSLAGEFADASLRMLPRGGRFLELGKTDVRDPVEVADAHPGVSYQAFDTVEAGPQRIGEMLHELVELFEGRVLEPLPVTAWDVRQAPEALRHLSQARHVGKLVLTMPPVWDAAGTVLVTGGTGALGAEVARHLVIERGVRNLVLVSRRGPAASGAAELVAQLTAYGAEVSLQACDVADRETLAKVLASIPDEHPLTAVVHAAGVLDDGVSESLTVERLDQVLRPKVDGARNLLELIDPDVALVLFSSVSGVLGSGGQGNYAAANSFLDALAQQRQSRGLPTRSLAWGPWAEHGMASTLREAEQDRLARSGLLPISTEEGLSQFDAACGGAHTVVAPVRFSRLSDGNAIKFSVLQGLVGPHRVNKAATADDAESLRKRLGRLPDAEQHRILLDLVRMHVAAVLGFAGSQEITADGTFKVLGFDSLTVVELRNRINGATGLRLPATLVFNYPTPDALAAHLVTALSADRLAGTFEELDRWAANLPTLARDEATRAQITTRLQAILQSLADVSGGTGGGSVPDRLRSATDDELFQLLDNDLELP

SEQ ID NO: 4030 - protein, 845 aa, Yersinia pestis KIM
MRAFFFNQIFAKKVCDKKRESGRESEMRVLKFGGTSVANAERFMRVADIIESNARQGQVATVLSAPAKITNHLVAMIDKMVAGQDISPNISDAERIFAELLRGLADTQPGFDYDRLKALVGHEFAQLKHLLHGISLLGQCPDSINASIICRGEKLSIAIMEALFQAKGYHVTVINPVEKLLAQGHYLESTVDITESTRRIGASGIPSDHIILMAGFTAGNDKGELVVLGRNGSDYSAAVLAACLRADCCEIWTDVDGVYTCDPRTVPDARLLKSMSYQEAMELSYFGAKVLHPRTIAPIARFQIPCLIKNTSNPQAPGTLIGGESIDEDSPVKGITNLNNMAMINVSGPGMKGMVGMAARVFAVMSRSGISVVLITQSSSEYSISFCVPQGELLRARRALEDEFYLELKDGVLDPLDVMEHLAIISVVGDGMRTLRGISARFFSALARANINIIAIAQGSSERSISVVVNNDAVTTGVRVCHQMLFNTDQVIEVFVIGVGGVGGALIEQIYRQQPWLKQRHIDLRVCGIANSKAMLTNVHGIALDNWRQELAEVQEPFNLSRLIRLVKEYHLLNPVIVDCTSSQAVADQYADFLTDGFHVVTPNKKANTSSMNYYRQMRAAATKSCRKFLYDTNVGAGLPVIENLQNLLNAGDELMRFTGILSGSLSFIFGKLDEGMSLSEATRQAKALGYTEPDPRDDLSGMDVARKLLILAREAGYKLELADIEVESVLPASFDASGDVDTFLARLPSLDAEFTRLVANAAEQGKVLRYVGVIEDGRCKVRMEAVDGNDPLYKVKNGENALAFYTRYYQPIPLVLRGYGAGNDVTAAGVFADLLRTLSWKLGV

SEQ ID NO: 4031 - protein, 317 aa, Archaeoglobus fulgidus
MLKEEIAKRAEIINKAIEELLPEREPIGLYKAARHLIKAGGKRLRPVISLLAVEALGKDYRKIIPAAVSIETIHNFTLVHDDIMDRDEMRRGVPTVHRVYGEATAILAGDTLFAEAFKLLTKCDVESEGIRKATEMLSDVCIKICEGQYYDMSFEKKESVSEEEYLRMVELKTGVLIAASAALPAVLFGESEEIVKALWDYGVLSGIGFQIQDDLLDLTEETGKDWGSDLLKGKKTLIVIKAFEKGVKLKTFGKEKADVSEIRDDIEKLRECGAIDYAASMARKMAEEAKRKLEVLPESKAKETLLELTDFLVTRKK

SEQ ID NO: 4032 - protein, 275 aa, Solanum tuberosum
MADTSLPIQRLLGKVALVTGGATGIGESIVRLFHKHGAKVCIADIRDEVGQHVCETLGNDQNVCFIHCDVTVEADVSNAVDFTVQKFGTLDIMVNNAGLSGPPIRDIRDYELSVFENVLDVNLKGAFLGMKHAARIMIPLKKGAIVSLCSVASAIGGIGPHGYAASKYAVLGLTQNVAAEMGKHGVRVNCVSPYAVATGLALAHLPEDEKTDDAMEGFRDFVARNANLQGVELMANDVANAVLFLASDESRYISGHNLMVDGGFSCVNHSLRVFR

SEQ ID NO: 4033 - protein, 379 aa, Vibrio sp. Ex25
MGKLALLVLEDGTVFHGVSIGADGISVGEVVFNTSMTGYQEILTDPSYSQQIVTLTYPHIGNTGTTSEDEESSSIHAQGLVIRDLPLIASNFRNEQSLSDYLKSQNIVGIADIDTRKLTRILREKGAQNGCIFAGNNLDEALALAKAKEFPGLKGMDLAKEVTTKEAYQWKQGSWTLEGGLPEAKDDSELPYHVVAYDFGAKRNILRMLVDRGCRLTVVPAETSAEEVLAMNPDGVFLSNGPGDPEPCTYAIEATKVFLEKGLPIFGICLGHQILALASGAQTVKMKFGHHGANHPVKDLERNVVMITSQNHGFAADEATLPENLRATHVSLFDGSLQGIHRTDKPAFSFQGHPEASPGPHDAAPLFDHFIELIKKHSA

SEQ ID NO: 4034 - protein, 517 aa, Rhizobium leguminosarum bv. viciae 3841
MCDAKSTAGSEGELGRNIHDIFVIGGGINGCGIARDAVGRGYSVALAEMKDFASGTSSGATKLIHGGLRYLEHYEFRLVRESLMEREILWAMAPHIIWPLRFVLPYHKGGIRPAWLIRLGLFLYDHLGGRKLLPPTAVLDMRRDPAGKPLKALFSKAFEYSDGWVDDARMVVLNARDAADKGALIMPRTKVVSARRENGLWHIETTDTVTGRNDSHQARMLVNAAGPWVDHVIRSAFGQNEAHHVRLVQGSHIVVKKKFDDARAYFFQNPDNRIIFAIPYEGDFTLIGTTDRDYTADPRDVRISEEETVYLCNAASEYFKEPVRPEDIVWTYSAVRPLYDDGASKAQEATRDYVLKLEGEGDAAPLLNVFGGKLTTYRRLSEHALEKIGAAIGAKGAPWTAKSHLPGGDFPVRGYEAQVDKLRRRYSFLADPLARRLVRRYGTKAELLLGNASGIDDLGRLFGGDLYEAEVTYLVEHEWARHAEDVLWRRTKDGLRLSKEQAQSLEEYMAAMPAMAG

SEQ ID NO: 4035 - protein, 247 aa, Zea mays
  misc_feature (237)..(237): Xaa can be any naturally occurring amino acid
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASGIIGVDINPAKYEQAKXFGCTEFRYPR

SEQ ID NO: 4036 - protein, 510 aa, Gibberella zeae PH-1
MAHSPSSSSVEDAAENTADEEDSEDYCKGGYHPVQVGEKFKDGKYTVVRKLGWGHFSTVWLSRDNTNGKHVALKVVRSAAHYTETAIDEIKLLNKIVQAKPDHPGRKHVVSLLDSFEHKGPHGTHVCMVFEVLGENLLGLIKRWNHRGIPMPLVKQITKQVLLGLDYLHRECGIIHTDLKPENVLIEIGDVEQIVKRVVKPEAAEKENNRNGRRRRRTLITGSQPLPSPLNTSFNQSNLFPSPTPHSSLAGVLNDGKSSNEASPKPSDDAQKQREKSADLLSREVSGISLDKSNSPSTAAGDKRKAEDAHAFDVISVKIADLGNACWVNHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALTDVLREKYHFKEEEAKRIADFLTPMLELVPDKRANAGGMAGHNWLEDTPGMKGLKIEGLEVGGRGEGIDGWSTEVRKR

SEQ ID NO: 4037 - protein, 306 aa, Acinetobacter sp. ADP1
MALRHFLTLRDLSSLELNSILDRASELKRQQHANQVYQPFKGKVLGMIFEKSSTRTRISFEAGICQFGGSAIFLSPRDTQLGRGEPIEDSARVISSMLDIVMIRTFGHNIVERFASFSKVPVINGLTDDHHPCQLLADLQTYQEHRGSIKGKTVAWIGDGNNMCNSYMEAAHMMGFKLKVGSPKGYEPKPEFLAEFAHCVEVFNSAEDAAVNADLIVTDVWASMGQEEEQKLREKAFLTFQVNEALMALAHPECLFMHCLPAHRGEEISENMLDHKNSVVWDEAENRLHAQKALMEFLLNENAKRA

SEQ ID NO: 4038 - protein, 139 aa, Picea sitchensis
MGRLGTMLLLVVSLFLMAESLHTALNSQEVTATSNWLGSVASYEQRGFESSAGQICDGALGECNDETEEEFMMDSEAHGRLLRRVRYYISYGALAANRVPCRPRSGRSYYTRNCYAATGPVRPYHRSCTAITRCKRYTS

SEQ ID NO: 4039 - protein, 391 aa, Photobacterium sp. SKA34
MTDTRYSLDDIRQNVSRIDNALLELLAERRALSLEVAKSKISTAKPVRDQTREHELLLKLIESGKLHQLDAQYVTQIFHTIIEDSVLFQQAYLQKLANPDSANPTARVAFLGAKGSYSYLASRNYFSRKQTNLVELSCSTFRDIFNTVETGNADYGVLPIENTSSGSINEVYDLLQHTSLSIVGEITQPIEHCLLTAVDTKLEHIDTLYSHPQPHQQCSEFLHSMGSIKQEYCSSTAEAMEQVAELKQPNVAAIGNASSGELYGLTSIKSDIANQQENFTRFIIVARKPVDVTSLIPAKTTLIMSTAQKAGSLVECLLVLKNLNINMSKLESRPVIGNPWEEMFYVDVEVNLKSDVMQQALEELTRLTRFIKVLGCYPSENVAPTEVELLD

SEQ ID NO: 4040 - protein, 643 aa, Ustilago maydis 521
MASLRPDISHWFEQAQLQLQLFVLQTDLFLFQLLPPLRSSAVRSPTSLIFTGLVVLIIQRFGSALSAYVAEQGVSISIDAPPQARAGWSGKVLETPSIRDASNPEKIVCYDPATAYLIGEVDADTPLSIARKIEAAKKAQAKWSNSSFALRRKVLRTMKNWVVNDSETIVRVAARDTGKTAIDATFGEILTTLSKLNWTIKNGEKVLSTESRSTNLLLMHKICQVRHEPMGVVVACVSWNYSAHNVLGPIISSVFAGNAIIVKASELVCWSAHYFINCVRECLRVSGADPDLVQVVTCWPEAVESLTGSAEVSHITFIGSEEVGRKVAQVATKELTPVTLELGGKDPAVLLKDADLNFFGSTFMRSCFQGSGQNCIGIERFIVDQAIADKLAKIVEPRIRALKLGSFMDDVSFGSSSSCQQLAHVDMGAMITDARFDRIEQLISDAVSQGATLLVGGKRFIHPRWKHGHYFTPTLLTNVRPTMAIANEELFAPIFLILPFPSTQLDSAIQIANSTRYGLGSSVFGSDLTQCTYVAEKLQAGMVNINDFGVSYLNQDLPFGGVKKSGYGRFAGPEGLLSLTHAKAVTRDRVFGWVRTKIPARMDYPMENPRKSWAFANGLVRFAYGGGVVARVRGVLNLITNRA

SEQ ID NO: 4041 - protein, 292 aa, Magnaporthe grisea 70-15
MAPSLDPAILKALGLDAETTNMSTHGGSGFASTFKLCGTVNGREKTFFVKTGSGKDAETMFRGEHASLNAIHSAVPNFCPASHAYGAMSSEGRFFMATDFLDLGGRGASGTGKSLAAKLAQLHTTPAPVPDGFDKPMFGFPVPTCCGSTVQDNSWKESWAEFYADNRLRHILAAGIKSNGKDAELERTVETVASRVVPRLLGDGHLKGVKPVVIHGDLWSGNHGAGRFAGSDGGVEEVVYDPSCVYGHSEYELGIMNMFGGFGSRFWEEYGKLVPKSEPVEEFEDRVALYEL

SEQ ID NO: 4042 - protein, 395 aa, Ustilago maydis 521
MAFFSSASTPSTFGARPAATPGQINTSAATKTSGDQDQEVAPGATDTVSCLAFSPTADFLAVGSWDNNVRIYQINKTSPTPVQPWQQYSHEAPVLDLCWSTDGAKVFSVGADKVCRMFDMNTNQPTVVAQHADTIRSVCWLNVAGGVLLTAGWDKQLKIWKIDNPASPQAVHSLTLPEKCYVMDNVQNVVVVAMAERMVLGFRLEETGSITPLTEQQSPLKYQTRSMAVLPDGDGYALGGVEGRVGVQYFHDPPDKDNKVKKFAFKCHRRANADHPEVPRNESHLFPVNCIAFNVHGTFATGGADGSINFWCKQSRTRLKTMETKGPANAPKELLKTNPAKQPITAIGFNRDATILAYAVGYDWHKGYAGAGAVEPKVYIQPVNYEDVKKRPPKA

SEQ ID NO: 4043 - protein, 538 aa, Oryza sativa Japonica Group
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAEW

SEQ ID NO: 4044 - protein, 507 aa, Brucella melitensis 16M
MSTTAYPDTILIIDFGSQVTQLIARRVREANVYCEIVPFQSADEAFKRLQPKGVILSGSPHSTTDIGSPRAPQAIFDAGIPVLGICYGEQTMCAQLGGNVESGHDREFGRAFLDVQEDSPLFAGIWAKGTRHQVWMSHGDRVTSLPDGFTIIGTSPNAPYAVIADEKRKYYGVQFHPEVVHTPDGAKLLQNFVHRIVGVKPGWTMGAYREQAVEAIRKQVGSGKVICALSGGVDSSVAALLAHEAVGDQLTCILVDHGLMRKDEVQQVVEMFREHYNLPLILVDASDRFIGALEGESDPEKKRKTIGRLFIEVFEEEARKLGGADFLVQGTLYPDVIESVSFTGGPSVTIKSHHNVGGLPERMKMQLVEPLRELFKDEVRLLGKELGLPDSFIGRHPFPGPGLAIRCPGGVTREKLEILREADAIYLDEIRKAGLYDAIWQAFAVLLPVQDRGRDGGWPHLRIRLRLARGDFGGRHDGGFLPLRHEFPRQCGHPHHQRSPRHQPRCL

SEQ ID NO: 4045 - protein, 366 aa, Eucalyptus gunnii
MGSTGSETQMTPTQVSDEEANLFAMQLASASVLPMVLKAAIELDLLEIMAKAGPGAFLSPGEVAAQLPTQNPEAPVMLDRIFRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNIGKVIVAECVLPVYPDTSLATKNVIHIDCIMLAHNPGGKERTQKEFETLAKGAGFQGFQVMCCAFGTHVMEFLKTA

SEQ ID NO: 4046 - protein, 317 aa, Mycoplasma hyopneumoniae 232
MTYQEYLQARLEQQNETKSLRSVLIIDGADPRAIAAAKLLKEKNLVKPVLLVDEEIPNLDVDQHIVNFQEKMEFIKEFLKFRKGKETPESAEIQFQSNAFYGTMLLRKKKVDAVVGGLNYPTAEILRAAFKIIGPKPNIKTISSVMIMHKDQEKYLFSDISVNIAPNENQLVDIAKNALDFAIQLGFDPKPAFLSFSTKGSAKSPQSELVAKATQMFNATSPIEAYGEIQLDAALDIEVRRQKYEVNVGKNANILIFPNLDAGNIGYKIAQRLGNFGAIGPIITGINAPINDLSRGSTTQDVFNTVLISALQVEEGK

SEQ ID NO: 4047 - protein, 337 aa, Mycobacterium sp. MCS
MAFTRKPPIDPVRWQPPPVDGLPPLPSPSVTVVPVPGHAPEDVVVDAAGRLYTGVDDGRILRLTPDGGEPAVIANTGGRPLGLAVARDGRLLICDSPRGLLALDPETGRFDPLVETVGGRHLQFCSNVTETADGTIYFTESTSAFTYAYFKGAALEARGRGGLFRRDPDGTVTTLADGLYFTNGVTVTADGSALVFAETLGRRLSKFWLTGPQAGTITPLVGHLPGYPDNLSTGADGRIWVAMVSAPNAAAEGLAPRTPVLRKLLWLLPDRFAPQLKPEVWAVAFDPDSGAVVGGLRTTHPDFGMVTGLVEAGGRLWMGCIGASALAHVALDDVALP

SEQ ID NO: 4048 - protein, 461 aa, Mycobacterium sp. MCS
MTQSYITEPVTSELGAKANRHLWGHFARHGEGITPPIITRGEGVRIWDDKGRSYIDGLSGLFVVQVGHGRKELAEAAAKQAETLSFFPLWSYATPPAIELAERIANYAPGDLNRVFFTTGGGEAVESAWKLAKQYFKLTGKPGKHKVVSRAIAYHGTPQGALAITGIPAFKAPFEPLTPGGFRAPNTNFYRAPEPYAHDVKAFGQYCADRIAEAIEFEGPDTVAAVFLEPVQNAGGCFPPPPGYFERVREICDEYDVLLVSDEVICAYGRIGSMFACDDFGYVPDIITSAKGLTSGYSPLGAMIASDRLFEPFNDGKTTFGHGYTFGGHPVSAAVALANLDIFEREGLNDHVKENAPAFRATLEKLYDLPIVGDVRGEGFFYGIELVKDKATKETFDDDESERLLRGFLTPALWEAGLYCRADDRGDPVVQLAPPLISGQAEFDAIYEILHGVLSEAARRL

SEQ ID NO: 4049 - protein, 110 aa, Glycine max
LGLDILPSFVNSSSQPLDFTQPFVWIGPMGLFDLPNFLLGTEVFAKRLAALTVKGVPPFIGGGDYVAVVEKVGLVSVMSPIFMGVGAGWEFLEVKDLQGFLPLDEAVPFA

SEQ ID NO: 4050 - protein, 567 aa, Legionella pneumophila str. Lens
MNTITESYRAGLFQKKYWLQNIISGLIVGVVALPLAMAFAIASGAKPEQGLYTAIVAGLIVSIMGGSRVQIAGPTGAFIVVLSGITTQYGISGLQIATLMAGFILVLFGFARLGSIIKFIPSPVIIGFTSGIAVVIWVGQWQYFFGLPAAGSGHFHEKFWHLLLSFPHLNIATTFLGICALFIVLYSSKLPGLKRIPGPLIALVLVTIIQSVWHFEGVATIGSLFGGIPQGLPTFTWPEITMGRLIELTGPAFAIAMLGAIESLLSAVVADGMSGTRHNSNRELVGQGIANIVAPLFGGFAATGAIARTATNIRNGGNSPLSGIIHSITLILVLLFLAPLAVDVPLAALAAILFVVSWNMSEARHFIKLIRVAPRADVVILLVTFCLTVFVDLVVAVNVGVIIAVLHFLRRMVNSIQIQRMSERQLSQELAQEKNYDLPEGVMVYVIEGPFFFGAVETFQSALANTHTDPKVLIIRMRWVPFIDITGLQAMEEIILNLQKRGVRVLLSEANPLVDAKLRKMGIVRLIGEQNYYKEFSQALDVCRINDSDRKSQPPYEAAKPLASVTQ

SEQ ID NO: 4051 - protein, 163 aa, Arabidopsis thaliana
MMMLRQTSRKAYLGLQASPLGLGRRLYHENVIDHFENPRNVGSFNRNDPNVGTGLVGAPACGDLMSLQIKVDDSGQIIDTRFKTFGCGSAIASSSVASEWIKGKTLDEVMTIKNAEIAKHLRLPPVKLHCSMLAEDAIKSAVRDYKEKQAKTNAAAAEETVKA

SEQ ID NO: 4052 - protein, 292 aa, Saccharomyces cerevisiae YJM789
MVLTRQVLEEVENTFIELLRSKIGSLVKSHAGTNFCSYDDKANGVDLVTALDKQIESIIKETLTAKYPSFKFIGEETYVKGVTKITNGPTFIVDPIDGTTNFIHGYPYSCTSLGLAEMGKPVVGVVFNPHLNQLFHASKGNGAFLNDQEIKVSKRPLILQKSLIALEGGSERTEGSQGNFDKKMNTYKNLLSESGAFVHGFRSAGSAAMNICYVASGMLDAYWEGGCWAWDVCAGWCILEEAGGIMVGGNCGEWNIPLDRRCYLAIRGGCESMEQKRFAESFWPHVAAELEY

SEQ ID NO: 4053 - protein, 284 aa, Candida albicans SC5314
MCCQIATLLDLDVVYVKPYEGLYCFQELADLDLARVLYSNVQFSEFHIQSFMYQILCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLEVEQILEQEFFKNLRNVHEEPSSKAIFDFSFEEKGKSIPQLKEILETEVRVFKEISKTGIE

SEQ ID NO: 4054 - protein, 556 aa, Bacillus clausii KSM-K16
MKQALSITWDRLWQQHTRTKSALNVFSYAQKGTSALKREAAEHEQAKQNSGGQPEPKEKKPYSRAQLVGLLLGPLLFFLTLMFFHPEGLPTEGRHVLAVTLWIATWWMTEAIPIPATSLLPLILLPITGAMEGSAVASSYGNDIIFLFLGGFFIATAMEKWNLHKRIALFIIAVIGTSTQRILLGFMAATAFLSMWVSNTAAVMMMVPMALAITAQVAETLKGQKEGRELPKFEKAMLFGVGYAGTIGGFATLIGTPPTIIFAGQVRELFGIEVSFASWMLFATPLMLVVLLFTWFYLGRIAFKTKIKELPGGKEVIQSERSKLGRISYEEGIVAGVFAFAAFMWITKDFFWSGDNAMIFQLPGISDGMVAIMATMFLFLIPGKASARILDWADSRDIPWGVLLLFGGGLAIAAGFQSSGLSVWLGEQLTVLDGLHMLLIIGGATLLIMMLTEITSNTATATMIMPIVASLAVAINVHPFALMAPCAIAANCAFMLPVGTPPNAIIFGTGKVKIIEMVRAGFWLNVFSTILIVLAVYAFLPIVFDIDLSVFPDSLK

SEQ ID NO: 4055 - protein, 867 aa, Neorickettsia sennetsu str. Miyayama
MSEKLVYHFSPSNADGDALMLDVLGGKGANLAQMCNMGLPVPPGFTISSSACELYHRDKDLFRKILEKEIQKSLQVLEAVTGKVFGSKVRPLLVSVRSGSKFSMPGMLDTILNVGLNDEIIASCSSRFILDSYRRLIQMYGDVVLKVESYHFEEVLYNYKNSKGILRDHDLSISDLHELIEAFREVVKRNSHASLPEDVYVQVMACIEAVFQSWGNERAKTYRKIHDIPESVGTAVNIQSMVFGNFNERSGSGVLFTRNPSNGHKTMFGEYMKCVQGEDIVSGVRTPQPIGELKSENPRLYEQIESVCQSLEKHYRDVQDIEFTIEDDALYILQTRSAKRSVEAAIRVAVDMVKEGLITKEEAVLRIRPKSLESLLHPRIDDEANHQIIGSGLPASPGAASGKIIFSTEEAVKRAQGGEKVILVKSETSPEDIAGMHAAVAILTTRGGMTSHAAVVARGMGKPCVCALSGGSIDQYSQVLRITPDVTLNKGDEITIDGTSGNVILGNASTSEFSFSDEFSTFMTWVDEFRQISVRANAETKEDVEVALRFGADGIGLCRTEHMFFSEDRIHIVRDMIVAEDLRQRSIALKKLLPIQQGCFAAIFREMQGRCVTVRLLDPPLHEFLPADEASLESFRKHSALEDSFIQRRIKVLKEENPMLGHRGCRIAISHPEIYEMQLHAIFGAAQEVGDVKLEVMIPFIMNADELCAIKQLVTSVAQGYSVDYLLGNMIELPSAAILADRIAESSDFFSFGTNDLTQTTLGISRDDCGMFMNIYKEKGLFREDPFISIQVESVGFLIKEAIKKGRSANKALKIGICGEHGGDPYSVEFFASSGVDYVSCSPYRVPIAKVAAAQHSIKMKQNNETL

SEQ ID NO: 4056 - protein, 364 aa, Escherichia coli CFT073
MKINRIVNEGFMKTMLAAYLPGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVVVVGLGPVGMMAMMLAKGRGAKRIIGVDMLPERLAMAKQLGVMDHGYLATTEGMPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 4057 - protein, 361 aa, Emericella nidulans
MGCMSSKQLEAGDDKEAIQRNARIEKSLKNDKKVMDRTIKILLLGAGESGKSTIIKQMRIIHSGGFPEDERRQTRAVIYSNIVVAFKVLLDIMRTENIDFEQEGTRVSDTEFVDNLEPDVGVEEAFSDLRVRDAMNEMWKDGGVQKAVSKGHEFALHDNLNYFFHSLDRLFESGWLPDNQDMLQARLRTTGITETLFELGQMNFRMMDVGGQRSERKKWIHCFEGVQCLLFMVALSGYDLCLVEDQNANQMHEAMMLFESLVNGEWFKRKPIILFLNKIDLFKDKLAISPISKHFPDYSDSNTDFDAAAKYFADRFRGINRIPEREIYIHYTNATDTTLLKATMDSVQDMIIQKNLHTLIL

SEQ ID NO: 4058 - protein, 310 aa, Bacillus clausii KSM-K16
MTKKVLMFCDPGIDDSLAIMYALSAPFIELIGLVVSYGNVSKKQAVTNAAYLLHLAGRTDIPLISGASMPIVEENLVYYPNIHGESGMGPIQLPAHDEIPVRPFATVPEIIARFQGEVIIVDTGRMTALAAAFVGFEKEMKDVHSFYVMGGAFFIPGNATPLAEANVYGDPHAAQLVISRATPLTLAPLNVTNQAVLPAIVVDKWAEQAKNPFSHVIRAICSHYIEAHQQMMPGSLGAPIHDLVPLMLIRTPEMAGYIERPIEIITYGKEQGLTYVDFRPGMRNEGPRIAVTLDYPLFLRTFKEGVGLSS

SEQ ID NO: 4059 - protein, 1173 aa, Oryza sativa Japonica Group
MDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 4060 - protein, 589 aa, Saccharomyces cerevisiae YJM789
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLRKVKKFINKNTVLLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 4061 - protein, 403 aa, Ralstonia metallidurans CH34
MNIHEYQAKELLRRYDVAVPNGCVAFTPEEAAQAARKLGGPIWVVKSQIHAGGRGAGRFAGDPSGKGGVRVVKSIDEVQANASQMLGATLVTKQTGPAGREVRRLYIEEGCDIARELYLGMLIDRATSRITVMASTEGGMEIEEVAAHTPEKILKVAIDPASGIQPFHARRLAFGLGLSGKQVAAATRFILSAYRAFTELDASIVEINPLVVTGSGDVIALDAKFNFDDNALFRHPDIEAMRDESEEDPAETEAARHALNYVRLDGNIGCMVNGAGLAMATMDIIKLYGGEPANFLDVGGGATKERVTAAFRLILADPKVEGILVNIFGGIMRCDVIAEGVIAAARDVDLTVPLVVRLEGTNVELGKTILRDSGLPILSANHLADAAEKVVAAVRAHQKKGGK

SEQ ID NO: 4062 - protein, 332 aa, Chlorobium tepidum TLS
MSSPITQAQVESKYRQYHAKINEALAACFPKEKPATLYDPARYILEGKGKRIRPFLTLLAAEAVSGKSDNALGVALGIEVLHNFTLMHDDIMDQADLRHGRPTVHKQWNVNAAILSGDMMIAYAYELALKAISSRHAEIIHIFNDANITICEGQALDMELEQRKDVTIADYLDMISKKTGRLISAALEAGGVAGDGTPEQIAALVTFGEKIGRAFQIQDDYLDIMAGDGKSGKVPGGDVINGKKTWLLLRSLELAEGADRELLQSIFDNNGTSPDNVPAVKAIFEKCGVLNETRAKINEDTEAALAALDALPFEEGRGYLRGFANILMKRDF

SEQ ID NO: 4063 - protein, 495 aa, Neurospora crassa
MLTPTTLLLLSPLLYLLTLLFRTALYRLRARSLGCSPVAVYPHKDPILGLDLFRESLRAMNTHALLPLWDARFKRYGNTHYTLTLGKWVLMTNEPENVKVILGTKMAEWPIDGPRLHASVAVLGKKSIFTTNGAQWREARGMIRPSFVRDQVADLHCFAKHVGNFLNAIPKDGSTFDMQELLLSMTMDSSTDFLLGCSTNSLLQPSPEAKQFLEDFEYTSREAAKKSRLGTLLNWLPNGEFQATVTRVREYVRAYIRKSQAEKTDKKERDYVFLHEILKSGADEEHAIDQVLSVIIAGRDTTAAAMTACFYYLARNPEAVKKLRKEIFDMEDEMPTWEQLKNMKYLNMIIKEGLRLFPPASTNSRAPIKDTVLPRGGGPDGKQPILVPKGQVVRWSLYSLHRRKDIWGEDAHEFRPERWDENLRVGWEYIPFSGGPRICLGQQFALTQIEYALFKFFRAFKSIEPRDDNGPLLLRTNLTVTFAKGCLVSATPDSN

SEQ ID NO: 4064 - protein, 507 aa, Triticum aestivum
  misc_feature (235)..(235): Xaa can be any naturally occurring amino acid
  misc_feature (252)..(252): Xaa can be any naturally occurring amino acid
  misc_feature (270)..(270): Xaa can be any naturally occurring amino acid
  misc_feature (275)..(275): Xaa can be any naturally occurring amino acid
  misc_feature (293)..(294): Xaa can be any naturally occurring amino acid
  misc_feature (298)..(298): Xaa can be any naturally occurring amino acid
  misc_feature (300)..(301): Xaa can be any naturally occurring amino acid
  misc_feature (306)..(306): Xaa can be any naturally occurring amino acid
  misc_feature (312)..(312): Xaa can be any naturally occurring amino acid
  misc_feature (316)..(316): Xaa can be any naturally occurring amino acid
  misc_feature (335)..(335): Xaa can be any naturally occurring amino acid
  misc_feature (337)..(337): Xaa can be any naturally occurring amino acid
  misc_feature (389)..(389): Xaa can be any naturally occurring amino acid
  misc_feature (400)..(400): Xaa can be any naturally occurring amino acid
  misc_feature (415)..(415): Xaa can be any naturally occurring amino acid
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLXKKGDMAKDKFSKVLWGXVTNYRTWIFVLLYGYCMXVELTXDNVIAEYYYDHFHLDLRXXGTIXAXXGMANXVARPMXGYLXDLGARYFGMRARLWNIWIXQXAGGAFCIWLGRASALPASVTAMVLFSICAQAACGAVFGVAPFVSRRSLGIIXGLTGAGGNVGXGLTQLLFFTSSQYSXGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 4065 - protein, 193 aa, Primula vulgaris
RSKYWANGAWRLSPVYKWEVKTGILGPIRIWKGAINGGRGVLFRVLPIGTCGKMEGQIIPQSLQNSNNFVGSSFGNIGTNWDGPSNPLGQGGVFDSTSNGGNINYRRNIVNNVSATSSFDVLSDGLGGHFGNFNGGGSFYRDPTWRSASPELEGPDAFGFGDGKMDPDVLATNSPAYVDAYNITNRANRGIAT

SEQ ID NO: 4066 - protein, 252 aa, Neisseria gonorrhoeae FA 1090
MPRFPRTLPRLTAVLLLACTAFSAAAHGNHTHWGYTGHDSPESWGNLSEEFRLCSTGKNQSPVNITETVSGKLPAIKVNYKPSMVDVENNGHTIQVNYPEGGNTLTVNGRTYTLKQFHFHVPSENQIKGRTFPMEAHFVHLDENKQPLVLAVLYEAGKTNGRLSSIWNVMPMTAGKVKLNQPFDASTLLPKRLKYYRFAGSLTTPPCTEGVSWLVLKTYDHIDQAQAEKFTRAVGSENNRPVQPLNARVVIE

SEQ ID NO: 4067 - protein, 349 aa, Saccharomyces cerevisiae YJM789
MNVTSNATAAGSFPLAFGLKTSFGFMHYAKAPAINLRPKESLLPEMSDGVLALVAPVVAYWALSGIFHVIDTFHLAEKYRIHPSEEVAKRNKASRMHVFLEVILQHIIQTIVGLIFMHFEPIYMTGFEENAMWKLRAGLPRIIPDAAIYYGYMYGMSALKIFAGFLFVDTWQYFLHRLMHMNKTLYKWFHSVHHELYVPYAYGALFNNPVEGFLLDTLGTGIAMTLTHLTHREQIILFTFATMKTVDDHCGYALPLDPFQWLFPNNAVYHDIHHQQFGIKTNFAQPFFTFWDNLFQTNFKGFEEYQKKQRRVTIDKYKEFLQKRELEKKEKLKNFKAMNAAENEVKKEK

SEQ ID NO: 4068 - protein, 323 aa, Mycobacterium smegmatis str. MC2 155
MTRYDSLLQALGNTPLVGLQNLSPRWDDEDGKPHVRLWAKLEDRNPTGSIKDRPALRMIEQAERDGLLQPGATILEPTSGNTGISLAMAALLKGYNMICVMPENTSIERRQILELYGARIIFSPAEGGSNTAVATAKELAAQNPSWVMLYQYGNPANSDAHYFGTGPELLADLPEITHFVAGLGTTGTLMGTGRFLREHVPGVQIVAAEPRYGEGVYALRNIDEGFIPELYDADVLTTRFSVGSFDAVRRTRELVTREGIFAGISTGAVLHAALGMAAKAVKAGERADIAFVVADAGWKYLSTGAYAGSLDDAEDALEGQLWA

SEQ ID NO: 4069 - protein, 348 aa, Mycobacterium smegmatis str. MC2 155
MADSHKINFDPVDIEMEVREDENILDAAFRQGIHLMHGCREGRCSACKSYVLDGEIQMESYSTFACNDAEVDEGYVLLCRSHAFSDCTIELLNFDEDELLGGIPIQDVRTQVQAVEPKTRDIVSLRLKPIEPGKFDFKPGQYADLHIPGTDEHRSFSMATTQSRSDEVEFLIKKYPGGKFSALLDGHIQVGDEIALTGPYGSFTLKDGHVLPVVCIGGGAGMAPILSLLRHMNETENSRPARFYYGARTPADLFYLDEILELGKGIKDFRFIACLSESADGEVPGRVTVEEGMVTDVVARHETAIAKTEVYLCGPPPMVDAALMFLDANCVPKDQVFYDSFTSPIFDQ

SEQ ID NO: 4070 - protein, 711 aa, Escherichia coli O157:H7 EDL933
  misc_feature (642)..(642): Xaa can be any naturally occurring amino acid
MCSGSAGGILTPISSLDLNALGNLPAAKDVDAEQSALENGLTLVLKNIEFRLLDSDGATSAILEAHRSLAGDTSLHEHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQHQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVXRLQAPVRWGDDEAQFIIMLTLNKHAAGDQHMRIFSRLARRIMHEEFRNALVNAASADAIASLLQHELEL

SEQ ID NO: 4071 - protein, 442 aa, Salmonella enterica subsp. arizonae serovar 62:z4,z23:--
MMSLGGTIGTGLFIGIAEPLSSVGPARALLAYLFAGAIMLATMMCLGELSCAFPHSGSFQHYALMFMPSPVWSYTIGWLYWFSWGFSLAADLTAAGFIAHQFFPAVPVYIFCLAILLILTVINFTSAKSFGECEYWLSAIKVFAIVLFICAGGVMIYSLMGHSDWHPTLKTNGMWFPHGWEQIVVCMTIVIYSFQGGELVGNAAGETESPHAILPKVILGIGLRIILFYGLAIAVLALVYPHKLAPNGQSPFVWVFSHAGIPGADTLMTLVIFSAAVSAANSAIYASSRMLWSMAGDRFAPACFGKTNGGGVPVYAILITVLLALVSLLTRYIPAQQFYLYLIASTGQVGCLAWITIGWCQYRFRQSVCNGTYASDLLRYRSPLFPWTARFVIITNFAIMVGTWFSEQGGVIMLVELAFMTGILLSWYLFRPTLSRLRNTVG

SEQ ID NO: 4072 - protein, 320 aa, Oryza sativa
  misc_feature (209)..(209): Xaa can be any naturally occurring amino acid
  misc_feature (219)..(219): Xaa can be any naturally occurring amino acid
  misc_feature (232)..(232): Xaa can be any naturally occurring amino acid
  misc_feature (271)..(271): Xaa can be any naturally occurring amino acid
MPYLTAEQKQELARIANAIVANGKGILAADESTGSMTKKLGPLGLENTEENRRLYRQVLFTADASLAESISGVILFDETFYQKTDDGTPFPQLLKSRGIIPGIKVDRGLVKLSGTDDETTTQGLDDLDARCAKYKREGADFAKWRCALKIGKGLPSQLAILENANVLARYASVCQANGIVPIVEPEILPDGDHDLATCQSVTEKVLAAXQALSDHHIYXEGTLLKPNMVTAXSFPTRATPEQVALATVTRVSAGVPAAVPGVTFLSGGQSXEEEATLNSDALNNVTSGEETVGMDFSFGRALEPMVWAVWQEKKENWPAR

SEQ ID NO: 4073 - protein, 523 aa, Mycobacterium sp. MCS
MRYAQQGGCGSDSVGPMTALASNASASNSVASSWIDGAPVQTGGGSFQIVNPATGAVVTEYARAANVDVDVAVAAARAALPGWATATPAERSAVLAKLAKLADEHTDVLVAEEVSQTGKPVRLAREFDVPGSVDNIDFFAGAARHLEGKATAEYSGDHTSSIRREAIGVVATITPWNYPLQMAVWKVLPALAAGCTVVIKPCELTPLTTLTLARLAGEAGLPPGVLNVVTGFGADVGTALAGHPGVDLVTFTGSTVVGRKVMSAAAVHGHRTQLELGGKAPFVVFDDADLDAAIQGAVAGSLINSGQDCTAATRAIVARDLYDDFVAGVAEVMGKIVVGDPEDPDTDLGPLISTAHRDKVAGMVSRAPAEGGRVVTGGTIPDLPGSFYRPTLIADVGEQSEVYREEIFGPVLTVRSFTDDDDALRQANDTDYGLAASAWTRDVYRAQRASREINAGCVWINDHIPIISEMPHGGVGASGFGKDMSDYSFEEYLTIKHVMSDITGVADKEWHRTVFKKRSGLNH

SEQ ID NO: 4074 - protein, 471 aa, Brucella melitensis 16M
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETVLEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 4075 - protein, 451 aa, Moritella sp. PE36
MSQHFDYIAIGGGSGGIASANRAAMHGKKVAIIEAKALGGTCVNVGCVPKKVMWHGAQIAEAMHLYAKDYGFDVENKGLDWGKLVAAREAYIGRIHTSYDNVLGNNKVTVIKGFATFVNKNTVSVNGETYTADHILIATGGAPTIPNVPGAEHGIDSNGFFELTEQPKRVAVIGAGYIAVELAGVLHGLGSKTHLFVRKESPLRSFDPILIDTLVDVMNTSGPKLHTNSVPKEVVKEADGSITLHLENGESQNVDTLIWAIGRHPSTDKINLAATGVETNDRGYIKVDEYQNTNIDGIYCVGDIMAGGVELTPVAVKAGRQLSERLFNGKTTAKMDYNLIPTVVFSHPPIGTIGLTEAEAIAQYGEENVKVYQSGFTAMYTAITSNRQPCKMKLVCAGEEETVVGLHGIGFAADEMIQGFGVAMKMGATKADFDSVVAIHPTGSEEFVTMR

SEQ ID NO: 4076 - protein, 570 aa, Zea mays
MEGGGVGDAYGEDRATEEQLITPWAFSVASGYTLLRDPRHNKGLAFSEAERDAHYLRGLLPPALASQELQEKKLMHNLRQYERPLHRYIAMMDLQERNERLFYKLLIDNVEELLPVVYTPTVGEACQKYGSIYRRPQGLYISLKDKGKILEVLKNWPERSIQVIVVTDGERILGLGDLGCQGMGIPVGKLSLYTALGGVRPSACLPITIDVGTNNEALLNDDFYIGLRQRRATGEEYHELVEEFMAAVKQNYGEKVLTQFEDFANHNAFDLLEKYRESHLVFNDDIQGTASVVLAGLLAALKVVGGTLADHTYLFLGAGEAGTGIAELIALEMSKHTGSPIEECRPKIWLMDSRGLIVASRKESLQAFKKPWAHEHGAVETLLEAVRSLKPTVLIGTSGKGGTFTKDVVEAMASQNERPVVFALSNPTSHSECTAEQAYTWTEGRAVFASGSPFPAVELDGRALVPGQSNNAYIFPGFGLGVVISGAIRVRDDMLLAASEALAEQVTEAHYAKGLIFPPFTNIRAISARIAAKVAAKAYELGLASRLPRPDDLVKYAESCMYTPTYRSYR

SEQ ID NO: 4077 - protein, 795 aa, Legionella pneumophila str. Lens
MTVKRHTIDLAHLGMRDLDQVGGKNSSLGEMISHLSSAGVSVPGGFATTADSFREFLSQNGLDKKIYDKLTALDTDDVRQLTVVGKQIREMIIDTPFTPDFEQSVRSSYQKLAQTIGHDNFSVAVRSSATAEDLPDASFAGQQETFLNVKGEEAVLAAIKQVFASLFNDRAIAYRVHHNFAHNEVALSAGIQQMIRSDLAVSGVMFTMDTESGFDQVVFITSSYGLGEMVVQGAVNPDEFYVHKPCLEAGKPAIIRRNLGSKALKMIYCDDPTLERRVKTVDVDPAERLLFSLSKEEVEQLANQALIIEKHYGRPMDIEWAKDGVNGKLYILQARPETVKSRDNKQVLERYTMQKRGDILAEGRSIGQRIGQGKAKVIKDINEMHRVQPGDVLISDMTDPDWEPVMKRASAIVTNRGGRTCHAAIIARELGIPAVVGCGDATKTIKDGDEVTVSCAEGDTGFVYSGLLPYEQERLDVETMPELPMKVMLNVGNPERAFAFQSIPNSGVGLARLEFLISNTIGIHPKALLEFDTLKDEELKRYIKEKTVAYDSPVEYYIERLKEGIATIAAAFYPKPVIVRLSDFKSNEYANLVGGSLYEPHEENPMLGFRGASRYVSSSFSECFALECKAVRRVREEMGLDNVEVMIPFVRTVSEASNVIEVLKKHGLERGKCGLRVIMMCELPSNALLASEFLQYFDGFSIGSNDLTQLTLGLDRDSGLVASQFDERNDAVKALLHMAISACKKEGKYIGICGQGPSDHQDFAQWLMKEGIESVSLNPDSVLQTCLFLAKQSMN

SEQ ID NO: 4078 - protein, 462 aa, Moorella thermoacetica
MNEGQVVQVIGPVVDVEFASDRLPDLYNAITIKTDKINITMEAMQHLGNNTVRCVALSSTDGLQRGMKAVDTGQPITVPVGRATLGRLFNVLGEPIDNQGPVETTERLPIHRPAPSFEEQQPSTEVLETGIKVVDLLAPYAKGGKIGLFGGAGVGKTVLIMELIRNIAYEHGGFSVFSGVGERTREGNDLYLEMKESGVLEKTALVFGQMNEPPGARLRVGLTGLTMPEYFRDPEAQDVLLFIDNIFRFVQPGSEVSALLARMPSAVGYQPTLPTEMGPLQERITSTKKGSITSVQAIYVPADDLTDPAPATTFAHLDATTVLSRQIAELGIYPAVDPLDSTSRILDPRVLGEEHYQVVRGVQQVLQRYKELQDIIAILGMDELSEDDKLIVARARKIQRFLSQPFHVAEAFTGQPGVYVPLKETIRGFKEILEGRHDNLPEQAFYMVGTIDEAVKKGQELM

SEQ ID NO: 4079 - protein, 400 aa, Chlamydia muridarum Nigg
MSLFEQLPSFSPDSILGLAQAFQEDPREDKINLLLGTYEREKSRYGGFSSVRKAQTVFFGDEKDKNYLPIRGSSVFLDQMAALCFGEIDANRWTGVQAVGGTGALHLGALVYAKSSLAGKVYIPAQTWGNHSRIFSRLGLSLEHYPYYDQEKKDLDLQGLKASLRDAPEASLILLHCCCHNPTGKDIPLSEWPEIIAIIKDRGLIPFFDMAYLGFANGIVEDRRPVRLCIEAGVATFVAGSCSKNFSLYGSRVGFFGVVHQDKTDLSRILSFLEEQIRGEYSSPAREGVAIVTSILENPYLRQEWGLELNGIRQSLEEIRANFVIAMREVAGHSFDFIASQKGFFGYPGFSKEQVVFLREELGIYTTAGGRFNLNGITDKNINRVIHGFAKAYEYSRSVS

SEQ ID NO: 4080 - protein, 97 aa, Triticum aestivum
MADQEAAEPGPPSWPPWTSLLLRAMSKRRTWAALFLAVYAALLSSSWSLLASVRAWYYAAAAGSAAHPAAWPAALYASVMYGAVFGLLSMGAALAVA

SEQ ID NO: 4081 - protein, 161 aa, Zea mays
MTSSCSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 4082 - protein, 248 aa, Chromobacterium violaceum ATCC 12472
MQDEIMQPWVLVTGGSRGIGRGLVLELAKDYRVVFTYKNNAEQARAVEESVLRMGGEAYAVQCDGSDPEAAKRLATQCLERFGAPYAVINNAGVTRDGLMMSMSLESWRDVISTNLDAVFHVTQAFLPAMCGEKRGAVLLMSSVTAIKGNMGQANYAATKAAMAGLARTLALETARFKIRVNAIAPGLIDTDMADDIPEKARQQLEKSIPLRRLGTVGEVAGLAKYLLSDAAAYITGQTIVIDGGLSS

SEQ ID NO: 4083 - protein, 310 aa, Glycine max
  misc_feature (256)..(256): Xaa can be any naturally occurring amino acid
  misc_feature (262)..(262): Xaa can be any naturally occurring amino acid
  misc_feature (264)..(264): Xaa can be any naturally occurring amino acid
  misc_feature (266)..(266): Xaa can be any naturally occurring amino acid
  misc_feature (277)..(277): Xaa can be any naturally occurring amino acid
  misc_feature (292)..(292): Xaa can be any naturally occurring amino acid
  misc_feature (297)..(297): Xaa can be any naturally occurring amino acid
  misc_feature (301)..(301): Xaa can be any naturally occurring amino acid
AGGSVEKLQSLLDLALRTTAAAADPFHEGLTCVVERCSLLRRLGTFNDLEVTLRNSGDNDLEEPVSITSLETFSLSYKVHWPLSIVLSRKALTKYQLLFRFLFHCKHVDRQLCGAWQVHQGVRALNTSGTAISRSSLLCRSMLKFINSLLHYLTFEVIEPNWHLMYNRLQSANSIDEVIQHHDFFLDKCLRECLLLLPELLKKVERLKSMCLQYAAATQWLISSSIELHNPEEPIDDSKGLNKAKWKSGQVLKSTXRNMAVXDXVXKFEKEFNTELXSLGSILSNNSQAEPXLSHLXQWLXGVKSEKNGL

SEQ ID NO: 4084 - protein, 305 aa, Neorickettsia sennetsu str. Miyayama
MKVLMGSKAGKLGQEIASLLNLAVVRAQANRFPDGESDVLVHHEDVIPGTKVLVIQSLCSDADIMEFLFIVDALNRLGVRDIALVSPYFGYARADRIVAPGSAISAKVVARLIGERISLLFVLDVHFPQFEGFFEIPVYNILPWTLLKESVHVGHNMALVAPDVGAVKKLKPLSEELGTNLVIMNKRRPRACLSEVTEVVGEIHGRDCIIVDDIVCGGGTLCNSAAKLKELGAKSVAAFVTHGVFSGSARQKIMDSQIDRIVVTNSIPGPGCEAKGKIEIISAADLLARKIHSVYLDVNTKSPNC

SEQ ID NO: 4085 - protein, 493 aa, Vibrio vulnificus CMCP6
MELKQRLSQQLKESRDAFLRNPYPTYQKRLENLNKLESLIKAHQAEIIYAIEQDFGTRSISETGLLELFTSIETIRDAKKQLKKWMKPSHRHTSVWFFPAKNRVVPQPLGVVGVIVPWNYPLMLTIGPLVAALAAGNRVMLKMSQNSPHLAQLLVELFEAQFNRDEVAIYADEAEMGPEFSKLKFDHLLFTGSTKTGRAVMQSAANNLVPVTLELGGKSPVILDEKFDVKIALERLLGGKLYNCGQTCIAPDYLFVPQSRLNEVVETTKAIMAKRFRTIQHQDYTSIIDANAFERLTHLLSDAKEKGAKLINCIPDSEPERGSRKLPFYLVTEVESDMAVMQEEIFGPILPIITYQHIDEVFHYIAQRPRPLALYLFSEDKWLQKKFTQETLSGGLCINDVMLHVAQHDLPFGGVGESGMGHYHGREGFNTFSKLKPVMTQSRFALTPLFYSPYSGFAKSILNVMINRKIGNYESAIQQKLTSLLRIIGRDVS

SEQ ID NO: 4086 - protein, 567 aa, Oryza sativa Japonica Group
MASSALICDTEQWKGLQAHVGEIQKTHLRHLMHDVERCKAMTAEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 4087 - protein, 538 aa, Yarrowia lipolytica CLIB122
MVTFFLHLSQATFLPPPHPHIFTTYTMTPPPVAQTVLEHIGDTPMVELQKIPQSLGIKCRILGKCEYFNAGGSVKDRIAKRMVLEAEKQGRIKPDAGYTLIEPTSGNTGIGLALVGAVRGYRTIITLPEKMSNEKVSVLKALGAEIVRTPTEAAWDAPESHIGVARRLEQEIPKAVILDQYGNEANPDAHLYGTGAEIWEQTEGKVTHLVAGAGTGGTITGIAKALKAKNKDVVVVAADPKGSILAVPESLNDSNEGYKVEGIGYDFVPDVLDRDVINSWIKTEDRESFLLSRRLIKEEGLLVGGSSGSALAAALQVAKDLTENDTVVVVFPDSVRSYITKFIDDDWMKNNGFVDDATLAEQAKRKQQYKGATIADLHLKPVVTVKGDSTVATAVELMREKGFDQIPVSSKSSGKLIGLVTLGNLLSYLSHGRATPETPVEKVMLDFRKLDSHQLTADAIASATASLSIGTPSGDKKASKQRQFVEVTVDTPLSALNKFFEHNSSVIVTEKDSDGVKPVHIVTKVDLLAYLVKNGSFE

SEQ ID NO: 4088 - protein, 99 aa, Prochlorococcus marinus subsp. pastoris str. CCMP1986
MASYKVTLISESEGLNSTIEVPDDQYILDAAEEQGVDLPYSCRAGACSTCAGKITSGTVDQSDQSFLDDDQLEAGFVLTCVAYPSSDVTITTHAEEELY

SEQ ID NO: 4089 - protein, 385 aa, Emericella nidulans
MAATESALTIHNDISMELPELAPNQGLEAFKDILFGSAAGMIGKVIEYPFDTVKVRLQSQPDHLPLRYNGPLDCFRQSFQAEGLRGLYRGISAPMAGAAVENSCLFFSYRVVQELLQASYYSSTEPLPLTALVFSGAASGSITSLALTPIELIKCKMQVPSEPSSARVGPLKIIVSVFRQDGVLGFWRGQLGTLIRETGGGAAWFGGYEGVSALFRSYHYSPSTTFSSEVESGSLPLYQQMLAGAAAGVSYNFLFYPADTIKSRLQTEDINNTSSKRQTFGGAARLSGMSKDFAAYIEAVVSLVRGLPQARHSFLHYLKAYGVTLDERIRYVIRFDFDSRRFFGPFLLIDDTYDLSRLRFSCLIIRLFNQLALGPRSKVRWRKET

SEQ ID NO: 4090 - protein, 276 aa, Nicotiana sylvestris
MATNGCLISLPPFFTTTKSISSYPFLSTQLKPISLSSSLPTLLSLNKRTTQFPTFVSVLSEDDNTLVLDDQEQGGDFPSFVGEAGETEEYQEPSEDAKLFVGNLPYDIDSEGLAQLFQQAGVVEIAEVIYNRETDRSRGFGFVTMSTVEEADKAVELYSQYDLNGRLLTVNKAAPRGSRPERAPRTFQPTYRIYVGNIPWDIDDARLEQVFSEHGKVVSARVVFDRESGRSRGFGFVTMSSEAEMSEAIANLDGQTLDGRTIRVNAAEERPRRNTY

SEQ ID NO: 4091 - protein, 556 aa, Physcomitrella patens subsp. patens
MQVGDRSFEQGESSEVRKCTVRGCIKSTSGPWIVRRPPGKGQSTAPAVLRMPSARERENNKRRERRRRAIAAKIFAGLRAHGNYCLPKHADHNEVLKALCQEAGWQVEEDGTIFRKNSFRAVHPVIQRIVEAKPIRTVQLISLQMQHSIVRQFIRNQQQGSQPPSREVTTAHNTPEGTPSYERSFKSDTSPSTSCSQAGQTSDEPTCTARSGGAEVRHLGRISVDSQFEDKRQRCDPLSNFKTVVAFPSAVQARNPNPNSRDPKNRAGPKSVAGFLLPEQTVRLHHVGNLNDPPVPGAEDIAEVCTALAVKNEWETTQGTAGVLYSGGQTVGQTYIVSCASEKDTSDCFERVSVTAGHDRFSHDPLVADMMDCVDLGQQLECGRRKRFLEHQSKQLEYDQLNPYLNVHMNGDSSVVSQVQRQTQDPDPGKHYTLFPEAADLLNQSQREQGDQYSCITHEMVDVTGQAYKSLKDGLCLWSGRDGASVSTGSTRLSLHPAAAAASTTASNRGGASIISLQHKKVDADEDIVKDIADDLTLTLCTSVRHTHTPESSRVV

SEQ ID NO: 4092 - protein, 233 aa, Spinacia oleracea
CVAQTSEWEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 4093 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4094 - protein, 315 aa, Nicotiana sylvestris
MSCATKPIIKPSSMATNSCLISLPPLFATTTKSKSFAYPYLSNTLKPIKLLHLSCTYSPCILSPKKKTSVSALQEEENTLILDGQGQESGDLFNFEPSGEETEEEGFVEAVGDAGESDEVEADEEEEEFQEPPEDAKLFVGNLPYDVDSEGLARLFEQAGVVEIAEVIYNRDTDQSRGFGFVTMSTVEEAEKAVEMYNRYDVNGRLLTVNKAARRGERPERPPRTFEQSYRIYVGNIPWGIDDARLEQLFSEHGKVVSARVVYDRETGRSRGFGFVTMASEAEMSDAIANLDGQSLDGRTIRVNVAEDRSRRNTF

SEQ ID NO: 4095 - protein, 433 aa, Desulfitobacterium hafniense Y51
MTDWNNMLHKISDLDLIVSHGRVAKIVGLMIESDGPRVSVGEYCRIHTQQGKEIPAEVVGFRNSTTLLMPLAELEGIAPGDRVVPQQHKLEVGVGQALLGRILDGLGRPLDGRPMVTHRDYPLQNAPPSAFLRPRIRDPLSVGVRTVDGILTIGRGQRIGIFAGSGVGKSTLLGMMARNTTAGVNVIALVGERGRELRDFIEKDLGEEGLERSVLVVATSDQPALVRLKAAFTATAIAEYFRDQGQDVLLMMDSVTRFAMAQREVGLTTGEPPATRGYPPSVFAMLPKLLERSGMSEIGSITGIYTVLVDGDDHNEPIADTVRGILDGHIVLTRELAMQNHYPAIDTLQSVSRVMNDIIAPEHKELAGKLREHLAVYHDAKDLIDIGAYVTGSNPRIDAAIRHIEGINGFLRQDVEEKVSFDQMLQQLQQALR

SEQ ID NO: 4096 - protein, 131 aa, Brucella melitensis 16M
MEAVDIYTRQCSTLVTATDLATMGATLAAGGVNPISGKRMVSAGNVAPILAEMTMEGLYTALGDWAYTVGLPGKSGVGGGIMAVVPGELAIAAFSPPLDPAGNSVKAMAAVAAVADSLGHNLYTTRGKVSS

SEQ ID NO: 4097 - protein, 142 aa, Mycoplasma hyopneumoniae 232
MKKEKKLDHLTELQYKVTQQNFTEPAFDNLYNNNYQEGVYVDIVDGTPLFLSIYKYDSGSGWPSFSKPIDENLIVEVLDFSASLTRIEVRSKNADSHLGHVFSDGPKQFGGRRYCINSASLKFIPKSELKSHNLGHLLEFFK

SEQ ID NO: 4098 - protein, 200 aa, Brucella melitensis 16M
MSSSSDAIKAALEKGRAAGLSATGGKNADYIPFLASVPSDLFGLAVVTADGQTFKTGDADIAFAIESISKVFTLALVMEEIGPDSVREKVGADPTGLPFNSVIALELHNGKSLSPLVNAGAIATASLVPGDTADARWNNILECQCGFAGRRLKLSNEVNQSNRRPIFTTAPLPGCFTVPVLATAIRWRPWIFIRANVQRL

SEQ ID NO: 4099 - protein, 510 aa, Brucella melitensis 16M
MTTPTASPAAGKPAAVTPARMAKLSVLTLAIMNVTAVVSLRGLPSEATYGLTSVFYYIFAAVFFLIPVSIVAAELATGWPQKGGVFRWVGEAFGPRWGFLAIFLVWVESTIWFPTVLTFGAVAIAFAGPGQRWDEALAANKLYTIGIVLVVYWAATWVSLHRLKSAARIAKWGGMIGTIIPAAILIVLGFTYYFSGNYIEVQLAWRDLIPDFTNFNNLVLAAGIFLFYAGMEMNAIHVREIDNPARNYPLAILISSLVTVAIFVLGTLAIAFIIPASQINLVQSLLITYDSFFKLFGIDWLSPVMAIALAFGVLGGVTVWVAGPSSALSVVGRAGYLPPFFQKVNAKGAPSHILIVQGLIVTFLAIMFVVLPSVQAAYQILSQLTVTLYLIMYLLMFAAAIHLRYSEPNTPRPYRVPFGAFGMWLFAGVGLVGSLIAFVLSFVPPSQIAVGSPSAYIWMLIAGNVIFVAIPLITYAIRKPHWKTPEGSADFEPFNWEKEGRMPGSQQAAG

SEQ ID NO: 4100 - protein, 463 aa, Photorhabdus luminescens subsp. laumondii TTO1
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 4101 - protein, 304 aa, Brucella melitensis 16M
MCWHKFARYWDVEIREIPMEPGRLFMGPEQMLEAVDENTIGVVPTFGVTYTGNYEFPEPLQDALDKLQKTKGLDIDIHVDAASGGFLAPFCAPDIPWDFRLPRVKSISASGHKYGLAPLGCGWVVWRDKEALPEELIFNVDYLGGQVGTFAINFSRPAGQVISQYYEFMRLGREGYTKVQQAAYRVAQYIAREIEPLGPYEFICAGEEKGGIPAVCFRIREGEDPGYSLYDLSERLRLTGWQVPAFALSGKASDITVMRVMCRRGFEMDLAALFIRDFKAGIEFFKSHPSPKITPSMGTGFHHT

SEQ ID NO: 4102 - protein, 276 aa, Methylobacterium extorquens
MQHATDLISIIALGLVCAFIGGMLAQRMRLPPLVGYLVAGIAIGPFTPGFVGDPALASQLAELGVILLMFGVGLHFSIGDLLAVRTIALPGAIVQITVATAMGAGLAWGFGWGAGAGLVFGLALSVASTVVLLRALEGQGLLDSDKGRIAVGWLIVEDLAMVVALVLLPALAPSLGGEAMQAAGHHGPPEHGLWVTLGLTLAKVGVFVAVMLVGGRRLIPYLLGLAARTGSRELFTLAVLASAVGIAFASSELFGVSFALGAFFAGMVLAESDLSH

SEQ ID NO: 4103 - protein, 80 aa, Glycine max
  misc_feature (53)..(53): Xaa can be any naturally occurring amino acid
  misc_feature (67)..(67): Xaa can be any naturally occurring amino acid
  misc_feature (72)..(72): Xaa can be any naturally occurring amino acid
NTTSSNRNASFTSLKSIAGYPTIKTNKHITFIASNGGRMQCMHVWPQFGKKKXENIYYLPDLEDAHXANEVXYLLTKGWI

SEQ ID NO: 4104 - protein, 167 aa, Brucella melitensis 16M
MKITLEVIMTGSNYPARDLIASVFGTEALQEIAASRGFREKEMQANAVYQIIHDELFLDGNARQNLATFCQTWDDDYVHKLMDLSINKNWIDKEEYPQSAAIDLRCVNMVADLWNAPKFADNATGTNTIGSSEACMLGGMAMKWRWRKKMQEMGKPTDKPNFVCGPV

SEQ ID NO: 4105 - protein, 418 aa, Legionella pneumophila str. Lens
MTYDKIKVPAQGEAITVAADHSLHVPDNPIIPFIEGDGIGVDVTPPMIRVVDAAVQKAYGNKRKISWMEVYAGEKATKVYGGDQWLPKETLDAMKKYVVSIKGPLTTPVGGGIRSLNVAIRQDMDLYVCLRPIRYFNGVPSPVREPWKTDMVIFRENSEDIYAGIEWQADTPEAKKVIQFLTQEMGVKKIRFPEHCGIGVKPVSREGTTRLVKAAIQYAIDNDRSTVTLVHKGNIMKFTEGAFKDWGYQVARDSFGAKEYQGGPWMEFKNPKTGKQIIINDVIADAFLQQILLRPEDYSVIATLNLNGDYISDALAAQVGGIGIAPGANISDQMAVFEATHGTAPKYAGQNKVNPGSIILSAEMMLRHMGWYEAADLIIRGMEGAIEAKTVTYDFERGMQGATLVSSSGFADAMIKHM

SEQ ID NO: 4106 - protein, 424 aa, Brucella suis 1330
MNPNTSPVWHPFTQHRLEPRPDRIVRTEGAYLFREDGSAVLDMISSWWVITHGHRHPAIMDAIRQASADLDQIIFADFSHQPAEELAKGLIALAPDGLSHVFYSDSGSTAVEVAIKMALGYFYNRGEPRSRIAVLQHSYHGDTIGTMSAGERGVFNAAYGALLFNVETLPFPSPGHEQPMLDRLEDVCRGGDLAALLVEPLVLGAGGMKMYPAHILAAMREITERHGVLLAVDEVMTGWGRTGTLFACEQAGITPDILCTSKGLTGGSLPLAATLCTAAIFDAHYSDDRSKTFFHSSSYTANPIACAAALANLQVWLSEPVTERISALTRMQTERLHRFKDDSRFAGLRQTGTITALELDVPAGGYLSDAGPKLRTFFKQNGVLLRPLGNVIYVMPPYCVTAEELDRTYDVITQGVDMIAGQTR

SEQ ID NO: 4107 - protein, 233 aa, Vibrio alginolyticus
MSSIQQNIEHITSQIRYDEQKCGRTPESVQLLAVSKTKPVEAILEAYQAGQTAFGENYVQEGVSKVQHFAEHYPDNRIEWHFIGPIQSNKSRLVAEHFDWVHTIDRTKIAQRLNDQRPSELKPLQVLIQVNTSGEASKSGVTEAEVFELAELISRLPNLTLRGLMSIPANVSDYESQLHEFQKLATLKQTLEAQFPEIDTLSMGMSGDMTAAIEAGSTMVRIGTAIFGARDYS

SEQ ID NO: 4108 - protein, 130 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAAPPYLCFAALLMAGLDGI

SEQ ID NO: 4109 - protein, 363 aa, Nostoc punctiforme PCC 73102
MTLSLSVAKSHRQPWPGLIEAYRQYLPVSEKTPVVTLLEGNTPLIPVPAIAERIGRQVRVFVKYDGLNPTGSFKDRGMTMAISKAKEAGAKAVICASTGNTSAAAAAYARRGGMNAFVLIPDGYVALGKLAQALLYGAEVLAIKGNFDQALEIVREMAESYPVTLVNSVNPYRLEGQKTGAFEIVDALGDAPDWLCIPVGNAGNITAYWMGFCQYHQDGKCDRLPRMMGFQAAGAAPLVHGQPVAHPETLATAIRIGNPASWELAIAAQTASQGNFHAVTDAEILDAYRLLASSEGIFCEPASAASVAGLLQVKDQIPTGATVVCVLTGNGLKDPDTAIKHNHSQFKQGIAAELGAVAEAMGF

SEQ ID NO: 4110 - protein, 306 aa, Vibrio vulnificus CMCP6
MNKLVVLGSVNADHVLQVPSFPRPGETLHGRNYQVIPGGKGANQAVAAARLGADTGFIACVGDDSFGINIRENFKLDGIQIDGVKMQPNCPTGIAMIQVADSGENSICISAEANAKLTEVAIESDLPRIRDARFLLMQLETPICGIELAAREAKAAKTNVILNPAPARTLSDELLACIDVITPNETEAQVLTGIEVVDDESAQQAANVLHQKGIEIVMITLGSKGVWLSENGRGQRICGFKVDVTDTTAAGDTFNGALVTGLLEDMPLESAIKFAHAAAAISVTRFGAQTSIPTRKEVDEFLAAHS

SEQ ID NO: 4111 - protein, 467 aa, Glycine max
KSTRSNRSLPVDIEVPQVVLPNPDQQLSDDGSTLVSNGGTFELGFFNPGSSNNRYVGIWYKKISIKTVVWVANRDNPIVRHNSSKLVIRQEGNLVLLSNNNQSLLWTTNVTKKASSSSPIVQLLDTGNLVIKDGINEESVFLWQSFDHPCDTLLSGMKLGWDLRTGLNRRLTSWKSWDDPSSGDIVWEVVIGNNPELVMWKSKVDYFRTGPYTGNMFSGVYAPRNNPLYNWKFVSNKDEVYFQYTLSNSFVVSIIVLNQTLNLRQRLTWIPDTKTWTVYQSLPLDSCDVYNTCGPNGNCIIAGSPICQCLDGFKPKSPQQWNAMDWRQGCVRSEEWSCGVKNKDGFQRLASMKLPNTTFSWVNESITLEECRAKCLENCSCTAYSNLDTRGGGSGCSIWVGELVDMRDVKSGQDLYVRIATSDPDGKHERQKKVILVVAITVSLVLVMLLAFCVYMIKKKYKGEFLT

SEQ ID NO: 4112 - protein, 204 aa, Neisseria gonorrhoeae FA 1090
MSFDNHLVPTVIEQSGRGERAFDIYSRLLKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCGRDLADLERDTDRDNFMSAEEAKEYGLIDQVLENRASLRL

SEQ ID NO: 4113 - protein, 148 aa, Triticum aestivum
MSAAALRARLNNHVTSMFATDTVDEYFQYLQSVDEDGSSAPGLVAEVINLFIGDANSILNGIASLLNQTMVDFNKVDDLVHQLKGCSCSVGAKKVNLSCMHFHHFIEARTKEGCLMASALLTNEFCDVRDKFQTMMQLEQQIAACGPK

SEQ ID NO: 4114 - protein, 444 aa, Brassica rapa subsp. chinensis
MATITAVKARQIFDSRGNPTVEVDVHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLADNPKIVLPVPAFNVINGGSHAGNKLAMQEFMILPVGASSFKEAMKMGVEVYHNLKSVIKKKYGQDATNVGDEGGFAPNIQGNKEGLELLKTAIEKAGYTGKVVIGMDVAASEFYSSDKTYDLNFKEENNNGSQKISGDALKDLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 4115 - protein, 142 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4116 - protein, 188 aa, Thiobacillus denitrificans ATCC 25259
MPLNLPNLLTWLRILFIPLMAGVFYLPDGWVTPPQANLLAALFFGVAALTDWLDGYLARALGQTSAFGAFLDPVADKLMVAAALIVLIDLDRVAPLIGLIIIGREITISALREWMAKAGKSASVAVSFVGKLKTAGQMVAIVLLLYFAPLAGLPTARIGTLLIWLAAVLTLISMAYYLMMAARALQKT

SEQ ID NO: 4117 - protein, 309 aa, Prochlorococcus marinus subsp. pastoris str. CCMP1986
MTATTFRNKNSNWTISDIPNLDGKTAFITGANSGLGYYTAKALAEKNAHVLLACRSLEKANSAIDKLKSLNPKGKFTPVELDLSDLNNVSEIGLKISSEFENLDLLINNAGIMHPPKTLSKQGFEIQFAVNHLAHMLLTLKFLPLIEKKENSRIVTVTSGAQFFGKVGWNNLKAENYYNKWESYATSKLANVMFALELNEKIKQKNILSLAAHPGIAKTNLFSAQKPKPSPIETFSLELFSPIFQSAEMGALPQLLAATSPMAKGGDHYGPKFNFRGHPKLSPTSPFALNKKERKNLWEKSLEILNSFL

SEQ ID NO: 4118 - protein, 195 aa, Vigna unguiculata
MILIVVFGQSSFTVASIFEGIFWFLLPATLIVINDIAAYIFGFFFGKTPLIKLSPKKTWEGFIGASVTTIISAFMLADIMGHSQWLTCPRKDLSTGWLHCDPGPLFKPESYSLPGWIPHWFPWKEVSILPVQWHALCLGLFASIIAPFGGFFASGFKRAFKIKDFGDSIPGHGGITDRMDCQMVMAVFAYIYHQS

SEQ ID NO: 4119 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 4120 - protein, 519 aa, Blastopirellula marina DSM 3645
MAMDRFHVGPIVVLGAGINGAAIARELALQGADVLLVDAEDLAGGTTSYSSRLIHGGLRYLEYAEISLVRESLAERDRLLRLAAEMVHPLELVIPVGNRLSGLISGAQRFFLKSGAAPKNGRGSLVVRLGLTLYDRFASGAVPSHRRITSAQFAESGLNAKKFFTAFSYFDGQLTFPEQFVLALVQDAQAAAKEQGGAFSLRTYQHVRREGETLFFSSIHPNQESAGNEVAVTPAAVINAAGPWVDAALAGLNVSSAKLIGGTKGSHLISRCPDLRKALGPRGVYAEAADGRPIFILPWNDACLIGTTDIRYDGDPAEAVADDEEIEYLIDATNAIFPDVGFTRDDVQQHYCGVRPLPAVGQGTTSSITRSHVVHRHEGTPFPLYSIIGGKLTTCRSLAEDTVQVVLPDLHQTVEHNSRERPLPAPYFGDTPADAELLPDVNIPVAHAAYGIEHLAAKTLADLVERRLMLVFDPHLSRQCLHTLGEQLATAGWLDRSQIDDEVDNYVARLQKRYGKRVS

SEQ ID NO: 4121 - protein, 450 aa, Escherichia coli CFT073
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTIEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 4122 - protein, 103 aa, Neisseria gonorrhoeae FA 1090
MKQLTLKEAQEFYAVHKDRPFYAGLVEFMTGGPVMIQVLEGENAVLKNRELMGATNPTEAAEGTIRADFATSVSINAVHGSDSVENAALEIAYFFSQTEICPR

SEQ ID NO: 4123 - protein, 538 aa, Populus tremula
MEEMYPAVAVPFRVGNSACESPSIDTQMDITRILMADTASLLSDTVTKVPTAGDKDCNCAAPASKEDRGGRGAALLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4124 - protein, 159 aa, Francisella tularensis subsp. tularensis SCHU S4
MSFRIGHGYDVHKFTSAKQNIIIGGVEIAYHLGLEAHSDGDVLIHALCDAILGALGLGDIGKHFLDTDNQFKNIDSKFFLAEIKKMLDKKQYSISNIDCTIIAQAPKMLPHIEKMRACLANILEIQISQINIKATTTERLGFIGREEGIATHVVCLLYR

SEQ ID NO: 4125 - protein, 158 aa, Photobacterium sp. SKA34
MRIGHGFDVHKFGGEGPVIIGGVAIPYEQGLIAHSDGDVALHAVCDALLGAIGAGDIGRHFPDTDAEWAGADSRFLLRDVYSKVKAQGYSLGNVDVTIIAQAPKMAPYIDAMCQAIAEDLETDITNVNVKATTSERLGFTGRKEGIACEAVVLIKKVS

SEQ ID NO: 4126 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4127 - protein, 365 aa, Gentiana triflora
MGSLLPSRVESLAISGIKTIPKEYIRPKEELASIGNIFEEAKNNNETTQIVPTIDLKDMDSLDNNKDVQTQCHGELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 4128 - protein, 362 aa, Brassica napus
MSQNGKLIPPNMDQNSTRLLNLTVLQRLDPFIEEILITAAHVTFYEFNIEISQWSRKDVEGSLFVVKRNKQPRFQFIVMNRRNTDNLVEDLLGDFEYEVQGPYLLYRNASQEVNGIWFYNKRECEEVARLFDRLLSAYSKANQKPNTSSSKSEFEELEAVPTMAVMDGPLEPSSTARDAPNDPAFVNFFSSAMALGNTSSGQTSGPPYQQPSPIPLQPHQPTLAPPAATAAPPQILSPPPLQSSSPMMPLFDNNPDLISNKSNVHTDLVTPSSFFGPPRMMAQPHLIPGSSMPTTNAIHQQRPYGTPMLQPFPPPTPPASLAPAHSGPVINRDKVKEALLALVQENEFIDMVTRALQNAHQP

SEQ ID NO: 4129 - protein, 434 aa, Photobacterium sp. SKA34
MSKIVKVLAREIIDSRGNPTIEAEVHLEGGFVGMAAAPSGASTGSREALELRDGDKSRFLGKGVLKAVAAANGPIAEALIGQDAKDQAAIDQVMIDLDGTENKSNFGANAILAVSLANAKAAAASKGMPLFEHIAELNGTAGQFSMPLPMMNIINGGEHADNTVDIQEFMIQPVGAKTLREAVRMGSEVFHSLAKVLKSKGMSTAVGDEGGFAPNLESNEAALKAIQEAVEAAGYELGTDITLAMDCAASEFYNKEQGIYDLKGEGKQFTSEEFNYFLKDLTEKFPAIVSIEDGLDESDWAGFKHQTELLGDKIQLVGDDLFVTNTKIFAEGIEKGITNSILIKLNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 4130 - protein, 485 aa, Oryza sativa
  misc_feature (70)..(70): Xaa can be any naturally occurring amino acid
  misc_feature (76)..(76): Xaa can be any naturally occurring amino acid
MASLADSFLADLDELSDNEAYPEEENAEAVGMDEDGGEDMLDLESLNYDDLDSVSKLQKTQCYNDIMQKXVEDALXKGTDFSNQGSILEEDPEYQLIVDFNALSVDIENEIIIIHNFIRDKYRLKFPELESLVHHPIDYARVVQKIGNEIDLTLVDLEGLLPSAIIMVVSVTASTTNGKPLSEENLAKTIEACERALTLDAAKKKVLDFVESRMGRIAPNLSAIVGSAVASKLMGTAGGLGALAKMPACNVQLLGAKKKNLAGFSSATSQFRVGYLEQTEVFQSTPPALRTSACRLIAAKSTLAARINSIRGDPTGKAGRNLLEEIRKKIEKWQEPPPAKLPKPLPVPDSEPKKKRGGRRLRKMKERYAQTDMMKLANRMQFGVPEESSLGDGLGEGYGMLGQAGSGKLRVSAAQSKLAAKVAKKFKEKSYGSSGATSGLTSSLAFTPVQGIELSNPQSHGNLLGSGTQSTYFSETGTFSKIKRN

SEQ ID NO: 4131 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETEGNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4132 - protein, 727 aa, Oryza sativa Japonica Group
MAQHSAAAAGGDEEVAEAEAAAAAAAGSTLRHRHAGKGAEEHEAAGRGRGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTIAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 4133 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDLMSNEEACDLARKRILVWHKKNGVALSSSRSEGIDPAAQAAAEFLSNRALQKGSKDNITVIVVDLKAQRKFKTKT

SEQ ID NO: 4134 - protein, 128 aa, Triticum aestivum
  misc_feature (8)..(8): Xaa can be any naturally occurring amino acid
PAMSLRGXEAWAGRGVLVYLRGHEGRGFGLGHKLRAYNLQDDGRDTVEANEELGLPVDSREYGIGAQILRDLGVRSMKLMTNNPAKYVGLKGYGLSIVGRVPLVTPITTENQRYLETKRTKMGHVYSN

SEQ ID NO: 4135 - protein, 148 aa, Brassica napus
MASTAISSVIVGTSFLRRQTSPISLRSLPLANTQTLFGLKSGTARGGRVTAMATYKVKFITPEGEQEVECDDDVYVLDAAEEAGIDLPYSCRAGSCSSCAGKVVSGFVDQSDQSFLDDDQIAEGFVLTCAAYPTSDVTIETHREDDIV

SEQ ID NO: 4136 - protein, 420 aa, Photorhabdus luminescens subsp. laumondii TTO1
MSFETISVIGLGYIGLPTAAAFASRNKKVIGVDVNQHAVETINRGAIHIVEPDLDKVVKVAVEGGYLKAVIAPLPADAFLIAVPTPFKGDHEPDMTYVRSAAESVAPVLKKGDLVILESTSPVGATEQMAEWLAAARPDLTFPQQVGEESDIDIAYCPERVLPGQVMVELIKNDRVVGGMTLKSSARASELYKIFLEGECVVTNSRTAEMCKLTENSFRDVNIAFANELSLICADQGINVWELISLANRHPRVNILQPGPGVGGHCIAVDPWFIVSQNPKQSRLIHTARMINDDKPLWVVNQVKAAVADCLAESGKRASEVKIACFGLAFKPNIDDLRESPAAHITGMIAQWHTGETLAVEPHIHELSAPLKEITQLVNLEKALEEADILLMLVDHNQFKAVNSHEIKQKWIVDTKGVWR

SEQ ID NO: 4137 - protein, 171 aa, Glycine max
MEFYTRPNRSDIHLSAEEEATIEAKTRDYFDGVAPQRHTKPQRSEYSAQYVDAFSNAHHSSSSSSIPEFMQFQRLENDPQEKKLEYNGSQVPEEFVETEYYQDLNSVDKHHHTTGTGFIKVEKNGNDFHIEPDNDTGCHHSCKCNPATNDWVPSPSNEVGFNSDKPNRSDN

SEQ ID NO: 4138 - protein, 141 aa, Legionella pneumophila subsp. pneumophila str. Philadelphia 1
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 4139 - protein, 378 aa, Pseudomonas putida KT2440
MTKPAILALADGSIFRGEAIGADGQTVGEVVFNTAMTGYQEILTDPSYAQQIVTLTYPHIGNTGTTPEDAESSRVWSAGLVIRDLPLLASNWRNTQSLPEYLKANNVVAIAGIDTRRLTRILREKGAQNGCILAGDNISEEAAIAAARGFPGLKGMDLAKVVSTKERYEWRSSVWELKTDSHPTIDAADLPYHVVAFDYGVKLNILRMLVARGCRVTVVPAQTPASEVLALNPDGVFLSNGPGDPEPCDYAIQAIKEILETEIPVFGICLGHQLLALASGAKTVKMGHGHHGANHPVQDLDTGVVMITSQNHGFAVDEATLPGNVRAIHKSLFDGTLQGIERTDKSAFSFQGHPEASPGPTDVAPLFDRFTDAMAKRR

SEQ ID NO: 4140 - protein, 375 aa, Pseudomonas putida KT2440
MSKRDYYEVLGVERGATEADLKKAYRRLAMKYHPDRNPGDKESEDKFKEANEAYEVLSDASKRAAFDQYGHAGVDPSMGGGGAGFGGANFSDIFGDVFSDFFGGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 4141 - protein, 221 aa, Dechloromonas aromatica RCB
MAAWLNCMFPPNLKTDHDKEFPMAVLVGKQAPDFTATAVYGNNEIKELKLSSFKGKPVVLFFYPLDFTFVCPSELIAFDHRLEEFKQRGVEVIGVSIDSQFTHLAWKNTAVKEGGIGPVGYPLVADVKHEICRAYDVELEAAGVALRGSFLIDKNGTVMHQVVNMLPLGRNIDEMLRMVDALQFFEENGEVCPAGWNKGKPGMVASTEGVAAYLAKNAKKL

SEQ ID NO: 4142 - protein, 382 aa, Salmonella typhimurium
MIKSALLVLEDGTHFHGRAIGATGSAVGEVVFNTSMTGYQEIVTDPSYSRQIVTLTYPHIGNVGTNKADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTAETYRWTQGSWTLKDGLPEAKSEDDLPFHVVAYDFGAKRNILRMLVDRGCRLTVVPAQTSAEEVLKMNPDGIFLSNGPGDPAPCDYAITAIQKFLETDIPLFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIEQYRQSAK

SEQ ID NO: 4143 - protein, 604 aa, Emericella nidulans
MTIGSKFSLLAGTRKTDGPTEISASSPPDVETPSAEKTATASAGNKEVGINDNSSDEALPSQHVQTGVQKIQAVTLVWSKWSLVAVFCLLWLVTLANGFRQSILYSLTPYATSSFQSHSLLTVINIVSSAMVSALYIPVAKVVDVWGRAEGWLVMVGLSTLGLIMMAASKNLETYCAADVFYSVGFAGMNYILCVLAADITNLRNRGIAFAFTSSPYMITAFAGSKAAEKFLVNVNWRWGFGAFAIIFPFVASPVYFVLKVGLNRAEKQGIIQPRLRSGRTLSQNFKYYFFAFDIPGVILLAGGLTVFLLPFTLATRAPNGWKSDYIIAMIVTGFVVMVLFVLYQAYWAPQPFLKYEFLTNRTVLGACLIDATYQMSYYCWNSYFNSFLQVVCNLPVAEAGYVGSTFQVVSGVLLFMVGFAIRKTGYFRWLLFIGVPLYIFAQGLMIHFRQPNQYIGYIVMCEIFISIGGSIFVLLQQLAVLVAVDHQYVAAALAVLFISGGIGGAVGNAISGAIWTNTFLPALMRNLPESAKANAVAIYGDLRVQLSYPVNSPERIAIQESYGYAQARMLAAGTGLMALMFIWMFMVKNYNVKNMSQTKGMVF

SEQ ID NO: 4144 - protein, 181 aa, Zea mays
RWRSPREIVYTRNATEAINLVAYSWGMNNLKAGDEIITTVMEHHSNLVPWQMVAAKTGAVLKFVQLDEQESFDLEHFKTLLSEKTKLVTVVHISNTLGCVNPAEEIAQLAHQAGAKVLVDACQSAPHYPLDVQLIDCDWLVASGHKMCAPTGIGFLYGKEEILEAMPPFFGGGEMIAEVFF

SEQ ID NO: 4145 - protein, 146 aa, Clostridium acetobutylicum ATCC 824
MKKDDLSKKLTPLQYEVTQNNATEPPFNNEYWDNKSEGIYVDIISGKPLFTSLDKFDSGCGWPSFTKPIVKENIKANTDFSYNMKRIEIRSKDSDSHLGHVFDDGPKDKGGLRYCINSASLKFIPKEALEEEGYGEYLKLFNKKEE

SEQ ID NO: 4146 - protein, 174 aa, Vigna unguiculata
MAEDDIYTKDGTVDHRGNPANKKETGTWRACPFILGNECCERLAYYGMSTNLVLYFKNRLHQHSATASNNVSNWSGTCYITPLIGAFLADSYLGRYWTIAIFSIIYAIGMTLLTLSASVPGIKPTCHGGEKCHATTLESAICFLALYLIALGTGGIKPCVSSYGADQFDDTDPV

SEQ ID NO: 4147 - protein, 134 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4148 - protein, 128 aa, Acinetobacter sp. ADP1
MAYSEKVIDHYENPRNVGILDKNAENVGTGMVGAPACGDVMRLQIQVNNDGVIEEARFKTYGCGSAIASSSLVTEWLKGKTLDQAQAIKNIDIANELALPPVKVHCSVLAEDAIKAAIEDYRNKRSKA

SEQ ID NO: 4149 - protein, 148 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 4150 - protein, 289 aa, Bacillus licheniformis ATCC 14580
MTYIMSMRVGYLGPEATFTHLAVCSCFSDADQQAFNTIPACMDAAMNGEIDLAVVPLENAIEGSVNLTIDYLIHEQPLYIVGEITAPIRQHLLVHPTRKEAWEDIQKVYSHSHAIAQCHKFLHSRFRSIPFEYATSTGAAAKYVSENPEENIGVIANEMAADTYGLDIVKRDVHDYEYNHTRFVMLHPDREASPPVNPQLKGRPKTTLLVTLPSDRSGALHQVLSAFAWRNLNLSKIESRPTKTGLGNYFFIIDIEMALDDVLIPGAIAELEALGCKVKMLGAYNAYTL

SEQ ID NO: 4151 - protein, 658 aa, Bacillus thuringiensis serovar konkukian str. 97-27
MIEKYKHGKVKKLFEVKTLILLQVNALSKLYGAETILANIKLEVQTKDRIALVGRNGAGKSTLLKIIAGELSHDGGEIIKPKDVSVGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVIELSTEGAQEYLGDYDYYVEKKNEMIERAELEQEDETPVQKTVAQEKLNYLEEKERKKLERQRTRKIEELEQNIVQFEEEIATLEDQLCLPEIYADYEKASEITTKKQTLQEQLDACMAEWEELHL

SEQ ID NO: 4152 - protein, 538 aa, Populus tremula
MEEMYPAVAVLFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDLMSNEEACDLARKRILVWHKKNGVALSSSRSEGIDPAAQAAAEFLSNRALQKGSKDNITVIVVDLKAQRKFKTKT

SEQ ID NO: 4153 - protein, 538 aa, Populus tremula
MEEMYPAVAVPFRVGNSACESPSIDTQMDITRILMADTARLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4154 - protein, 174 aa, Physcomitrella patens subsp. patens
MAFGISKGMVLPLMILNFCLYFIAACLAGSILNRNLDANQGITNNFPIGNVVTPIFIPVVLIACMAGLASVLAGLHHVRIWRTESLAAAAATAVIAWTLTLLAMGLACKQIHTRYGRSKRMKTVEAFMIILSLTELLYLLALYAGRVTREGYANAPGQRAVNDPKYGTPAATAV

SEQ ID NO: 4155 - protein, 121 aa, Moritella sp. PE36
MSITKDQIIDAIAELSVMEVVELIEAMEEKFGVSAAAAVVAGGAAAAAEEEQTEFDVILASFGENKVKAIKAVRAATGLGLKEAKGVVESAPVAVKEGVEKAEAEELKKVLEEAGCTVEIK

SEQ ID NO: 4156 - protein, 507 aa, Zea mays
  misc_feature (76)..(76): Xaa can be any naturally occurring amino acid
  misc_feature (199)..(199): Xaa can be any naturally occurring amino acid
  misc_feature (476)..(476): Xaa can be any naturally occurring amino acid
MAAEPPAYLLLLPLIAIPLIVFLVLSRRRDDQRRFPPAPWALPVIGHLHHLAGAPPHRALRDLARRHGPLMTLRFXGELRVVVASSPDAAREILRTHDVDFASRPIGPMLQLVFRGAEGLIFAPYGDGWRQLRKICTLELLSARRVHSFRPVREDEVGRLLGSVASAAAAGLPVNLSERITAFVADAAVRAIIGSRGAXHRDEFLRLLMDGLKIIPGLSLPDLFPSSRLAMLVSSVPGKIERRRKGLLDIVDPIILEHQEKRAAGGIDEDEDLLDVLLRLQKDMDSQYPLTTDNIKSVLIDMFGASSETSATTLKWTMAELMRNPAVMRKAQDEVRGALAGHDEVAEDSLVNLRYLQLVIKETLRLHPPAPLLLPRECRSPCQVLGYDVPRGTMVLVNAWAIGRDPALWDAPEDFVPERFEESGRDFKGMDFEFIPFGAGRRMCPGMAFGLAHIELALAALLFHFDWKLPEGVACXEEIDMAEAVAITAPPRSDLVVLPVTRLPVSI

SEQ ID NO: 4157 - protein, 449 aa, Idiomarina loihiensis L2TR
MSASEQLVKQLRKKRERIQKPSVAVSGYLTRVVGLMFEAVGCRAPVGSSVAVEADSGDIEAEVVGFEGNISYLMPTEDAHGVIPGARVRPLNRKNQLPLGMELLGRVIDARGEPLDDKGPIFSDGKTYRSKPMNPLNRRQVKQPLDVGVTAINACLTVGQGQRMGLFAGSGVGKSVLLGMMTRGTTADVIVVGLIGERGREVKEFIEEILGEEGREKAVVIAAPADQSPLIRLRGCETASQVAEYFRDQGLNVLLLMDSLTRYAMAQREIALAVGEPPATKGYPPSVFAKLPALVERAGNGGDGQGSVTAFYTVLTEGDDLQDPIADSARAILDGHIVLNRELADSGHYPAIDIEASISRVMPQVVSEEHMQQAIKVRQWYSSYRRNRDLISIGAYTRGSDPAIDQAIAMQPRVSMFLQQKMREVVNYDESLLLLNQLVNPKQKQSAGM

SEQ ID NO: 4158 - protein, 563 aa, Dechloromonas aromatica RCB
MKIAFHPKLLDCLPTYNRTQLGQDIAAGITVGVLALPLAMAFAIASGCSPTAGIWTAIVAGLITSLLGGSRVQIGGPTGAFIPIIYGIVAIHGFSNLLGATMLAGVFLLAMGLARMGQLIRFIPVTVVIGFTNGIAVVIFLAQIKDFFGLKIESLPAEFFHRIKTLAAYADTVDLPTLGLASACFIFLLSYNWLAQRIAILRRAPGPLAVLVVGTLVSYIFDLPVETIGSRFHGIPQELPHFGLPDLSIHDFGQLISPAITIALLGAIESLLSARVADGQIDDRHDPNQELVAQGLANIVAPLFGGFAATGAIARTTTNVKSGGRTPIAGIIHAFVLLGVVLIAAPLASYVPLATLSAIVMVVAINMGEWHEFRELQRYTYNYRIILLATFIVTVLFDLTIAVELGMVLACLFFIYRMSELTRVERRPLREEASEPQFLYPDGTMRVAAWQLFGSLFFGAVNKLEALLDPAAGHPEVVILDMTQLIQLDTTGLEGLESLLDKLKKRGCTLLVCGLNSQPGSLLYRSGFVDHLGDDNVCPDLSSALQRAYILLPNLMGSHEEDY

SEQ ID NO: 4159 - protein, 406 aa, Streptococcus pneumoniae
MKLAVVGTGYVGLSISVLLSQHHEVVAVDIIPEKVNLINEGKSPIKDDYIEEYLANKSLNLVATLDASKAYTDADFVIIAAPTNYDSEKNFFDTSAVEKVIETVLEINPNAVMVIKSTVPVGYTQWVRNKYKTNNILFSPEFLRESKALYDNLYPSRIIVGLDMDDAYLRERAETFAKLLQEGAIKEAIETLYMGFTEAEAVKLFANTYLALRVSYFNELDTYAEVKGLDTKAIIEGIGLDPRIGNQYNNPSFGYGGYCLPKDSKQLLANYKDVPQNMITAIVESNRTRKDFIAEQILKFAEVSSNGDIHTKDVIIGLYRLTMKSNSDNFRQSSIQGVMKRLKAEGVNVIIYEPTLSDNETFWGSKIVNDLEYFKSISNVIVANRYDDLLKDVSDKVYSRDIFKRD

SEQ ID NO: 4160 - protein, 218 aa, Desulfitobacterium hafniense Y51
MKDVLFSASMMCANYGHLETEIRSLETAGIDSFHVDIMDGHFVHNFAMGLYELKYICRTAKKNVECHLMITDPYNYIDTFADAGVDVVYIHPESEYQPSATIEKIQNAGMIPGIAINPGTSVETITELLKIVGRVLVMCVNPGNAGQIYLPFVHDKICKLLDMQKEYGFEVYWDGHGSVENIRKYAPLGVRGFVLGSATLFGKGRGYGEILSELRNGL

SEQ ID NO: 4161 - protein, 377 aa, Pseudomonas aeruginosa UCBPP-PA14
MNCYQDEFDQTNGLRYLNHAAVAPWPRRAADAVSAFARENVAHGASDYPEWLKIEHRLRERLARLLNARAGSDLALVKNTSEALSFVAFGLDWREGDQVVIGNEEFPSNRVVWEALRPRGVEVVEVGLAGDDPEGALLAACGPRTRLLSISAVQYASGLRLDLERIGTGCRRRGVLFCIDAIQQLGALPFDVQAYDCAFAMADGHKWMLGPEGLGVFYCHPEQRERLALHEYGWHMLEHALDYERRDWRPARSARRFECGSPNMLGAMALEASLGLLEEVGMERVGRDIAERVQWLQDGLSGIPGVRLHSPRNPSRRAGILTFSLDGQDSRTLFETLRQERVICAQRGGGIRFSPHFYTSSTVIDDTLAILRQVAGT

SEQ ID NO: 4162 - protein, 97 aa, Hordeum vulgare
ATKKVKLVTPEGEVELEVPDDVYILDQAEEEGIDLPYSCRAGSCSSCAGKLVSGEIDQSDQSFLDDDQMEEGWVLTCAAYPKSDVVIETHKEEELTA

SEQ ID NO: 4163 - protein, 442 aa, Chlamydia muridarum Nigg
MKELTTEFDTLMTELPEVQLTAVVGRIIEVVGMLIKAVVPDVRVGEVCLVKRHGMEPLVTEVVGFTQNFVFLSPLGELSGVSPSSEVIATGLPLHIRAGAGLLGRVLNGLGEPIDIETKGPLENVDSIYPIFKAPPDPLHREKLRTILSTGVRCIDGMLTVAKGQRIGIFAGAGVGKSSLLGMIARNAEEADINVIALIGERGREVREFIENDLGEEGMKRSVIVVSTSDQSSQLRLNAAYVGTAIAEYFRDQGKTVVLMMDSVTRFARALREVGLAAGEPPARAGYTPSVFSTLPKLLERAGASEKGTITAFYTVLVAGDDMNEPVADEVKSILDGHIVLSNALAQAYHYPAIDVLASISRLLTAIVPEEQRRIIGRAREVLAKYKANEMLIRIGEYRRGSDREVDFAIDHIDKLNRFLKQDIHEKTNYEEAAQQLRAIFR

SEQ ID NO: 4164 - protein, 127 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 4165 - protein, 147 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 4166 - protein, 887 aa, Gibberella zeae PH-1
MSSSPTTTAAAVTSAHPQGGIIEGLNPIVYNPKDPITLFIVQAFVIIIFCRLLQWPLSKFGQPRVIAEVIGGIVLGPSVMMRIPGFKENIFPTESMPVLSNVATIGLLLFLFLVGLEVDTRMFKSNWRVAVSVGLASMMLPFGLGVAVAWGLYEEYGSEGTMKDMEFGTFALFIGTALAITAFPVLCRILSELQLLSTSVGVTVLAAGIGNDVVGWVLLALSVALVNNANGLTALYVFLTAVAWVLFLVYAVRPVFLWVLRRTDSIQNGPSQGITTLTLLLVLASSWFTAAIGVHAIFGAFLIGLICPHDGGFAIKLTEKIEDLVGSILLPLYFALSGLNTNLGLLDDGTTWGYVVAIIACAFFGKIIAGTLAARLTKCLWRESFTIGALMSCKGLVELIVLNIGLQAGILSPRTFTMFVVMAVVTTVTTSPLTRWLYPLSYRLKVEKWRRGEIDWDGNPLQTEAQSSEHKMEEALDKSQTNRLILHLRLDALPGLFNLVSLLGGSRKQTVPAITPTTNDVNADATPAEEKTQVIPSRPFEVRGVRLMELTDRTSSVMQSAELDEFASRDAVFSAFQTFSRLNGVAVAGQVSIIPTNAYAETIVKFAEEARSDFMIIPWSTYGGIAEESSTAALIETGNINDRFFSRTYIDYVQNAIERSTCTTGIFINRVPHDVLTRKPTLTRTRTGLSVHSAHDGAVVQRPVDQRQIIFVPFIGGKDDRAALLFALQLAHNPHVSIHVVHLHFSEDDHEALNASPDSDPSTGNDLGKNAVDFPSASDMDLLSTAKNNAAGKLEGRVTFLEIPVDSVRNLPDLAVAHARELVGKSRYSVGDLIIAGRSHPLFDNLLVEDFGVERDFQRTIGVLGDRFARAGVDAGLLVIDDKQAKA

SEQ ID NO: 4167 - protein, 220 aa, Bacillus thuringiensis serovar konkukian str. 97-27
MDLKQIAGEYAATFVKDGMKVGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIVDCIFPNHIPTPSDLHKRLKMITGVVETGLFVNMTSKAIIGTKNGIQEL

SEQ ID NO: 4168 - protein, 2186 aa, Yarrowia lipolytica CLIB122
MTPSLPIFPPLNPEDKLMTLELQDGTAVQGYSFGADKPVAGELVFQTGMVGYPESITDPSYQGQILIVTFPLVGNYGVPSREAVDEVVKGLPKHFESNKIHVAGLVVASYTEEYSHFLAESSLGAWLKEQDIPAIYGVDTRRMTKHIREEGSMLGRLCIDNAVPEWVDPNKLNLVAEVSIKEPKLYTPPADRAIHVNGKPVRILAVDVGMKYNQIRCFVNRGVELLVVPYDYDFLNEEYDGLFLSNGPGDPSVLKETAARIAKAVEAKKTPIFGICLGHQLLSRSTGATTLKMKFGNRGHNIPCTNLLSGRCYITSQNHGYAVDAKSLTGGWEELFVNSNDGSNEGIYHKDLPFFSVQFHPESTPGPRDTEFLFDVFIKAVVEHKTSGVLKAIEFPGGTIEENRAAHPRVQVKKVLVLGSGGLSIGQAGEFDYSGSQAIKALKEEGIYTVLINPNIATIQTSKGLADKVYFLPVTPEFVRKVIKYERPDAIYVTFGGQTALNVGIEMKDEFEGLGVKVLGTPIDTVITTEDRELFARSMEEIGEKCAKSATASSKEEALAVVEEIGYPVIVRAAYALGGLGSGFADNEAELIELCNKAFAGSPQILVERSMKGWKEIEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLNIPLNEIRNSVTQVTCACFEPSLDYVVVKIPRWDLKKFTRVSTLLSSAMKSVGEVMSIGRTFEEAIQKAIRSTDYQNLGFNETEALMSIDIDSELQTPSDQRLFAIANALHSGYTVDKIWELTNIDKWFLNKLDGLVKFAKGLTKYNNSNLPVNIMREAKQLGFDDRQIAKYTGSNELAVRLKRVEAGVTPFVKQIDTVAAEFPAFTNYLYMTYNADSHDLTFDDHGTMVLGSGVYRIGSSVEFDWCAVRAVRTLREQGAKTIMVNYNPETVSTDYDEADRLYFEVINMERILDIYELERSSGVVISMGGQTSNNIALQLYRQNVNILGTSPEMIDSAENRYKFSRMLDTIEVDQPAWKELTSIDEAEAFAEKVSYPVLVRPSYVLSGAAMNTVYTRDDLASYLNQAVEVSRDYPVVITKYIENAKEIEMDAVAKDGKLIMHVVSEHVENAGVHSGDATLIVPPQDLDPETVRRIVVATAKIGKALQVTGPFNIQFIAKDNEIKVIECNVRASRSFPFVSKVTGVDLIEMATKAICGFPVSPYPLEELPQDFVAVKVPQFSFSRLSGADPILGVEMASTGEVATFGKNKYEAYLKALLATGFKLPKKNILLSVGSYKEKVELMPSIKRLHELGFKLFATAGTADFIQEHGVPVQYLDVLNEGADEEKSEYSLTQHLANNMIDLYINLPSSNRFRRPANYMSKGYRTRRLAVDYAVPLVTNVKNAKLLTEALARNMTLDVSATDFQSSHNTVTLPGLVNVAGVVPDIAIAGSSDIADFTKVSLRSGFTFSRLLPMGVSESIIDLASLQTAQANAEGHSFTDYNLSVAATAHNANEVGKVTGKVGSLVLPFSKLGDNTTKVAAISEHFGAWPANKPIVTDATTTDLASILLLASLHNRPIHVTGVVDKNDIVLVAMAKERGLAVTCDVSVFALFFAREDYPEAHSLPTQEDQDALWANLATIDCFSVGILPSQMAKELGQPVVAGLGVAETLPLLLSAVADKRLTVEDIEARLYTNPVRIFELVEQPDTSIVVNLGRKYTFKSKGLWSPMAGKPATGSVERVIVGGQTVVLEGDLNGASTGKAISIHPQAAPVEAAPATQEMVHSPTTPRMARFSFSSDVRPFANNHVESSVVGAIPPEVSAPSILNKLRRNPFLGQHILSVNQFSKENLHDIFALANELRQAVKRVGVLDILKGRLLTTLFYEPSTRTATSFDAAMQRLGGRVIAVNVDASSYKKGETLQDTLRSVACYSDAIALRHPDPESANIAGRFSPVPVINGGNGSVEHPTQALLDMYTIREEVGTLNGTTITFMGDLRYGRTVHSLVRLLTHYKVNIRLVCPPELTLPDELKTLLKSQGKLDLESATLTPEIVSTTDVLYCTRVQKERFTNEKEFEAIKESYLVDNKVLKDAKPHMCVMHPLPRNAEINPEVDFDARAAYFRQMRHGLFVRMALLAMVMGPVQ

SEQ ID NO: 4169 - protein, 175 aa, Blastopirellula marina DSM 3645
MTKRLQLEFHDHLIAATAWIAPTATVLGDVTLGHESIVLFSAVVRGDTEQIRIGAACNVQDGAVLHADPGSPCLLGDRVSVGHRAIVHGAVVEDDVLIGMGAIVLNGAKIGAGSLVAAGALITENCVIPPRSVVMGVPGKVVRHTTDEDLARIHHASEHYRLASQEYLEAYEGIG

SEQ ID NO: 4170 - protein, 428 aa, Neisseria gonorrhoeae FA 1090
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 4171 - protein, 494 aa, Bacillus cereus G9241
MLTKNIELKPKVKAFLNEEIKMFINGEFVPSISGKTFETYNPATEDVLAVVCEAQEEDIDVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPDGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATIAAGGERAFEKGYFVQPTVFIDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 4172 - protein, 482 aa, Bradyrhizobium japonicum USDA 110
MTAILKNFIGGEWVDGSGVTRNINPSNTNDLVGEYAKADKAQTEKAIAAAKAAFPGWAQSTPQVRYDALNKISLEILARKEELGRLLAREEGKTLPEGIGEVARAGQIFAFFAGEALRLIGEKGASVRPGLDVELTREPMGVVGMITPWNFPIAIPAWKIAPALCYGNTVVFKPAELVPGSAHALSEIITRSGIPAGVFNLVVGSGSVVGQTLLDHPDVAAISFTGSVQTGRKIAQACVLSNPMKKFQLEMGGKNPLVVLDDADLKTAVEVAVNGSYFSTGQRCTASSRLIVTEGIHDRFVAAMAERLKGLSVDDALKAGVHIGPVVDQSQLDQDLRYIKIGQDEGAKLAFGGELLQRETPGHYLQPALFTEANNNMRIAREEIFGPVAAVIRAKNYEEALAISNDTEFGLASGICTTSLKYASHYKRNSESGMVMVNLPTAGVDYHVPFGGRKGSSYGAREQGSYAREFYTTVKTAYTYPG

SEQ ID NO: 4173 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKTFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4174 - protein, 491 aa, Magnaporthe grisea 70-15
MATPGDTREEASAALSPRSFALRHMRPKSSFLGCAKIADYEVLGKLGEGTFGEVHKARSKKTGAIVALKKIIMHNEKDGFPITALREIKLLKLLSHPNVLTLEDMAVEHPQNRSDKRKRPIMHMVFPYMDHDLSGLLDNPSVKFTEAHIKCYLIQLLEGLKYLHHNKILHRDMKAANLLINNKGILQIADFGLARHYDGPVPQPGRGGGEGARNYTSLVVTRWYRPPELLLHLKAYTTAIDMWGVGHGQMAVSLLKELMKLDWKSRINAIDALQHPYFRTAPMPSKPEDIPTFEDSHELDRRRYHDRPPKALPPAPKGGAVGRGPMDGPGPNHGYQSGDYGSRNGANGGRYPPPHRGAPNGEPDRRQPAWSKDRNLGLPPRPPPPAGSHNGMDNSSRDVPPPRSRGNDRAGGGGRADVDTYIPSYSGGGRRDDRMPPRDERRRREDRDDRRYDRDRGYDDRARSSRTRSRSPIRDRDRDRERDRDRDLYRR

SEQ ID NO: 4175 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4176 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTSCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4177 - protein, 539 aa, Clostridium perfringens str. 13
MKKGIAASKGYAIGTVFIQEHEEIIISDAKVSDIAAEKEKLSKALAQSKEQLEAIKEKTANEIGEHEAQVFEAHLMLLDDVEFTGQMEMTIENDQLNAMKAVQNVTDTFVMIFDSMDDPYMRERAADIKDVSKRIIANLAGKGGNGMENVGANTVVVAHDLTPSDTAQLDRSKVIGFLTNIGGRTSHSAIMARTLEIPAVVGLGDITTSVKNGDTVIVDGIEGVAIINPDEATINEYKARLEKFKAEQEELKKLIDVKTTTKSGRRIEVCGNIGKPEDIDQVLANGGDGVGLFRTEFLYMDRDEAPTEDEQFEAYKYVLEKADGKQVVIRTLDIGGDKTLPYLPLPEEMNPFLGYRAIRLCLDRKDIFRVQIRALLRASVYGNLAVMFPMISGLEEFQQAKAFVEECKAELKAEGIAYSDSIQWGIMVEIPAAAVYADELAKHVDFFSIGTNDLIQYTLAADRMSEKVSYLYNPMHPAVLRLIKMTIDGAHKHGKWVGMCGEMAGDERAIPTLVEYGLDEFSMSATSILTAKKIIMEQE

SEQ ID NO: 4178 - protein, 247 aa, Photorhabdus luminescens subsp. laumondii TTO1
MNISTPWVFISGGSRGIGKGIVKMLAAQNYHVVFTYKSSINEAQILCHDIEQQGYRCEGYQCDVSNAKEVTTLSAELISQYGAPYAIINNAGITQDALLINMKEEEWHNVISTNLSSIYLVNHSFLPEMITAGEGCIIHMSSVTAFKANSGQVNYAATKAAMIGITRSLAVEVGRFNVRVNTVAPGLIDTEMLAHIPAPHRKKLLSNIPLGRLGSVEDIALTVNFLLSPGGRYITGQTFVIDGGMTA

SEQ ID NO: 4179 - protein, 405 aa, Moritella sp. PE36
MQDTLTVILAGGMGARLAPLTDNRAKPAVPFGGKYRIIDFTLTNCLHSGLRRILVLTQYKSHSLQKHLRDGWSIFNPELGEYITVVPPQMRKGDKWYSGTADAIYQNLWLLSRSDAKYVVVLSGDHIYRMDYAPMLERHKETGADLSIACMEVPVAEATNFGVMAIDENQRIVEFTEKPAQPSTLPNDPEKSLASMGIYIFSTDALVDALEQDADNPDSNHDFGQDIIPKLIDKEKAYAHQFGGSTGRVTEDDYWRDVGTIDSLYQANMDLLQPVSPIDLYQRDWGIRTYEPQLPPARTTSSDTGNEGIFINSLISNGVLIAGGSVQNSVLSSNVKINDGATVSASILFDDVEVGEYSQLLNCIIDKHVKIPPRTKIGVNRAEDAARFTISDRGIVVVPESYKFE

SEQ ID NO: 4180 - protein, 138 aa, Propionibacterium acnes
MSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 4181 - protein, 519 aa, Photorhabdus luminescens subsp. laumondii TTO1
MAACLPLTSSPNGAEYLKAALSAPVYEVAQVTPLQEMEKISARLGNTILVKREDRQPVHSFKLRGAYAMIASLTEEQKNRGVITASAGNHAQGVALSANRLGINSLIVMPVTTADIKVDAVRSFGGKALLYGANFDEAKAKAIEMAQQEGYTFVPPFDHPAVIAGQATLAMELLQQDVRLDRIFVPVGGGGLIAGVAVLIKQLMPEIKIIGVEAEDSACLKAAMEAGHPVDLPRVGLFAEGVAVKRIGDETFRLCQQYVDDVITVDSDAICAAVKDLFEDVRAIAEPSGALALAGLKKYVQQHQLRGERLAHILSGANVSFHGLRYVSERCELGEQREALLAVTIPEQKGSFLSFCQKLGDRVVTEFNYRYTDADPDQACLFVGVRLSRGEVERREIIEELRTAGYQVADLSDDEMAKLHVRYMIGGRPSKPLKERLFSFEFPESPGALLKFLQTLGTHWNITLFHYRNYGTDYGRVLAAFELSGAEVRFKRHLDALGYAYHDETDTPAFKFFLMCQNI

SEQ ID NO: 4182 - protein, 194 aa, Triticum aestivum
  misc_feature (174)..(174): Xaa can be any naturally occurring amino acid
MAISLGPYWALSTVSLLSIVGLYMLFTGSGEEFNVGKLLQETSPYAWALTGMGLCIGLSVTGAAWGIFITGSALLGGAVKTPRIQSRNLISIIFCEVVAIYGVIMAIVYSAKLSDVPADQLYTNSNFFTGHAIFWGGLTVGICNLLCGLSVGVTGSSAALADAQNPELFVKVLXVEIVGSVLGLFGLIVGLLTT

SEQ ID NO: 4183 - protein, 526 aa, Dechloromonas aromatica RCB
MNPIDSPAWRALAAHAEAIRPLHLRDLFATDPQRFELFSLHHDGLLLDYSKQRVSVETMALLRAYAETADVTGWRRRMLDGESINHTEGRAVRHMSLRAGDQAPAEVRAALARQQAFCESIHNGVWRGFSGERITDVVNIGIGGSDLGPRMAALALSARQQPDIAVHFIANVDSADIAPLLASLNPRTTLFIVASKTFTTLETLTNARTARDWLLATAGQESAIARHFVAISTNLELTKQFGIADDNVFEFWDWVGGRFSIWSAIGLSLALAIGWKNFEQLQAGARAMDRHFIDTPADENLPLTLALLSLWNTNFLGASTEAMLPYSQSLHLFPAYLQQLEMESNGKQIDRDGKPLNIATSPVIWGESGTNGQHSFYQLFHQGGHLIPADFVALREADFPLPGHHASLLANCLAQSAALAFGQTAEEVRAAGIPEALIPYKVFPGNQPSNTLLLPSLDPYTLGQLLALFEHKVFCLGVLWNLNAFDQWGVELGKQLAGQLTPLIEGNGDLSAFDSSTRGLITALKG

SEQ ID NO: 4184 - protein, 440 aa, Dechloromonas aromatica RCB
MPMSTSCPHQPYCEMREQTDMRFISHLTRNTFAIILAGGRGTRLKQLTDFRSKPAVPFAGKFRILDFTLSNCVNSGIRKIGVATQYKAHSLIRHIQRGWSFLDGRFDEFIQLLPAQQQIDETQWYQGTADAVYQNLHFLRRYQPDHILVVAGDHIYKMDYGRMLAHHVKHHADMTVACIDVPLDEAREFGVMGVDEQDRVIDFVEKPQNPPAIPGQPDRALASMGIYIFNTKFLFEQLERDAMTKGSNRDFGKDIIPYIVPRYRVFAHRFADSCVGSDNHRPYWRDVGTIDAYWEANMEMTKVTPELNVYDRDWPIWTYQEQIPPAKFVFDDEDRRGTAVDSLIAGGCIISGASVKRSLLFSSVNVHSWASVEDSVVLPDVDIGRHAVLKRCVIDKHCRIPEGMVIGVDPEEDRKRFHVSPKGITLVTAEMLGQGAAEGR

SEQ ID NO: 4185 - protein, 295 aa, Mycobacterium bovis AF2122/97
MLFGMARIAIIGGGSIGEALLSGLLRAGRQVKDLVVAERMPDRANYLAQTYSVLVTSAADAVENATFVVVAVKPADVEPVIADLANATAAAENDSAEQVFVTVVAGITIAYFESKLPAGTPVVRAMPNAAALVGAGVTALAKGRFVTPQQLEEVSALFDAVGGVLTVPESQLDAVTAVSGSGPAYFFLLVEALVDAGVGVGLSRQVATDLAAQTMAGSAAMLLERMDQDQGGANGELMGLRVDLTASRLRAAVTSPGGTTAAALRELERGGFRMAVDAAVQAAKSRSEQLRITPE

SEQ ID NO: 4186 - protein, 141 aa, Medicago truncatula
FKDTIDLFVERYKGKNISVVAGIEARGFIFGPPIALAIGAKFVPLRKPKKLPGKVISQEYILEYGRDCLEMHVGAVETGERAIVVDDLIATGGTLGAAMNLLERVGAEVVECACVIELPELKGRERLNGKPLYVLVEYFDI

SEQ ID NO: 4187 - protein, 360 aa, Burkholderia xenovorans LB400
MSRTIKFAKAGGPEVLEFIETPVAAPGPHEVRIKVEAIGLNRAESMWRNDAYIEPVSFPAGLGYEAAGVVDAVGAEVTGIAPGDKVNVMPSFSMNQYFTYGEVILAPDYAVVKHPESLSFAEAASVWMMFVTAYGALIEDAKVTEGDFVLVPAASSSVGLAAIQIANYAGATSIALTRTSAKRQQLLDAGAAHVIATAETDLVAEVMRITDGKGARVAFDPVGGPTFTKLLAALSFQGIAYIYGALSEEATPLPVLEMIARMLTVKAHNIWLTSGDAARRKAAVDYVLKGLESGALKPVIDRTFTFDDMVEAHRYLETNGQFGKIVVTVQAGLADSNVDTAAVREAGAASSVSSTARVAG

SEQ ID NO: 4188 - protein, 67 aa, Zea mays
MTTSRRLADRKIARFEKNITKRGSVPETVKKANDYPVGPILLGFFVFVVVGSSLFQIIKTASNAGLF

SEQ ID NO: 4189 - protein, 133 aa, Medicago truncatula
MGGSKYERRTSLTAPGIQSYTWRTERFSRVRATVLYSDVFEAGGYKWRAIIHPRGNNTDYLSIYLCTADSASLPDGWSSYVEFTLKVVNQIEYKYSVTKGAIFNLFFTVVTNELPCMYVEIQTKCGNAHNFWA

SEQ ID NO: 4190 - protein, 128 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 4191 - protein, 373 aa, Triticum aestivum
  misc_feature (152)..(152): Xaa can be any naturally occurring amino acid
  misc_feature (198)..(198): Xaa can be any naturally occurring amino acid
  misc_feature (256)..(256): Xaa can be any naturally occurring amino acid
RRPTRPPALPVSPVARRPPAPNLAACRGWRWPSPAKRLCSSPHSGPAEGMGSDGTGARRRLPPANGVSKEGAPLTLPQPVPPRLLTLPTVLTIGGVGGVFFLINTSYMEGPWGATVTTGIFLAAAITDWLDGYIARKMHLGTPLGAFLDPVXADQLLVTATLVLLCTKPLETSLLTNGPRLLTVPSIAIIGREITMSXVTEWTASQNTQLFEAVDLHHLGKCKTATQMTVLTLVLARRDPDSHVPRALVPPGIGLXNASVGIAECSLVGVIKKIWRILLKYCPPIVYKRTKSWANILHLRCSPFAETGGLHSGHYNWCKPVGPKNTWRLNHATRQPGAGSTAATIIAAPWNPGKSLAAGLQPRLWAPLSSRPA

SEQ ID NO: 4192 - protein, 125 aa, Salmonella enterica
MPKPMFGDNGSGMHCHMSLSKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLD

SEQ ID NO: 4193 - protein, 442 aa, Mesorhizobium tianshanense
MRITMIGSGYVGLVSGVCFADFGHDVICVDKDLSKIEALREGRIPIYEPGLEQLVAENTSTGRLSFSTDVGESVRSADVVFIAVGTPSRRGDGHADLSYVYAAAREIATYVEGFTVIVTKSTVPVGTGDEVERIMRETNPAADVAVVSNPEFLREGAAIEDFKRPDRIVVGLNDDRARETMTEVYRPLYLNQAPLVFTTRRTSELIKYAANAFLAMKITFINEIADLCERVDANVQDVSRGIGLDGRIGSKFLHAGPGYGGSCFPKDTLALAKTAQDYDAPMRLIETTISINDNRKRAMGRKVISAVGGDIRGKKIAILGLTFKPNTDDMRDSPAIAVIQTLQDNGAQVVGYDPEGMENARKVIENIEYASGPYEAAAGADALVIVTEWNQFRALDFSRLKQSMRAPILVDLRNIYRSDEVRKHGFTYTGIGTNLYQETTGA

SEQ ID NO: 4194 - protein, 467 aa, Vibrio vulnificus CMCP6
MNSTNLKLLSLFVLGSVLWFLPVPDGLTEQAWQMMVIFVTTVLSLILAPLPLGAMALLGLTAATLLGVLPIKTALNGFAHPTIWMIAAAFFISRGFITTGFGRRVGYWFISKLGHNSLGLAYGLVLTDLLFAPATPSTTARCGGIIAPLFRSVASAYDSDPEKGTQNRIGAFLVQCIFQCNAITCAMFLTSMAGNPLAANFAKEQGVEITWAGWAAAAIVPGLLCLFLIPLAMYLFFPPELKKTPEMRAIAKEKLQQMGAMTRDEIMVCATFIGMVTLWVLGPTLGIHATVTALIGLVFLLLSRTITWDAVLSEKEAWHTITWFAVLIMMASELNKLGFIKWFSNGIGESLSGFGWATTIILLLLVYYYSHYLMASAMAHISAMYSAFLAIAISAGVPPMLAAIVLGIFSNLYMSTTHYSSGPAPILFGAGFHSLQNWWKIGFVFSLIVIPIFIFVGGMWWKVLGLW

SEQ ID NO: 4195 - protein, 487 aa, Escherichia coli CFT073
MLPLRINPTFLLPSNKFKEFEMDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 4196 - protein, 397 aa, Francisella tularensis subsp. tularensis SCHU S4
MASLNKKIQNVSTSPTNAMAALAKQIKDQGNDVISLAIGEPGFSTPDIIKAAGIEAINKDITKYTNVDGLKELREAIVARYKREYGIEFAADQVCVTSGAKHSLHNIFNCILEAGDEAIFFAPYWVSYPDMIALTGAKPVVVETKFENNFEIDVTDLEKHITAKTKAVIINSPNNPTGLIYSKKCIEDLANLLIKYPNIWIIGDDIYDQLYFKDRVTLITEVAPDLADRYVIASGVSKNFAMTGWRVGFTIAPKLLNDALKKFQSQSATCACSISQYAAITAMNMPAQDLQYFVESYKQKAQFVTKYLEAMPYVDVKSAEGTFYLFPDLRKLLEHTNFSTDVELCNALLREEYVAMMPGVAFGLSGFARISCANEMPELEEAMTRVARFINKHVSTK

SEQ ID NO: 4197 - protein, 396 aa, Bacillus thuringiensis serovar konkukian str. 97-27
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTARRWAYDVKKVEANRAEIIVCEDNFHGRTMGAVSMSSNEEYKRGFGPMLPGIIVIPYGDLEALKAAITPNTAAFILEPIQGEAGINIPPAGFLKEALEVCKKENVLFVADEIQTGLGRTGKVFACDWDNVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 4198 - protein, 538 aa, Populus tremula
MEEMYPAVAVLFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4199 - protein, 215 aa, Candida glabrata CBS 138
MDQENDRSISRLWRTFRTVKEMVRDRGYFIAQEELDLTLEDFKVKYCDSMGRAQRKMMSFQANPTEESMTKFPDMGTLWVEFCDEPSVGVKTMKTFVIHIQEKQFQTGIFIYQNNITPSAMKLVPSIPPATIETFHEAALVVNITHHDLVPKHIRLNEEEKAELLKRYRLKESQLPRIQRADPVALYLGLKRGEVVKIIRKSETAGRYASYRICM

SEQ ID NO: 4200 - protein, 538 aa, Populus tremula
MEEMYPAVAVPFRVGNSACESPSIDTQMDITRILMADTASLLSDTVTKVPTAGDKDCNCAAPASKEDRGGRGAALLDMISETERNWVVGDDGITRESEEEDSLSLEGDPILDSSCSLSVASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTSCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4201 - protein, 352 aa, Candida glabrata CBS 138
MATLHAVPETQKGVIFYENNGKLEYKDIPVPKPKANEILINVKYSGVCHTDLHAWHGDWPLATKLPLVGGHEGAGVVVGMGENVKGWKIGDYAGIKWLNGSCMACEYCEKSNESNCPEADLSGYTHDGSFQQYATADYVQAARIPQGTDLAQVAPILCAGITVYKALKSANLNAGEWVAISGAAGGLGSLAVQYAKAMGYRILGIDGGDEKKALFHELGGEIFVDFTKSKNVEQDILVATNGGAHGVINVSVSEAAIESSTRYVRSNGTVVLVGLPANAKCSSDVFNHVVKSISIVGSYVGNRADTREALDFFSRGLVKSPIKIAGLSELPEIYEKMEKGQIVGRYVVDTSK

SEQ ID NO: 4202 - protein, 425 aa, Escherichia coli CFT073
MIDRLPGVSTLTLQPKTPFLQALDACFRVAYSLDNLPYHQRCPVFKSDAARTRQRLSARKGRTLPPGRGKFPHSTMESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWRGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGIAEDAAKRGHLTASTVIQYRGAIIPREAMPA

SEQ ID NO: 4203 - protein, 431 aa, Brucella suis 1330
MAHFAIKLPDVGEGVAEAELVEWHVKVGDIVREDDLLAAVMTDKATVEIPSSRAGKVIAINGEVGEKIAVGSELVRLEIEGGATEKAEEPQPQAAEPTAPAAAVPEAPVLLQTPVPEKPAAPKRENAGRPFTGAGPLRPEGEKPLATPSVRLRARDAGIDLRRVRGTGPAGRITHEDLDAFFQMESGAAPALSGYAADTSINEIKVIGLRRKIAERMAEAKRHIPHITIVEEVDVTQLEELRNGLNHEKKEGRPRLTLLPFIIRTIVKAVKEQPGLNAHFDDEADIIRQFGGVHVGIATQTPNGLIVPVVRHAESMSVFAAATELSRVTEAARNGTAKREELTGSTITITSLGPLGAIATTPIINRPEVAIVGINKMAVRPMWDGTQFVPRKMMNLSCSFDHRVIDGWDAAVFVQKLKSLLETPAMIFVEG

SEQ ID NO: 4204 - protein, 463 aa, Pseudomonas putida KT2440
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 4205 - protein, 248 aa, Burkholderia xenovorans LB400
MSHPVILITGALTGIGRATAIAFAEIGARLVVSGRREAEGKAFEKELRELGADAHFIQADVRRDEEVASLVDQTVARFGRIDAAVNNAGTEGQPGAITSQTVESYSATFDTNVLGTLLSMKHELRVMSAQKSGSVVNVSSTYGHEGAAFASVYAGSKHAVEGMTRSAALEVASTGVRVNAVAPGPTDTGMLDRFTGTPENKAALAAQVPLGRIGKPDDVARAIVFLASDAASFVTGQIVTVDGGKTAG

SEQ ID NO: 4206 - protein, 223 aa, Arabidopsis thaliana
MTKQHANWSPYDNNGGTCVAIAGSDYCVIAADTRMSTGYSILSRDYSKIHKLADRAVLSSSGFQADVKALQKVLKSRHLIYQHQHNKQMSCPAMAQLLSNTLYFKRFFPYYAFNVLGGLDEEGKGCVFTYDAVGSYERVGYGAQGSGSTLIMPFLDNQLKSPSPLLLPKQDSNTPLSEAEAVDLVKTVFASATERDIYTGDKLEIMILKADGIKTELMDLRKD

SEQ ID NO: 4207 - protein, 270 aa, Shewanella sp. MR-7
MKPEELIDEVIAIATDAGRTIREIYLKGNFERETKSDNTPVTSADLAANKLICERLAALTPDIPILSEEAADIPLSVREGWKRYWLVDPLDGTGEFIAGSGDFSVIIALVEHNRPVMGVVYVPMTQVCYYAIAGLGAYKRTDKQEVRISSRQIEHREQVSLRLAVSRRQDPQSVLTLFNQPKHCELVVMGGAALKSCLVAEGRADCYVRVGPTGEWDTGAAQIIIEEAGGQLMDTELQPLTYNERETLENPNFIVVGAPNLEWDKILIGE

SEQ ID NO: 4208 - protein, 464 aa, Brucella suis 1330
MSEISCKLLIIGGGPGGYVCGIRAGQLGIDTVLVEKTRLGGTCLNVGCIPSKALIHAADEFHRLTTFAAKSPLGITTQNPAIDFARTLEWKDGIVHRLNSGVAGLLKRSRVRMFQGQARFQDGKTVLVDTDTGRQTIHAENIVIATGSVPVEIQALPFGGNIISSTEALSLEKIPERLAVVGGGYIGLEIGTAFAKLGSRVTVVEATDRILPQYDAELTRPVMARLKTLGVEVLTGTSAKGLSADGKALEIRTQDGAVKAIEADKILVTVGRKPQTDGWGLSEIRLDMDGRFIRIDDRCRTSMRGIYAIGDVTGEPMLTHRAMAQGEMVAEIIAGGKHAWDKRCIPAVCFTDPEIVTVGLSPDEARKAGHNIQTGLFPFQANGRAMTMERDDGIVRVVARADNHVILGIQAVGAGISELSAAFAQAVEMGARLEDIAATIHAHPTLGEGFAEASMKALGHALHV

SEQ ID NO: 4209 - protein, 159 aa, Triticum aestivum
NKFVQKSRLVPVRNSRDIVDPRVRVRAKSVEQGWNLNLAELSRIWKGGCIIRARFLDRIKKAYDRNPELANLIVDREFAREMVQRQGAWRWVVARAVEAGISTPGMSASLSYFDTYRCNRLPANLIQAQRDLFGAHTYERIDRPGSFHTEWTKLAREGK

SEQ ID NO: 4210 - protein, 436 aa, Brucella suis 1330
MNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQRALN

SEQ ID NO: 4211 - protein, 400 aa, Chlamydia muridarum Nigg
MYNVKEDFPIFRNQKDPYIYLDSAATTHKPQCVIDAVTDYYSFSYATVNRAIYSASHDISSAYWRVRSKVAAWIGARYDQEIVFTRGTTSSLNLLAIAANDSWLAGGTVVVSEAEHHANILSWEIACRRSGATVKKVRVNDEGIIDLSHLEKLLKQGVQLVSLAHVSNVSGAVLPVQEVAFLVHRYGALLAIDGAQGVGSGPLNLSGWDVDFYAFSGHKLYAPTGIGVLYGKRELLESLPPVEGGGDMVVVYDSESSRYQEPPLRFEAGTPHIAGVLGLGAAIDYLQALPFSVSDHLTALTRFLYNRLLTIPDIQIVGPQQGTPRGCLCSIIIPGVQASDLGFLLDGKGIAVRSGHQCSQPAMARWDLGHVLRASLGVYNDQQDVISFVEALEDILRSYR

SEQ ID NO: 4212 - protein, 386 aa, Escherichia coli CFT073
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSAINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHSLIMTRLESRPIHGNPWEEMFYLDIQANLESAEMQKALKELGEITRSMKVLGCYPSENVVPVDPT

SEQ ID NO: 4213 - protein, 124 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 4214 - protein, 223 aa, Xanthomonas campestris pv. campestris str. ATCC 33913
MQPTAIAPSILSADFARLGEEVDNVLKAGADWVHFDVMDNHYVPNLTIGPMVCQALRKHGITAPIDVHLMVEPVDRLVPDFADAGATTISFHPEASRHVHRTIQLIRSHGCQAGLVLNPATPVDILDWVLPELDLVLVMSVNPGFGGQAFIPSALDKLRAIRSKIDALGKPIRLEIDGGVKADNIGAIAAAGADTFVAGSAIFNAPDYSQIIAQMRAAVDAAR

SEQ ID NO: 4215 - protein, 152 aa, Vigna unguiculata
MGIYDVDTRAITRRLREDGSLIGVLSTDNSKTDEQLLQMSKSWDIVGVDLISGVSCKSPHEWVDKTKQQWEFSSGKVAGENFHVVAYDFGIKHNILRRLASYGCKITVVPSTWPASETLNMKPDGVLFSNGPGDPSAVPYAVETVKNIIGKV

SEQ ID NO: 4216 - protein, 154 aa, Vigna unguiculata
MGIYDVDTRAITRRLREDGSLIGVLSTDNSKTDEQLLQMSKSWDIVGVDLISGVSCKSPHEWVDKTKQQWEFSSGKVAGENFHVVAYDFGIKHNILRRLASYGCKITVVPSTWPASETLNMKPDGVLFSNGPGDPSAVPYAVETVKNIIGKVPA

SEQ ID NO: 4217 - protein, 611 aa, Pantoea agglomerans
IYHLRALGVDVRLTRSDVTKGHPEYYQDYARRLAEETPGAYYIDQFSNPANPLAHATTTAPELFDQLAGRVDAVVVGVGSGGTLGGLQAWFAKHSPHTEFVLADPVGSILADQVETGQHGEAGSWRVEGIGEDFIPPLAQLENVRQAYRVTDAEAFATARQLLQTEGVLAGSSTGTLLAAALRYCQAQTTPKRVVTFACDSGNKYLSRMFNDEWLRQQGLQDDDRPAPAAPASALATLSVHSGAFNDQHGAVMPPIYATSTFAQPAPGQHTGYEYSRSGNPTRHALESAIAELEGGTRGYAFASGLAAISTVLELLDKDSHIVAIDDVYGGTYRLIENVRRRSTGLQVSWVKPDDLAGLEAAIRPDTRMIWVETPTNPLLKLADLAAIAEIARRHNVISVADNTFASPLIHRPLTLGFDIVVHSATKYLNGHSDVVAGLAVVGDRPALAEKLGYLQNAVGGVLDPFSSFLTLRGIRTLALRIERHSSNALALARWLEQQPQVEKVWFPWLTSHPQYALARQQMAQPGGMISIVIKGDDQRAAEVISKLKLFTLAESLGGVESLVSQPFSMTHASIPLAQRLANGITPQLIRLSVGIEDEKDLLADLQQALA

SEQ ID NO: 4218 - protein, 404 aa, Neisseria gonorrhoeae FA 1090
MTVKTPVYLDYAATTPVDKRVAEKMIPYLTETFGNPASNSHAFGWTAEEAVEKARADIAALINADPKEIVFTSGATESDNLAIKGAANFYKTKGKHLITVKTEHKAVLDTMRELERQGFEVTYLGVQENGLIDLEELKAAIRDDTILISIMWVNNEIGVVQNIPAIGEICRERKIAFHVDAAQACGKVPVDVEAAKIDLLSMSAHKVYGPKGIGALYVRRKPRVRLEAQMHGGGHERGFRSGTLPTHQIVGMGEAFRIAKEELAQDTAHYLKLRDIFLKGIEGIEEVYINGDLEHRAPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 4219 - protein, 155 aa, Vigna unguiculata
MGIYDVDTRAITRRLREDGSLIGVLSTDNSKTDEQLLQMSKSWDIVGVDLISGVSCKSPHEWVDKTKQQWEFSSGKVAGENFHVVAYDFGIKHNILRRLASYGCKITVVPSTWPASETLNMKPDGVLFSNGPGDPSAVPYAVETVKNIIGKVPAR

SEQ ID NO: 4220 - protein, 344 aa, Bacillus thuringiensis serovar konkukian str. 97-27
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLAKKGLEVEVIDPRSLSPFDEDTILSSVEKTNRLIVIDEANPRCSIATDIAAIVADKGFDLLDAPIKRITAPHTPVPFSPPLEKLYLPTPEKVIETVSEMIGDQSLLHV

SEQ ID NO: 4221 - protein, 459 aa, Bacillus thuringiensis serovar konkukian str. 97-27
MRILVVIGGGPAGYVAAITAAQNGKEVILIDEANLGGTCLNVGCMPTKSLLESAEVHDIVRKANHYGITLNNGSISIDWKQLQARKSQIVTQLVQGIQYLMKKNKIKVIQGKAKFETDHRVRVTNGNKEDVVDGDQFIIAAGSEPAELPFAPFDGKWILNSSHAMSLENIPKSLLIVGGGVIGCEFASIYSRLGTKVTIVEMAPQLLPGEDKDIAQILKEKLESDGVEIFTGAALKGLNNYKKQASFEYKGSIQEANPEYVLVSVGRKPRAQGLDLEKAGVQFSNKGISVNEHMQTNRSHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAIGHAVHA

SEQ ID NO: 4222 - protein, 601 aa, Francisella tularensis subsp. tularensis SCHU S4
MRRFLLSYTYSVFKNTLRLLVKKLFVNLMSLLILLPSLTLIAAPVPTGYGFIPIQEEMQIAQPVTATHGMVSSQEALASKVGLDILKQGGNAVDAAVAVGFALAVTLPRAGNLAGGGFMIIHLQDGNKNIAINYREKAPAKASRDMFLNDKGDIDYAKVSGSYSASGVPGTVAGLIDAQQKYGKLKLSQVIKPAIKLAEDGIPVSYDLHQSLVTAKPWLQKSPDAMKIFYKKDGSAYEVGEILKQPELANSLKLIAKQGKKAFYEGEIAHKIADSMAKNGGLITLQDLKNYNIEEMKTVKGTYRGYTIYSMLPPSSGGVILIELLNILENFPLSDYGNNSAKTINLMSNAMSYAYNDRNSDLGDPDFVKMDLAKFLSKKYAKQIAQKITTDKHIPSKDISTIDPDDHEKLQTTHFSIIDKDGNMVSNTYTLNYSYGSGIVVPGTGIFLNNEMDDFAAKVGEANVFGLVQGEANTVAPNKRPLSSMTPTIVLDKDGKPFLATGSPGGSRIITTTLQVILNIIDFNMNLQAAVNNPRIHSQLWPEEIGVEQGISVDTINLLKKMGNTVTPYAAMGAAESVMSDGQYVYGAADPRRASALAIGY

SEQ ID NO: 4223 - protein, 543 aa, Candida tropicalis
MSSSPSIAQEFLATITPYVEYCQENYTKWYYFIPLVILSLNLISMLHTKYLERKFKAKPLAVYVQDYTFCLITPLVLIYYKSKGTVMQFACDLWDKNLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 4224 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTSCFLKVDAEVGGKAGAEPVAPETVGSTAVVAIICSSHIIVANCGDSRAVLCRGKEPMALSVDHKPNREDEYAWIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4225 - protein, 519 aa, Candida apicola
MIIGLSDAFALGGIALSFLVAYQFIYFYFIYSPRAKKLGCAPPVIVFSFPLGLPALYKFATAMLHDNLLEYISIRIADMKVRTGFQTLAGQRWLVTLEPENIKTVLATSFKDYSLGFRYDIMYGLLGNGIFTLSGDGWKHSRALLRPQFSREQVSHLESMRTHINLMINNHFKGGQVVDAQALYHNLTIDTATEFLFGESTNTLDPDLAQQGLPGPKGLVTGEQFAEAFTSALEILSVRVIVGAAWFLIWTPKFWRSCKVCHNFIDYFVYKALATPMEKDQEADRYVFIRELTKETSDPRVIRDQALNILLAGRDTTAGLLSFITYYLGAYPEVYAELREAVLSEFGSTDVETPTFEQLKQCKVLQNVIREVLRLHPNVPLNFRQAIVDTKLPTGGGPNGDQPVFVPKGQNVFYSTYSMQRRTDIWGPDATTFRPDRWNEPREALASGWDYIPFNGGPRICLGQQFALTEASYTIVRICQEFSRIEVLHPDVITSKNSMKQRMRLTQTASGGVITRFIR

SEQ ID NO: 4226 - protein, 385 aa, Arabidopsis thaliana
  misc_feature (373)..(373): Xaa can be any naturally occurring amino acid
  misc_feature (379)..(379): Xaa can be any naturally occurring amino acid
MEESRESPAEHGYYMPAEWDSHAQTWIGWPERQDNWRHNALPAQRVFADVAKAISKFEPVTVCASPAQWENARKQLPEDIRVVEMSMNDSWFRDSGPTFIVRKRPVKLSSLNRNIAGIDWNFNAWGGANDGCYNDWSHDLLVSRKILALERIPRFQHSMILEGGSIHVDGEGTCLVTEECLLNKNRNPHMSKEQIEEELKKYLGVQSFIWLPRGLYGDEDTNGHIDNMCCFARPGVVLLSWTDDETDPQYERSVEALSVLSNSIDARGRKIQVIKLYIPEPLYMTEEESSGITQDGEAIPRLAGTRLAASYVNFYIANGGIIAPQFGDPIRDKEAIRVLSDTFPHHSVVGIENAREIVLAGGNIHCITQQQPXAEPTSXVAENGH

SEQ ID NO: 4227 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTSCFLKVDAEVGGKAGAEPVAPETVGSTAVVAIICSSHIIVANCGDSRAVLCRGKEPMALSVDHKPNREDEYAWIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4228 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 4229 - protein, 136 aa, Corynebacterium diphtheriae
MTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 4230 - protein, 592 aa, Vitis vinifera
MAFECQESIEVCLVKNSIDSDEQQGGLSDFNSNFNHITSIFDAKSQLETETAHRESGVVCLLKNSIEERAGLTQFSPDSDHNTLIRDSGNSQSEIEIGIQKPSTSNPKVNDTSGHYRRLITDLPSALISEILNCLDPKELGVVSCVSTVLNRLASEHSVWKDFYCERWGAPVVSGFSDEKSWRELFVEREFRSKTFRGRFSIDVLYGHTEAVRAVFLLASAKLIFTSGYDSIVRMWDMEEGLSIACSRPLGCTIRAVAADKKLLLAGGSDGFIHCWRAVEGLSCLFDLVGSQNLSTEFRIWEHEGPVTCLALDIKRIYSGSWDMTVRIWDRSSFKVVKVLRHTDWVWGLVPRDTTVASTSGSDVYVWDADSGTLLTIISNAHVGNAYALARSHTGDFLFTGGEDGAIHMFEVVSDCMERNVLEVSTWIPHSGPVHSLAFEFPWLVSASADGRMSLIDVRKLLQTCKPSLGKNVSKVRHRDHKSVEPPQRMLHGFGCNLFSVDIGADRIVCGGEEGVVRIWNFSQALEAEQRARALRGIRLENRMRRRRLQIELTSKGSRTDQCSVAASKNPINGDRSGVWHNKRGMSGRMKA

SEQ ID NO: 4231 - protein, 234 aa, Zea mays
  misc_feature (200)..(200): Xaa can be any naturally occurring amino acid
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWNCLAPWFSHPTRTAIRQRYNLEGSFEAFTRQCGCCGDLVEDEERREHLEAACDLATHYLCHPCALCQEXGRELRRRVPHPGFNNGHSVFVMMPPMEQTMGRGM

SEQ ID NO: 4232 - protein, 456 aa, Moritella sp. PE36
MLNPREVKTVADAKHIIEQRGLSHVKVGLFDADGIMRGKYMSKEKFFSSLDSGFAFCDVVLGWDSKDQLYDNVEFTGWHTGYPDAPVRILPETCRNLPAEGDMLLFIAEFSDHAEAVCPRGTLRRVLERADRMGFDVTAAFEYEFFMFKETPESVREKGYKNLTPLTPGFFGYSMLRNSVHADLHHQIMALGEEMDFPIEGLHTETGPGVLEAAIAHDGAKEAADKAALFKTFIKVWAQRNGLMATFMAKWSSDWPGQSGHIHISLKDKNGKAVFHDPNNAYNMSDTQRHFLAGQQKYMPEFLAMIAPTVNSYSRMVPGLWAPLDATWGVENRTTALRVIPGSEKSQRIEYRLGSADANPYLALAAALASGLMGIEQKLEPYAQVKGNAYDQDHPEALSLPRTLFDAARKLKRSEVAKELFGHEFVQHYAATREWEEREFRKHVSDWELERYFEII

SEQ ID NO: 4233 - protein, 443 aa, Pseudomonas putida KT2440
MNFAKLGLIEPLLRTLQQLDYTTPTPVQAKAIPAVLAGRDLMAAAQTGTGKTAGFALPVLQRLALEGEKVASNSIRALVLVPTRELAEQVHNNVREYAENLPLTTYAVYGGVSINPQMMRLRRGVDLLVATPGRLLDLFRQNAVKFNQVQTLVLDEADRMLDLGFAEELQSVYAALPRKRQTLLFSATFSDQIRMLAGLALNDPLSIEVSPRNATAASVKQWLVPVDKKRKADLFCHLLRKQRWKQVLVFAKTRNGVDQLVERLLAEGVNADGIHGDRPQATRQRALDSFKAREVQVLVATDVAARGLDIDDLPLVVNLDLPIVAEDYVHRIGRTGRAGNKGEAISLVCADEVQLLAAIEVLTRQTLPRHEEPDFIPEHRVPMTDASGQVIKKPKKPKKPKENSAKRGLGRWMDSTEAASAEPAVKAVRKVPSFNGGPRKRKP

SEQ ID NO: 4234 - protein, 478 aa, Moritella sp. PE36
MSNNNESGVVTYNEVSADYLDNRQLKKGVAGWVLLASLGVSYVISGDFAGWNFGLAQGGFGGMLIATVLMGIMYTFMVFGLAELSSSLPTAGGGYSFARRAMGPWGGFLTGTAILLEYSIAPAAIAVFIGAYVNSIFGIDGPLVYAGCYIAFIGIHLLGAGEALKIMMCITGVAVIALLVFALGLIPHFDVNNLLDIAVNTEAAGATPFLPEGYIGIWSAIPFAIWLFLAVEGVPLAAEETTNPGRDMPRGIITAMVILLIFAFGVLFLAPGVAGSEMMKDHGAPLVGALQVVYGENSSIATFVNIVGLFGLIASFFSIIYAYSRQVFALSRAGYLPRFLSITGERKVPTMALIIPGIIGFLLSLTGEGDLMITMAVFGATISYALMMLSHIILRFKEPNLERPYRTPGGIFTTGIAFILSIVAFASTFLVSLEAAMWAGIFYAILVAYFAFYSRHHLVGKVPDEEFAAIAQAESELS

SEQ ID NO: 4235 - protein, 403 aa, Chlamydia muridarum Nigg
MDKLSIKDLSPEGKKVLVRVDFNVPIKDGKILDDVRIRSAMPTINYLLKRDAAIILVSHLGRPKGDMFEEAYSLAPIVPVLEGYLGHHVPLSPDCVGEVARQAVAQLSPGRVLLLENVRFHRGEEHPEEDPSFAVELAAYADFYVNDAFGTSHRKHASVYRVPQMFPDRAAAGFLMEKELEFLGQHLLVEPKRPFTAILGGAKVSSKIGVIEALLSRVDNLVLAGGMGYTFLKAMNQQVGNSLVEETGIPLAKRVLEKARTQGVKIYLPVDAKVARRCETGEDWQELSIQEGIPEGFSGFDIGSKTIALFSEVIQDSATVFWNGPVGVYEVPPFDQGSKAIAQCLASHSSAVTVVGGGDAAAVVALAGCTSQISHVSTGGGASLEFLEKGYLPGTEILSPARS

SEQ ID NO: 4236 - protein, 286 aa, Arabidopsis thaliana
MEGKEEDVRVGANKFPERQPIGTSAQTDKDYKEPPPAPFFEPGELSSWSFYRAGIAEFIATFLFLYITVLTVMGVKRAPNMCASVGIQGIAWAFGGMIFALVYCTAGISGGHINPAVTFGLFLARKLSLTRAVFYIVMQCLGAICGAGVVKGFQPNPYQTLGGGANTVAHGYTKGSGLGAEIIGTFVLVYTVFSATDAKRSARDSHVPILAPLPIGFAVFLVHLATFPITGTGINPARSLGAAIIYNKDHAWDDHWIFWVGPFIGAALAALYHQLVIRAIPFKSRS

SEQ ID NO: 4237 - protein, 436 aa, Idiomarina loihiensis L2TR
MAEHNHEHGHQDYQKSSLSLWGAVSLGTGVMIGAGIFALTGQVAQLAREWFVLAFVCGGIIAGFSAYSYVKLAKAYPSAGGIAMFLSKAYGKGSVTAIFALLMYFSMVINESLVARTFASYTSQLISFEAQWLIPLLAVGLLVFAFFINILSNQFIQTFSFFMAFVKTLGLVILAAGGLWASGIQFESISAIPEEATGGGILAGIALSILAYKGFTTITNSGGEIVEPKRNVGRAIIISLIICALIYVLVTLAVGSSLSIDEIVKAKDYALSEAARPVYGETGLWVTVAFAIVATVSGVIASAFAVSRMLAMLTNMKLVPHSHFGMPGSIQKHTLVYTIVMAMILAAFFDLSRIASLGAIFYIVMDIAIHWGVLRHLRQKVNANIYILVSAITLDVIVLVAFIWVKWTSDPLVIWASLIGMALIAAGEILFLRKKR

SEQ ID NO: 4238 - protein, 543 aa, Clostridium acetobutylicum ATCC 824
MNNLKGLELLRNPFLNKGTAFTLEERKKYDLTGLLPCAVMTLEEQEKVVYEKLKSIDDALDKHFYLMNIYDTNRILFYYVVKKHIVELLPIVYTPTIGDAVINYSKNYDTPKDAVFLSINHPENIKKSIEAVSNDLDDIKLIVVTDGEGVLGIGDWGVQGVDISIGKLAVYTVAAGLNPRNVLPIVIDAGTNNEALLNDPFYVGNKHKRVTGEKYYSFIDEFVKTCTSLFPDVLLHWEDFGRGNASTILEKYRNNICTFNDDIQGTGVMMVAALNSVAKVTNTPIKNHKILVFGGGTAGIGVSDQILLEKIRSGLTLDEALKDFYIVDRQGLITEDMQDLTEGQKKYSRKKGEFKKPLKDLAEIVAEVKPTVLIGTSGVHGAFTEAVVKNMAKSTERPAIMPISNPTKLAEAKAEDIIKWSDGNALVVTGSPSSPVEYKGVTYTIGQANNALLYPGLGLGIVVSKSKTVSDGMLAAAAHGVSSLIDLSVKGAPMLPVISKLREASKLVATAVVKEAVKENLNRAPIVDAENAVENEIWEPYYR

SEQ ID NO: 4239 - protein, 476 aa, Clostridium acetobutylicum ATCC 824
MNTSEIRKSHYNIYLKLLICILFGVFIWFIPHSKSIQPLAWHMLAIFIATILACILKPLPIGAVSIIGLTLAIITNTINVNTGLLGFSEGSIWLIVIAFFISRGFIKTGLGSRIAYHFIKLFGKKTLGLCYSIIFCDLVIAPATPSNTARAGGIIYPIIKSLSEAFGSKPEDNTERKIGSFLIFSEFHGDIITAAMFLTSMAANPLAKTLAKTLNVNITWFGWFLAALVPGIISLVLIPLIIYKIYPPEIKNTPNAPELAKKELEKMGPMKKDEKLMSIVFVIILFLWITGSLTKIDATLTAFIGLSLLLIFKVITWDDVKGEKGAWDTLIWFSVLVMMANQLNKLGLIKWFSTLVKNSVHGFSWPIILLILLVCYFYIHYIFASATAHVSSMYSAFLAIAIAGGVPPLLAALSLGFFGNLLASTTHYSSGPAPILFGSGYVNQNKWWSLNFILGIVYFIIWLGIGSIWWKVIGIY

SEQ ID NO: 4240 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 4241 - protein, 639 aa, Chromobacterium violaceum ATCC 12472
MSYQVLARKWRPKRFADLVGQEHVVRALSNALKEQRLHHAYLLTGTRGVGKTTIARILAKSLNCETGTTAEPCGECQACRQIDSGRFVDLLEIDAASNTGIDNIREVLENAQYAPTMGRFKVYIIDEVHMLSKSAFNAMLKTLEEPPGHVKFILATTDPQKVPVTVLSRCLQFSLRNMTPQQVSSHLAHMLDIEGIHYEAPALALLGRAASGSMRDAQSLLDQAIAYGLGEVKEDGVRAMLGAVDRRYLFTLLQALAASDGPALMAEADRLAERGVSFDSALSELAVLLQQLALAQTVPAALAADEPERDTLFALADAIAPQDVQLYYQIAIHGRKDLALAPDEHAGFNMTLLRMLAFHPANAPAQTAAPARPAAAVQPRPVAASAAAVASVSVPAERGMSPAARALQAAGLGAQAQGKPRAAEPSPAAEPEPEPAPLPSAVVSAVSEPSKPAPSPQPAPALAAPVSEPAAQDDEDERDEEEIVEAPWSDDDAMPAYMQQPPLEDEPSSYSFDGDWQRLVADLGAKLGAARMLAHNAVLKRWSQDRLELAVPESFRHMSGRDYQEKLKAALAERFGHPVDLAVTVEELGMETPAMTDARLRQEQLAVARECMQNDPVVQQMVREFGATLLIETIQPVQE

SEQ ID NO: 4242 - protein, 123 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAG

SEQ ID NO: 4243 - protein, 373 aa, Bacillus licheniformis ATCC 14580
MLNLKKRIALLPGDGIGPEVLDAAVDVLKSVAEHYQHEFEFEYGLIGGAAIDEAGAPLPEETVAACKAADAILLGAVGGPKWDQNPSELRPEKGLLAIRKQLDLFANLRPVKVFESLAGASPLKTEYIEGVDFVIVRELTGGLYFGKPSEQYVNQNGEEEAVDTLFYKKSEMERVIREAFQMAQSRKGKVTSVDKANVLESSKLWRKTAEEVAKEFPDVKLEHMLVDNAAMQLIYAPGQFDIIVTENMFGDILSDEASMLTGSLGMLPSASLSSSGLHLYEPVHGSAPDIAGQNIANPLAAILSAAMMLRTSFGLEAEAQAVEHAVDQVLRAGKRTKDLAKGSEHCTTQSITGEVKAALADDNAISNIMTAYV

SEQ ID NO: 4244 - protein, 397 aa, Neisseria gonorrhoeae FA 1090
MQNYLTPNFAFAPMIPERASGSRVWDTEGREYIDFSGGIAVNALGHCHPALVDALNAQMHKLWHISNIYTTRPAQELAQKLVKHSFADKVFFCNSGAEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQAARRLCDRHNALLILDEVQTGMGHTGRLFAYEHYGVVPDILSSAKALGCGFPIGTMLATEKIAAAFQPGTHGSTFGGNPMACAVGSRAFDIINAPETLHNVRSQGQKLQTALLDLGRKTGLFSQVRGMGLLLGCALDTPYRGRSSEIAATSLKHGVMILVAGADVLRFAPSLLLNDEDIAEGLRRLEHVLTEFAAANRP

SEQ ID NO: 4245 - protein, 130 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 4246 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSMASETSSLCGEDLLSLETTSEVGTLSSVEIQKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQKQWKNAFTNCFLKVDAEVGGKAGAEPDAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4247 - protein, 462 aa, Neisseria gonorrhoeae FA 1090
MSIKFADLNLDKNILSAVSSEGYESPTPIQAQAIPFALEGCDIMASAQTGSGKTAAFLLPTLQRLTKRSEKPGKGPRALVLAPTRELAAQVEKNALAYAKNMRWFRTVSIVGGTSFGYQTRALSKPVDLIVATPGRLTDLMQSGKVDFERLEVLILDEADRMLDMGFIDDIETIVEATPADRQTLLFSATWDGAVGKLARKLTKDSEIIEVERVDGQGKIEEQLLYCDDMRHKNRLLDHILRDANIDQCVIFTSTKAMTEVIADELYEKGFAANCLHGDMPQGWRNRTLTDLRKGRCKILVATDVAARGIDVPTITHVINYDLPKQAEDYVHRIGRTGRAGRTGIAITFAEVNEYVKVHKIEKYINRKLPELTIEGMEPARKRKSAGGKPKGKGGWGDRKSGGRRGDHKPGKEGFGGKTRGEGFKKEGFKKDSFKKTGEGFKGKRKAGDSFAGKSERRYKDR

SEQ ID NO: 4248 - protein, 907 aa, Bacillus anthracis str. A2012
MALVFSSFGALSAHAESLQKEKQFSPQLKTTIEQWGESKIAQHVETKTTKEISVIVELQHAPLAAQSNIQHAPDLQNSHAQSYHTELKKAQEETTKKIKEKAPGAKIKEVYNTLFSGFSISVPGDQITALASLPEVKTVYPNLTYKLHETTKSATSEEAPNIGGPTIGAPEAWNLKDPSGKSLDGKGMKVAIIDSGVDYTHPDLKANYIGGYDTVDEDADPMDGNVHGTHVAGIIAGNGKIKGVAPNASILAYRVMNDGGTGTTDDIIQGIERAIQDGADVLNLSLGQDLNVPDQPVTLTLERAAKLGITAVVSNGNDGPKPWSVDAPGNASSVISVGASTVSIPFPTFQVAGSSKTYQGLSLSKSDFPIGNDSPLVYVGYGNPSDYAKQDVKGKFALVLQGTSSTLVKAEQAKQAGAIGVLFISTEKEMNSMPEYFTRENLALPVMQLSNVNGEELKNLITKRKKNIKIGQPVPTELIGNFSSRGPSQGSWLIKPDIVAPGVQITSTVPRGGYESHNGTSMAAPQVAGAVALLRQMHPDWTTQQLKASLANTAKTLKDVNENTYPIMTQGSGLINIPKAAQTDVLVKPNNVSFGLIKPNSGKVKLTQNITLQNLSSKKKSFSTRVELLDTNTKTKVKTSVPSSISIQPNSSTEKPFTITVDSSLPQGVYTGNVYVKEQGAKEETRIPFTFSIDPKDYKRIDGLEIINSTFSPNGDQILDDNLINYYLVAPVDDVTLHANLVTKERVTYQGIIHQAKNETAGYKPFKWDGTKADGTPLADGLYQIEAVASNSGGETKQTAAVFLDRTAPKLTYEIDQENLVITGKVDDILLDWMTESGWVAPGIPVRLQYEINGNGVWESAFLNPWEKNYGIYLDRTQLQEGKNTIHIVATDAAGNTSNLNVDLDVK

SEQ ID NO: 4249 - protein, 354 aa, Neisseria gonorrhoeae FA 1090
MASYDDISGEWYRVCPKRSSNRALITVKFPFSTLFCLKSMTDITPFANRLGKNIKHLMKWAKRNGIEAWRIYDRDIPQFPFAADVYGDRIHLQEYDTGWLMRPGEYEAWLAEVLEAVAFVTGFEPEQIRLKRRERQKGLQQYEKTGKAGDDFVIAENGRKFWVNLDKYLDTGFFLDHRNTRKKVGETAAGKRFLNLFSYTGSFTVYAATGGAASSETVDLSNTYLDWARRNFELNGIDMERHKIVRADVFQYLQTAYGEGRQFDLIVMDPPSFSNSKKMPGILDIQRDHQKLIDGAVNLLASDGILYFSNNLRSFVLDDSVSEQYAVKDISKQSVPEDFRNKKIHRCWEIRHKS

SEQ ID NO: 4250 - protein, 258 aa, Blastopirellula marina DSM 3645
MTLSALFDLSGRTALVTGGSKGIGKAIARGLAEAGASVCITARHQQELETAAQEIGAGLDVRVAWRICDMADRAAVDALADGVLEEFGQVDILFNNAGTNQPQLLVETTDESWDHVLEINFTSCMRLARKLAPGMIERRWGRIIHLSSVLAVVSNPGRGNYSGTKGALSAMTRAHALELGPHGITVNCLAPGPIATDLPMSLLNDEQKQRFAERTAVLRWGETKDLVGPALLLASDAGAYITGTTLLVEGGMICRTFD

SEQ ID NO: 4251 - protein, 626 aa, Bacillus thuringiensis serovar konkukian str. 97-27
MTICSVNNVTKSFGGNIIFENISLEIKNGERVGLVGRNGSGKTTIFQLLTGMESLDAGAIHMKKGTRIGHVAQIPKFDESMTVYEVLSSAFKTEKELEREMRTLEKHMAEEQEPSVLQKLMERYGVIQEKFAFLGGYEIEANIMKVANGLQVIELFPRPFLELSGGEQTKVSLAYMLLQKPDLLLLDEPTNHLDLFAVEWLEQFLKEYNGTVMVISHDRYFLDEVVTKIFDLEDGEIHVYHTNYSRFVEEKEERLLQEFQAYQEQQKKIKKMKEAIKRLREWANQANPPNEGLHKRARSMERALERMQKLKKPILERKQMGLQFEGQDRSGKDVVVIKEVSKGFADHPLFNEVNLHVRFQERAAIVGRNGTGKTTLLKLLLEEIEPDAGEIRIGSSVKIGYLSQHAYGNMKSDVLEAFREYVAVTEGEARHILAKFLFYGPAVFKKVTQLSGGEKMRLRLAQLMYQDINFLILDEPTNHLDIESREVLEEALEQYNGTILAVSHDRYFLNKLFEKTYWIDERKLFEFAGNYAWARQKWEEKLGTQVIKQKRQGRKSIETVPVKKIEVRNIEEIETELMHVEEDIYTLECKMEHVVDVEMLEQLYEEKTKKELLRAELYNELENIVE

SEQ ID NO: 4252 - protein, 303 aa, Mycobacterium tuberculosis H37Rv
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTEVVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 4253 - protein, 249 aa, Clostridium perfringens str. 13
MIILKNENEIDLMRKAGKILGETLNLLKEKVRPGITTTELDRIAEEFITKHGATPSFKGLYGFPASLCISVNNQVIHGFPGSYELKDGDIVSIDCGVCLNGFHSDAARTFGVGNISEEAEKLIRITEESFFKGIEKAYVDNRLTDISNEIQQYVEANGFSVVRDFVGHGIGRKVHEDPEVPNFGRPGRGPKLMAGMVLAIEPMVNMGSYRVKTLDDGWTVVTADGKLSAHYENTVAILPNGPEILTLIK

SEQ ID NO: 4254 - protein, 173 aa, Zea mays
  misc_feature (62)..(62): Xaa can be any naturally occurring amino acid
  misc_feature (74)..(74): Xaa can be any naturally occurring amino acid
  misc_feature (80)..(81): Xaa can be any naturally occurring amino acid
MAYSMLSSAAVVTSPAQATMVAPFTGLKSSSAFPVTRKANNDITSIVSNGGRVSCMKVWPPXGKRKFETLSYLXPDLTEXXNWVRKVDYLSPATGGFLGGESRVGATGFGYRGSTGKHPPETTKGRYWEKGETFPLGRKGPHLWLKGVKEAPKGEKGEPPNRLSTGILGFQNT

SEQ ID NO: 4255 - protein, 397 aa, Desulfitobacterium hafniense Y51
MYRSALPGESYLQNNFLEGVGMKAIVYEGIRDVKVKNVGDPGIQKPDDIIVKVTSTAICGSDLHLIHGMVPGMPEGFVLGHETMGIVEEVGGDVHKVKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKGDTVVVLGCGPVGLLTIKWAIFQGAKRVIAVDHISYRLDHAYRYYGVEVINFEDHDNTGEYIKEITHGGADVVIDCVGMDGKASTFEKIETLLKLQGGSKSAIEIATQAVRKGGTVALVGVYGSKYNLFPLGDFFSRNITLKMGQCPAHSYVEPILELIKTGRFDATDIITHRLSLDKGEHAYEIFDEKKDNCIKVVLKP

SEQ ID NO: 4256 - protein, 538 aa, Populus tremula
MEEMYPAVAVPFRVGNSACESPSIDTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETTSEVGTLSSVEIKKSIGGVDIVAKTADLGDSNVDTVVSDPPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQEQWKKAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4257 - protein, 474 aa, Brucella suis 1330
MKIAVIGTGYVGLVSGTCFAAWGHEVVCVDKNARKIAVLERGILPIYEPGLDELVERNCAEGRLRFTCNLAEAVRGAEMVFIAVGTPPRAGHGDADLSFVYMVARELAPLIDENAVVVVKSTVPVGTGDIVQKLIGSVRRAGTFSVASNPEFLREGVAIRDFLYPDRVVIGVEDERARKALLDLYGTPLKEQKTPIVVTQRRTSELIKYAANAFLATKITFINELADLCEHVGSDVSQLALGIGLDKRIGESFLNAGPGYGGSCFPKDTLALLRTAQDHGVALRIVEETVTANEARKRRMALKVLDALGGDVEGLTIAVMGLTFKPDTDDMRDAPSVPLIETLQRFGARIRAYDPIGAENARNILSDVELCDDPYECVRAADAMVVITEWDSIRRLDLSRVRQAMRQPVLIDLRNAYEPNVAENLGFRVSAVGRAATARHETSIKDALSLLASRSRRADSAEELVPEGGGSNDL

SEQ ID NO: 4258 - protein, 267 aa, Vitis vinifera
MADRVHPKASSPDATSPRPPQSPSNSNPPTPENPVPPAGTYVIQIPKDQIFRHPPPENARRYQKYSGRKPRRSGCCCCLCWFLGLAALLIFLLAIAAGIFYLVIRPKALSYSVEDISITGFNVSSAAATASISPEFDVTVRADNPNKKISIYYEEDSSVKVYYSDVDLCNGVLPVFYQPPKNVTVFQTALNGSGVVLTSGMKETLVNQQREGNIPLKLKLKAPVKIRVGSVKTWTITVKVSCDLTVDKLTAESKIVSKDCDFSVRLW

SEQ ID NO: 4259 - protein, 680 aa, Coprinopsis cinerea okayama7#130
MTAVATLSTTEVIASANELLSAHSALLSNLRTKQQQQRRQLHSLQPPPNEVLRLPLLPSPSPSPPPPDEDNEQHHEEGSSTSPPKRVLRADLPPIKRARALRYLNYIPEEETIRNDYSQRYVDSGEWPQNWVLGAEPERRFEEYPKQQRLLNLKKASVNNHSLPPSYLPYSQLSTLNSSKFDVILLDPPFSSSFTWDNLQELPIPSLAADPSFVFLWVGSGAGEGLERGREVLAKWGYRRCEDVVWVKTNKTTNQGPGGRCGDLRIVDTDVIIWEGDPTDPTRKPPEMYTLIENFCLGIRRLEIFGRPSSLRRGWVTVLGPNQDEQLETLEDGTVHVAGKEGGRGSLWTQHDWDEGIKELVAAGNPGGVAGVVGSGKPVVPMTSEIDALRPKSPVRPGQNAAGHHHHGSTGGGGGVGGGVGGLPPNPMTGHATPMQLPPRFSAGGGGGGRGFGGMGTSGGTMMGPPGAAAGRGGVGGMGGPGGQPMVPMGVQQMMGVNDIMGAAWNNLTSMNNLNNMSNMGAMNPGMGMGVSVPGMMPMVGVNPGTLAGMNNMGGMNVQGIQPGGGGGMGVNVNAMGMGGPQMGMLNQMAAAGQMSMHDGFGQHPQGMPGMFNPGMGAWGGGGGGDGQFGMEGGHGQWDGGQGVVPNMMGAAGGMNMQGMQGMHGMGMGQWGHGGPQGNF

SEQ ID NO: 4260 - protein, 329 aa, Dechloromonas aromatica RCB
MKITLLGAGAWGTALSIAFSGKHDLTLWSREVDVADDLRKTRENHRFFPGYKLPESVAVSTDFEVAVAGAELLVVATPIAGLRPTVERLQALGCKLPVLWVCKGFEAGSGKLPHQVVAEVLGKEALCGALSGPSFAEEVAAGQPTAVSLATNDPAFAREAARQLHTTRLRIYANDDLVGVEVGGAVKNVLAIATGVCDGLGLGLNSRAALMTRGLAEIARLGLALGAERQTFMGLAGMGDLILTCTGDLSRNRRVGLALAQNKSLPQILEELGHVAEGVYTAREVDRLAARLGVEMPISAAVAAVLDGRLTAAQAVEQLMARDPKEELA

SEQ ID NO: 4261 - protein, 543 aa, Clostridium acetobutylicum ATCC 824
MNNLKGLELLRNPFLNKGTAFTLEERKKYDLTGLLPCAVMTLEEQEKVVYEKLKSIDDALDKHFYLMNIYDTNRILFYYVVKKHIVELLPIVYTPTIGDAVINYSKNYDTPKDAVFLSINHPENIKKSIEAVSNDLDDIKLIVVTDGEGVLGIGDWGIQGVDISIGKLAVYTVAAGLNPRNVLPIVIDAGTNNEALLNDPFYVGNKHKRVTGEKYYSFIDEFVKTCTSLFPDVLLHWEDFGRGNASTILEKYRNNICTFNDDIQGTGVMMVAALNSVAKVTNTPIKNHKILVFGGGTAGIGVSDQILLEKIRSGLTLDEALKDFYIVDRQGLITEDMQDLTEGQKKYSRKKGEFKKPLKDLAEIVAEVKPTVLIGTSGVHGAFTEAVVKNMAKSTERPAIMPISNPTKLAEAKAEDIIKWSDGNALVVTGSPSSPVEYKGVTYTIGQANNALLYPGLGLGIVVSKSKTVSDGMLAAAAHGVSSLIDLSVKGAPMLPVISKLREASKLVATAVVKEAVKENLNRAPIVDAENAVENEIWEPYYK

SEQ ID NO: 4262 - protein, 354 aa, Zea mays
MARCLWVGKNAAARGAGAAIPKPPAPHPPAPRSLPAVDDCPTLAFLRPKPTAVGYGTATVPLPAHCFPALPVGDHLFHRLQLDGLIPPVSTATRPPELVGVTVEQARKVARAAEMEVARARLRSNAQSVVSGSEFAALCVDIAGGVEGGRRLARALDESGVVIVLGEAVFLRPDMVAKAIGSILPVKKQLQAPRAGDGSEARKRELEAMEAQKAAIDADAAAQVRRELWCGLGLLATQTLGFMRLTFWELSWDVMEPVCFYATSLYFMSGYAFFMRTATEPSFEGFYRSRFASKQRRLMRARGFDVDRYNALRKGQGQGLVPSPTPTRVGTSAMYNSASLRPDEAAWLVPGGHT

SEQ ID NO: 4263 - protein, 429 aa, Klebsiella pneumoniae subsp. pneumoniae MGH 78578
MKALNQEVREYFKEHVNPGFLEYRKSVTAGGDYGAVEWQAGGLNTLVDTQGQEFIDCLGGFGIFNVGHRNPVVVSAVENQLAKQPLHSQELLDPLRAMLAKTLAALTPGKLKYSFFCNSGTESVEAAIKLAKAYQSPRGKFTFIATSGAFHGKSLGALSATAKSTFRKPFMPLLPGFRHVPFGDINAMRTMLSECKKTGDDVAAVILEPIQGEGGVILPPTGYLPAVRKLCDEFGALLILDEVQTGMGRTGKMFACEHENVQPDILCLAKALGGGVMPIGATVATEEVFSVLFDNPFLHTTTFGGNPLACAAALATINVLLTQNLPAQAAQKGDMLLDGFRLLAQEYPDLVNEVRGKGMLMAIEFVDNEIGYDFASEMFRQRVLVAGTLNNAKTIRIEPPLTLTLEQCEQVLKAARKALAALRVSVEEA

SEQ ID NO: 4264 - protein, 398 aa, Streptococcus agalactiae 2603V/R
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 4265 - protein, 376 aa, Pseudomonas sp. BG33R
MTTLHSTPRADGFHMPAEWAPQTQTWMIWPERPDNWRLGGKPAQAAHVAVAKAIARFEPVTVAVSAGQYENARARLDVPNIRLVEMSSDDAWVRDTGPTFVINDSGEVRGVNWDFNAWGGFDGGLYAPWNRDSQVGGKILEIERAPRYRTQGFVLEGGSIHVDGEGTLITTEECLLNRNRNPHLDRAAIEAVLADHLAVDKIIWLPDGLFNDETDGHVDNFCCYVRPGEVLLAWTDDPQDPNYPRCHAAMDVLQNSTDAKGRAFIVHKMPIPGPLYATEEECAGVDPVDGSQERNPSVRLAGRNVNFLIVNGGIIAPSFDDPLDHTGQTNPAEPVPAARSSDGAGPRTVTGGRQYSLPDPTAARTAQKLSVVVTVL

SEQ ID NO: 4266 - protein, 336 aa, Streptococcus agalactiae 2603V/R
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVATLEKDVTVEEVNAAMKAAANDSYGYTEDPIVSSDIVGISYGSLFDATQTKVQTVDGNQLVKVVSWYDNEMSYTSQLVRTLEYFAKIAK

SEQ ID NO: 4267 - protein, 538 aa, Populus tremula
MEEMYPAVAVPFRVGNSACESPSINTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETASEVGTLSSVEIKKSIGGVDIVAKTADLGDSNVDTVVSDRPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQKQWKNAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4268 - protein, 448 aa, Candida glabrata CBS 138
MGICGSKPDKAGDTKPGTSKARVRSDNRNSGGASNGKSTTAGQKDGQDMEGGQSGNSMSNEGDKKTTLEEELQNTRGLPVDEQSSSQSGSNNQKAIKVLLLGAGESGKSTILQQLKILHQNGFTKQELIDYTPLIYDNIIEIGKDIISARRKFNVDIDDPTLTEEDLDKISNYTSTRKNTDEDSSEGENSITVKPSEQANTTSIVSKDEFPKEFYPILSKLWNMKSTQELIMSEKSSQFYMMDSTKYFLDNLDRICNTPNYIPTEQDVLRSRQKTSGIFDTVVNMDNNFQMHIYDVGGQRSERKKWIHCFDNVTLVIFCVSLSEYDQFLMEDKSQNRFQESLVLFDNIVNSRWFARTSVVLFLNKIDLFAEKIQRVPLEHYFPDYMGGKDINKAAKYILWRFVQLNRANLNIYPHVTQATDTSNIKLVFAAIKETILENLLKDSGVLQ

SEQ ID NO: 4269 - protein, 538 aa, Populus tremula
MEEMYPAVAVPFRVGNSACESPSINTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETASEVGTLSSVEIKKSIGGVDIVAKTADLGDSNVDTVVSDRPSVAGSVEEEAGDGSDAKTSSVVLQLTLERGTSGTVSRSVFEVDYVPLWGFTSVCGRRPEMEDAVATVPYLLKFPIQMLIGDRLLDGMNKYLPHQTAHFFGVYDGHGGSQVANYCHDRIHSALSEEIEFVKNGLSDGSIKDSCQKQWKNAFTNCFLKVDAEVGGKAGAEPVAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4270 - protein, 3850 aa, Streptomyces eurythermus
MSTNESDSPNGSATTEAKLRDYLRRAMVELHETQEKLRRVEEEAHEPIAIVGMACRFPGGVGSAEDLWDLVVAGTDAVSGFPVDRGWDVEGLYDPDPDAVGTSYVREGGFLHGAGEFDAEFFGISPREAVAMDPQQRLLLETSWEALERAGIDPHTLRGSRTGVYAGVMYHDYGSGQTTATDDMGGYFGTGTSGSVASGRISYVLGLEGPAVSVDTACSSSLVALHLAVQALRRGECDLALAGGVTVMATPTVFVEFSRQRGLAADGRCKAFSDAADGTGWAEGVGVLAVERLSDARRRGHRVLAVVRGSAVNQDGASNGLTAPSGPSQERVIARALADARLTAGDVDVVEAHGTGTRLGDPIEAQALLATYGRGRSADRPLWLGSLKSNIGHAQAAAGVAGVIKMVMAMRHGVLPRSLHVGVPSSHVDWSSGGVEVLTRARAWPVVERARRAAVSAFGVSGTNAHVVLEQAPEEAGDAEAVPGPVKHPVPVVVSGVSAGALDAGLGRLAALVESDGGLGVGEVGWSAAQRSVFGHRAVVVASGREELLAGLRAPVVSGVAGSVGRSVLVFPGQGTQWAGMGAELLDSSPVFAARMGECAAALSPLVGWDLLEVVRSGEGLERVDVVQPVTWAVMVSLAEVWAACGVKPDAVVGHSQGEIAAAVVSGALSLEDGARVVALRSQVIGRVLAGAGGMASVALPADVVEERLSGWSDRLGVAAVNGPAITVVSGEADAVGEFVTACERDGVRARRIPVDYASHSAQVEAIEAELASLLGSVVAREPEISFYSTVEPGGQVRTDAGYWYRNLRSRVRFAETVDLLLADGFGVFIEASAHPVLTIGIQELADRTGPDRDVVITGTLRKGEGGLRRLWTSMAEAFVHGVAVDWKAAYAAHGLTARRVDLPTYPFQRRHYWLDTSDRRGGTDDLTYHVEWKALREDETGARLSGRWLLLLPETPRCPAFAAHAAEGMARAMADRGAEVVTLGIDPAGDRYRMSALLAEAAEAKQAPDSAPLHGIVSFLALAEGTHPDHPGLPLGVAASSTLIQAAADAQAGARLWTVTRGAVSALPREEASVEQAQVWGLGRVAALELPYLCGGLLDFPADTDTDTDIADPRSYRRAAAVLAASPEGEDQVAVRGPGVYGRRLVRSAAATTGPGWRPRGTVLVVGEVAAVAEPLARRLLADGAEHVVLAGPAASLPTALGEETSIEGTRADGTRVADGTLADGRVSLVPCEVEDDAALRSLIAEHPPAAVLVAPAAVPLSALSDTTPAALARAVHTKTDLATRLEALLEDTKLDAFVVFSSVAGVWGGTGQGGYAAGTAHLDAFAERRRSRGLPFTSVAWTPWHGHEAFASGDDEAVAAREEIAAGMSRAGLTPLDPRRAVDALFRAVGRGAGAVVVAEVDWERFAAAREAVRPSALFEGVAATRRPRTATGDSGAHAGVAAGADASPVDTAPADDAGSDGRRETPEVVRLLAGKSDEEQLRLLLRLVRGHAATVLGQSSLDAVDTRQPFKDLGFNSVTAVELRNRLRTATGLTLSASLVFDHPDPAALARHLREQALEQGAAKPAGTGDALVRSAAPPGPAAGHASEPIAIVAMACRFPGGVSTPEELWRLLSDGGDAISAFPGNRGWSLEELYDADPDASGRTYVREGGFLHEAPDFDPAFFGISPREALAMDPQQRLMLETSWEAFERAGIDPSALRGSRTGVFVGTNGQHYLGLLQNGEESFDGYLGTGNSASVMSGRLSYVFGLEGPALTVDTACSASLVALHLAVQALRRDECSMALAGGATVMSTPEMLVEFSRQRVLSPGCRSRAFAGAADGVVLGEGAGVLLLERLSDAERLGHPVLAVVRGSAVNQDGASNGLTAPNGPSQQRVIREALADAGLRAEDVDAVEAHGTGTPLGDPIEAQALQVTYGASREPGKPLRLGSVKSNIGHAQAAAGVAGVMKTVLALRNGVLPRTLHVDEPSPRVDWSSGTVALLTEPMPWPEGETPHRAGVSSFGISGTNAHVLIEEAPEPGHRPTPSAPRTVGGGHDGLEPDGTGGPEPDGTGGHDGIAPLVLSARTEAALQAYADRLRGAFLDDPGLRPADAGLTLLTARARFEHRAVVGGADREELLHALRALAEGREHPSVARHRAVPADGGAVFVFPGQGSQWPAMAEGLLDRSVAFRESAEACDAALRPFLDWSVLDVLRQVPGAPSLSRVDVVQPVLFTMMVSLAACWRAAGVQPSAVVGHSQGEIAAAYIAGGLTLEDAARIVALRSQAWLTLAGKGGMVAVSLPAEQVRVRLERFGDRLSVAAVNSPGTAAVAGDPESLRELLAELEADGVHARAIPGVDTAGHSAQVEALRERLMRELAPVAPRSGDIPFYSTVTGGPLDTAELDAAYWYRNMREPVEFEQATRALLADGHHAFLETSPHPMLAVSLEQTVADAGTPAAVLHTLRREKGGTRNFALALASACAQGADIDAAALYGPEARPAGLPTYPFQRRRYWYHPPARRGDTASVGLADAGHALLGAGVELPDAAGHVYTARLGAGTRPWLAEHALLGTVLLPATGFVDLVLWAGAQSGCGQIDELALRTPLVLPGDDAGPAGTDTVELRVQVGPEDEEGHRTVTVHSREAGAPPRSPWTLHAQATVTPASSAGTLTESPAAGLPTADAPAAGGSDGWPAPGAAWPPAGARPAGVPDPAAFYAAFAERGYDYGITFQGFRTGWRDGDTVYADVALPGPAAGEARDHDIHPALLDAALQAMSLGGFFPADGQARMPFALRGVRLYAAGADRLRVTVSPVGAEAVRLLCADGEGRPVLAIDELVVRPVPAEQLAERSGAAGGGRPGTGSGSLYRVLWERKPAPASVPAQRWAIVGDDRGGLAGALTPVRAADCATHPGLESLLDACSTEGALPDGVVVQLAHFPGVPDPCTARAVLDRTLEVAQHWLTAAGQSSAKLVVVTRGAVAVGPGETVRDTAAASAWGLVRSAQSEEPGRMVLLDLGPDDDAVDGGALAAALACGEPQLAVRGEHVHAPRLAPMGPDTPDTLHLPDAGTDLGTAEATEPTESAGSAGRARSAAWRLGTRGDGTLEGLRLEPAPDTLAPLRPGQIRVSVRAAGLNFRDTLIALGMYPGHGVMGAEGAGVVTETGPGVTGLAPGDRVLGMWTGGFGPYAVADHRMVARIPDGWSYAQAASVPAVFLTAHYALGRLAQARPGQTLLIHAATGGVGMAALQLARHLGLTVYATASTPKWDTLRALGLSDGQIANSRTLDFADRFLEETGGRGVDIVLNSLAGDFVDASLRLLPRGGHFLELGKADVRDPRTIADRHPGTAYRPFDLVEAGPETVGAMLTELLELFEAGVLHPLPLTVHDVRHARRAFRALSQGKHTGKLVLTMPPVFDPHGTVLITGGTGTLGSAIARHLAGEHGVRHLLIAGRQGGEAEGAEDLVRELAELGADVTVRACDAADRDQLAALIDAVPTAHPLRAVVHTAGVLDDGTLPSLTPERMDAVLRPKVDAVLNLHELTRDLDLSAFVLCSSSSALFGSPGQGSYAAANAFVDAFAQYRRGTGLPALSLAWGLWARNSGMAEHLDQDGMHRRLARGGILPLTDAEGVALFDETRRWDEALQVPIRLHHAALRAQDTVPPFLSGLVRSRRGPLTATAPAQPDAPTAAPSMVLGDRLAQLPPAEQMDAVLEAVRTHAAAVLGYAENGELSAERNFRELGFDSLTAVELRNRLTAATGLRLAATLVFDHPTPEALARHLHDRLAPDTPAESGDVSLATELDRLERLFTRLTEQGGLDTALPDGTARHDITNRLAALTGLWDRLNGTSGDDPAGPADDEVTGTLDAADDEELFAFIDERF

SEQ ID NO: 4271 - protein, 538 aa, Populus tremula
MEEMYPAVAVPFRVGNSACESPSINTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETASEVGTLSSVEIKKSIGGVDIVAKTADLGDSNVDTVVSDRPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQKQWKNAFTNCFLKVDAEVGGKAGAEPFAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4272 - protein, 126 aa, Brassica napus
  misc_feature (115)..(115): Xaa can be any naturally occurring amino acid
MSQETVNPKAYPLADSQLTITILDLVQQAANYKQLKKGANEATKTLNRGISEFVVMAADTEPLEILLHLPLLAEDKNVPYVFVPSKQALGRACGVTRPVIACSVTSNEGSQLKTXIQSLKDAIEKL

SEQ ID NO: 4273 - protein, 143 aa, Dechloromonas aromatica RCB
MKTLKQLLAGRNRPLAVVAPSDTVYHALTVMAQHEVGALLVLDGEQLVGIFSERDYARKIILQGKTSKETLVREIMSDRVAYVTPGSTLDECMALMTEKRFRHLPVLDEQGGIVGMISIGDLVKETISDQKFLIAQLEHYIAG

SEQ ID NO: 4274 - protein, 220 aa, Dechloromonas aromatica RCB
MPLFQKAVFLTTVANLRDLPQDSVREVAFAGRSNAGKSSAINTLAGRVRLAFVSKTPGRTQHLNYFTLDEGKYFVDLPGYGYAKAPEAIRSQWEGLIGPYLSKRDQLAGLVVIMDIRRPMTDLDLRLIDWFRPTGRPIHILLSKSDKLSRQDQTKALRSVKAEVATWGDADLYSVQLFSSLKKAGVEEAERVLASWLDIEIKQKENKGPPDKGSPGAKMP

SEQ ID NO: 4275 - protein, 609 aa, Emericella nidulans
MALDDISAVPKGALDTDPAVERPPPLLDADRSDSERLQPGVKRAEMLRKGWTRQGLIIAFTGLFLATLSINFGDYSTQVYVPYATSAFKQHSAMSAARVVGNITRIAAYPIIAKLGDVFGRAEMFILSIVFQAVGYAIYAGCKNVGQYIAGGIFEAIGSTGFGLTQQVFVADVTNLINRAVWSTLPDSLTVIPALYLGTEIAEAVLEKNEWRWGFGMWAIIEPVCSVLLVGTMLYYQKRARKDPSPAEFASEPTERNVDDGWWKRIYNLVWVQLDAFGAILLLLGLSLFLVPLSLTGSGNSDDWHRGSFIAMLVLGVVIFVAFLAWDTWCAKKPFIPYRMIKNRTVAAACLLGILDFFHYSVFSVFFTSYLQVAAHHGAGPATRIDNSLRVAFQVAGIFAAYFMKFTKRSQVWVFTGVPLCVLGMGVLLYLVDMGEGRVGNEAAFVTAKSLIGIGRGFYQTASQVSVQAKVSRGEVSVVTAVFFAAMSIGGAIGTSVAGAIWRSTLPPKLAQHLPAELKDQAQAIFGSIVVAQKYEVGTPARDAIDMCYRQSQRMLAIAALAALAPMLIIMFFLENVPLTDETTLIELHGNREAVKKNHSGGEGKEARS

SEQ ID NO: 4276 - protein, 216 aa, Azoarcus sp. EbN1
MPIFRNARFEVSIAKSGALPPPEGAEIAFAGRSNAGKSSAINTLADHTRLAFVSKTPGRTQLINFFRLDCGAVLVDLPGYGYAKVPENIRRQWQGLLEHYLRKRENLIGLVLIMDSRHPLTPLDRQMIDWFVPGGRPIHVLLTKCDKLSRNEAAATLASVRREVAALGPQISVQLFSSLKKIGMEEVEHKVAGWLGLPSDDLPAIPTPAQLRAAGK

SEQ ID NO: 4277 - protein, 295 aa, Dechloromonas aromatica RCB
MSIEDLSPGTKAAVLAEALPYIKRFHGKTIVVKYGGNAMTDEHLKSCFARDVVLLELVGFNIVVVHGGGPQIESLLARVGKKGEFIQGMRVTDAETMEVVEMVLGGQVNKDIVNLINQHGGKAVGLTGKDGNFIRAKKLMLEDKDNPGDLIDVGQVGEIVSIDPTLIDHLDKGAFIPVIAPIGVGKDGETYNINADVVAGKIAEVLKAEKLVLLTNTPGVLDKNGDLITGITPKQIDEMVDDGTLSGGMLPKIGSALDAARNGVKGVHIIDGRVEHALLLEILTDHGVGTMIKSH

SEQ ID NO: 4278 - protein, 220 aa, Azoarcus sp. EbN1
MTQDELKKAAAIAALDYVENGMIVGVGTGSTVNHFIDGLAGIKGRIAGAVSSSEASARRLQAHGIPVLDLNDITDLPVYVDGADEIDGGFCMIKGGGGALTREKIVAAVARRFICICDASKKVACLGRFPLPVEIIPMARAYVERELVRIGGRPELREGFVTDNGNLIVDVHGLMITSPRALETELNQIVGVVTNGLFARRGADVLLLATLAGVERQVAN

SEQ ID NO: 4279 - protein, 206 aa, Zea mays
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTLEEILLNNPEELVHGSESPETKA

SEQ ID NO: 4280 - protein, 220 aa, Streptococcus agalactiae 2603V/R
MSTNKIAPSILAADYANFANELKRIEETTAEYVHIDIMDGQFVPNISFGADVVSSMRKHSKLVFDCHLMVVDPERYIEAFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 4281 - protein, 397 aa, Salmonella enterica subsp. enterica serovar Typhi str. Ty2
MFQKVDAYAGDPILSLMERFKDDSRHDKVNLNIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDEDAYAIRAIASAGLPALVSNSFSKIFSLYGECVGGLSVVCEDAEIAARVLGQLKATVRRIYSSPPCFGAQVVATVLGDEALKASWLAEVDAMRTRIISMRQTLVKELKAEMPDRNFDYLLQQRGMFSYTGLSAEQVDRLRDEFGVYLIASGRMCVAGLNASNVHRVAKAFAAVM

SEQ ID NO: 4282 - protein, 389 aa, Thiobacillus denitrificans ATCC 25259
MTARRPRTATRADAIAPFHVMDILARAQALEAAGRDIIHLEIGEPDFATPGPIVEAGIAALRAGHTRYTGALGLPALRRAIAEFHRTYWGTPVEAERVVVTPGASGALLLVLGLLAGPGDEVLMADPGYPCNRNFAQFCDARAVEIPVDAASGFQLTREAIERHATPATRAVLIANPSNPTGTTIDPEALADIHAWCAARGIALIVDEIYLALTYDGDTHSAARWDDVFVINSFSKCFLMTGWRLGWLVAPAWALAALERLAQNLFLAPPTPAQHAALAGFEPATLAILETHKAELRARRDFLLPALRARGFAIPVIPHGAFYLYADCSALAADSQVLAGLLLEQAGVATTPGVDFGRHDPARYLRIAYTQPKPRLDEALARIDRFLRP

SEQ ID NO: 4283 - protein, 201 aa, Geobacter sulfurreducens PCA
MCMCTLVTKEAPDFTADAVMPDNTFGTVKLSSYRGKYVVLFFYPLDFTFVCPSEILAFNKKLDQFKAKNCEVIGVSVDSKFTHMAWKNTPVENGGIGNIQYPLVADLKKEIATQYGVLFEGAGVALRGLFLIDTKGVVRHAVINDLPLGRSVDEALRMVDALQFVETHGDQVCPANWKEGDEAMKPTASGVAEYLAKHSVG

SEQ ID NO: 4284 - protein, 224 aa, Francisella tularensis subsp. tularensis SCHU S4
MFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYIARQIVKLGGQPVYREQTITDNGNVILDVYNLKIDNPLKLETELNQITGVVTNGIFALKPADTVIMATKDSNIVVL

SEQ ID NO: 4285 - protein, 325 aa, Oryza sativa
  misc_feature (21)..(21): Xaa can be any naturally occurring amino acid
  misc_feature (70)..(70): Xaa can be any naturally occurring amino acid
  misc_feature (161)..(161): Xaa can be any naturally occurring amino acid
  misc_feature (181)..(181): Xaa can be any naturally occurring amino acid
  misc_feature (250)..(250): Xaa can be any naturally occurring amino acid
  misc_feature (285)..(285): Xaa can be any naturally occurring amino acid
  misc_feature (305)..(305): Xaa can be any naturally occurring amino acid
ITPSKLIPANKIYQSYRKNKXIVAHTPLQRSPYLSTKYSANIFLKREDLQAIRSFKIRGAATAFRYMTEXEKSRGVVTASAGNHAQGIAYCCKTLKVKGTIFMPATTPKLKINSVRHHGGEFLEIIMVGTTFDDAVAEARKYQEQTNAVFIHAFDNINVIXRPRRISSINSIGMDFKLTIXFVFTCVGGGGLCSGLGCYLRQMAPEVKLVGFEPLGSPSMYNSLQSNQPVILDALGTFVDGASMKRTGRXPFDILSELKQEVHLINEGIGCKTMLEMYDEGAIIXEPAGALSVAGVKVMKDRIAXKIGICILKGSNHDIIRAFKI

SEQ ID NO: 4286 - protein, 267 aa, Bacillus thuringiensis serovar konkukian str. 97-27
MLTKHRILFIGAGRMAEAIFSGLLKTSKEYIEEIIVSNRINVEKLDQLRARYNVSTTTDWKQHVTSVDTIVLAMPPSAHEELLAELSPLLSNQLVVTVAAGIGPSYLEKRLPEGTPVAWIMPNTAAEIGKSISLYTMGQFVNKTHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVAATNKKARGK

SEQ ID NO: 4287 - protein, 591 aa, Physcomitrella patens subsp. patens
MGREKRPSGSGTGLSDETLACVLKYVESAEDRASVSLVCKQWRLVDGATRKFVTIAYMYSTSPEMLTRRFKRLEGLKLKGKPRAAEYDLLVPDWGGYAEPWIRDLGRAYTSLQTLQLRRCQVSNADLTLIASSPCQASLQVLYLHKCAGFSTAGLLPVAKSCRSLKSLSVEDSDVTDEGGEWLFELARNNSVLEVLNFAVLGLEDVDAADLVLLVERCKSLVSLKVGEVEMVDMISAISRASSLTEFGTGSCNFFGDEDSRTHVSISLPSSLTGLSGLWAMSDPGLAMVLPIAPNLRKLDLKFTLLSRKAYCQLFSQCHALEELQVRNAVGDEGMEVIGKTCKSLRRLRVEHDNAGAITQRGVVAVAQGCARMQQLIVYVSDITNAALAMLGQCCAQLTDFRLVLETAARRVVDLPLDDGIKLLLKGCRKISKLAVYLRHGGLTDRGMGYIGEFGTNLKWLLLGCTGESDIGLASLAYKAQRIERLECRDCPFGEAGLAAAVVAMSSLKFIWIQGYRAPWAGEHLLALSRPYLNIEVISSTDTQPGQLIAHYTTVGPRTDNPLEVKQLTLNPDDHLQEMRPSLHSPGSTRH

SEQ ID NO: 4288 - protein, 277 aa, Bacillus thuringiensis serovar konkukian str. 97-27
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLHNEVVTIPKSIKEHRIIENANIFDFELSSDDMKAIQALNEDHRVGPDPDNFNF

SEQ ID NO: 4289 - protein, 283 aa, Candida glabrata CBS 138
MTYTLTILGCGVMGQAVLSAIYKAPKATSVIKALYPSKIITCNHDEPSAQQVTDLISTFETSPNGIEVVSTYGKNVEAVKQSDVIILGTKPFLAEQVLNGVKDVTSGKLIISLAAGWTIGQLQAYTPSVSRVMTNTPAKYGYGCAVVSHSPQVTEDQKSLVSELISHVGKYVELPEKNMDAATALVGSGPAFVLLVLESLMESGIKMGIPLKESTECALKVLEGTAKMVEESGVHPSVLKHQVCTPGGTTIAGLCVMEDKGVKSGIIRGVEEAARVAAELGKK

SEQ ID NO: 4290 - protein, 518 aa, Zea mays
MGPAWMVASAVAAVLASWAFNALVRLVWRPYAVARRLRAQGVRGPAYRFLAGNLAEMKRLRAEGARATLDVGDHDFVPMVQPHHRKWISLYGRTFLYWNGATPNLCLADVNLVRQVLFDRTGLYPKNHINQYVTRLLGRGLLLTDGDEWKRHRKVVHPAFNMDKLKTMTATMSDCALSMISEWEAKLAKGGDAEVVELSSQFEELTADVISRTAFGSSYREGRQVFLAQRELQFLAFSTAFDVQIPALRYLPTRNNLRTRELDRRVRGMLMDIIKARLAVAGKDTAGGGYGHDLLGLMLEAAVEHGGEAPTLSMDEIVDECKTFFFAGYDTTSHLLTWACFLLSTHPEWQGRLREEVRQECGADEVPTGDALNRLRLVNMFLLETLRLYGPVSLIQRKAGTDLDLGGVRVPEGAILTIPIATIHRDTEVWGDDAGEFRPERFQNGVTRAAKHPNALLAFSSGPRSCIGQNFAMIEAKAVVAIILQRFALELSPTYVHAPMDVITLRPRHGLPMLLRSL

SEQ ID NO: 4291 - protein, 232 aa, Zea mays
  misc_feature (67)..(67): Xaa can be any naturally occurring amino acid
  misc_feature (88)..(88): Xaa can be any naturally occurring amino acid
  misc_feature (118)..(118): Xaa can be any naturally occurring amino acid
AYLSSRNAVEVVRLEQKAASLGKLVEEEEEAQVTLDVLSKPKHPGFLLRHLFPSKAGDIPAWLDPVXLPSGKSSYSGFCGKPLQFVLXAFSLCAMKLPHSTAYCLDIDLVTVRLGCVXIYALTKDNVAAFHRTLFMFMCPSMACLLRDQHEQWKHKYGNPCRSVKIFRCQLPRNNAFYSAQPPKHDGSNKPLCLGALVCHWCGTWKGDKICSNCKKARYCSEKHQALHWRTS

SEQ ID NO: 4292 - protein, 667 aa, Candida glabrata CBS 138
MSQENSNVPALKRTESKYKIGRVKSLPTVQIDEKTGDSYIELAPRSEGKIYGCTTFQGNYKEEEKLGQGTFGEVYKGLHLQTQRKVAMKRIIVNQENDLFPITAQREITILKRLNHKNIIKLLEMVYDFPPESNNKDYAQFNQNNSANPPAVPKKFFYMILPYMVADLSGILHNPRIELKMADIKNMMKQILEGVNFIHCSKFMHRDIKTANLLIDHNGVLKLADFGLARQYYGSPPNIKFPGSAGSGAKYTSVVVTRWYRAPELVLGDKYYTTAVDIWGVGCVFAEFFEKKPILQGKTDIDQGHVIFKLMGTPDERTWELAKYLPGAELTKTEYKSTIDERFGKHLTPTGLSFLKGLLALDPYKRLTAMSAMKHPFFQEEPLAADRLTLPCEESHEADIKRYKEELHEAMSQKGPSAPPGHIKEATPSPAKFEKKSGIKREQPYQSNQKNDQYPIKRQKFNQNPSVPHPQPKANRYGGSSLPSGPKYGRYEGNNHSGSLRNRITPSNMGTHSNPRAENMGSKPYQSEGRYSSNEDRKNGYNRGYSSSVNSRYNNRAAFNETEDQSITTTTLNRYRHKGYHDNNQSQTRLQGHSSLPGKPTSKYNSTQTNIPYRRTEIPNPNEYNASKLGSQDTKKNDYPKHSETQKQQNNEEKKIHSEQKDIADLY

SEQ ID NO: 4293 - protein, 268 aa, Pyrococcus furiosus DSM 3638
TTAALALARELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLVQMHKEVFNLPIEEPKKVLLADKIGEYNFRLVEGANEIIQLEALLAQFTLIGKK

SEQ ID NO: 4294 - protein, 639 aa, Nostoc punctiforme PCC 73102
MEASFEITLQMAIAVFAGISAQVLAAYFRIPSIVLLLLLGILFGSDGIGLLHPHLLGTGVEVIVALATAIILFEGGLNLDLRELGRVSVSLQLLVTLGTLITLLGGSMAAHWLGEFPWNIAFLYASIIVVTGPTVVGPLLKQINVDRQVATLLEGEGILIDPVGAILAFVVLDTILNGDADPINAIVGLLIRLGVGAAIGGAGGYLMSLIFKRASFLSFELKNLVVLAILWSLFTLSQMIRSESGVMTTVVAGAVFANSSVPEERLLRSFKGQLTILSVSVLFILLAADLSIASVFALGWGSLFTVLVLMFIVRPINILLCTWNSDLNWRQKLFLSWVAPRGIVAASVASFFAISLTQRGINGGDSIKALVFLTIIMTVVCQGLTAGWVAKWLQITSKDVTGVVIVGCNPLSLLIARFFQERGENVVMIDTDPECLVQAEAQNLRVIASSGLDAAVLEEAGLASMGTFLAMTSNGEVNFVLAQRAAEEFKPPRVLAVFPRDPQASISVSNKVNQAFISDLAIKTWNEYLNDGRVKLGTTTLNELEFSTQCDRIQEKIRTGVLIPLLVEREERLQVMPVNQDWEIGDRIIYLLHDPRPSLLKRLSGATQSTPLSLEKLAEVEDLSLAQLSQLSTSEAPGG

SEQ ID NO: 4295 - protein, 291 aa, Azoarcus sp. EbN1
MSMKHPIIAVTGSSGAGTTTVKHTFAAIFHRERVNAAIVEGDSFHRYTRNEMNRLIEDAERIGQRGISHFGPEANLFEELENLFRAYGESATGRNRSYIHNEEESARLGLAIGTFTEWEDLPVGTDCLFYEGLHGGVVADKVDVARHVDLLIGVAPAINLEWIQKLHRDTKIRGYSMEAVQDTILRRMHDYVHYIVPQFSLTHINFQRIPIVDTSNPFIARDVPTLDESMVVIRFKDPRGVDFPYLLRMIHESQMSRANSIVIPGGKMDLAMQLILTPLIWKLMERRRQWV

SEQ ID NO: 4296 - protein, 338 aa, Azoarcus sp. EbN1
MTIKVAINGYGRIGRCTLRALYELGLRDQFEIVAINASGDLATNAHLTRYDTTHGRFATPVATEGDNLMIVGDDRIPFFSTKDPLAVNWGEFGVDVLLECTGAYASKAKAEVLLKQGAKKVLISAPGGDDVDATIVYGVNHDVLTRDMTVVSNASCTTNCLAPVAKVLQDNIGIEQGLMTTVHAYTNDQVLVDVRHKDLRRARAAAQNIIPTKTGAAKAVGLVLPALKGKFDGFALRVPTMNVSLVDLTFTASRATSKEEITVLMKEAANGPMKGVLAVNEEPLVSMDFNHDSHSSVFDATQTRVMDGTLVKVLAWYDNEWGYSCRMLDAARVFHQAK

SEQ ID NO: 4297 - protein, 540 aa, Prochlorococcus marinus subsp. pastoris str. CCMP1986
MSKFSSKNINKTKVPESPVVLAILDGWGHREENLDNAIKNANTPIMDSLWHAYPHTLINASGADVGLPNGQMGNSEVGHLTIGSGRIIQQELVRITNVVKNNQLTQVNELKEMANSIKKKKGTLHITGLCSDGGVHSHIDHLLGLIKWASEEHIEKVAIHIITDGRDTPAKSAYKYIRQIEDCIKKFKVGEIASICGRYWIMDRNLIWERTEKAFVNLTDPNGKKIDISPADYLNKSYNANITDEFLEPIRISKDFLKDEDSLICFNFRPDRARQIIKALSEKEFDNFKRKSIPDVDILTFTQYEANLPVKIAFPPESLNNFIGQIVSENGLKQYRTAETEKYPHVTYFFNGGVEVPSPGEQRHLIPSPRVATYDMAPEMSAEELTISCSNAIKTGQYSFVVINFANPDMVGHTGNMAAAIKAIETVDRCIGKIVNATGEMGGSILITADHGNAELMKGPDGEPWTAHTINKVPLIFIEGEKRKIPNMGNEIYLRENAGLADIAPTLLQLLNLPIPKEMTGKSLIKEIELKGFNKVVQHV

SEQ ID NO: 4298 - protein, 394 aa, Azoarcus sp. EbN1
MNVKKLADLDVAGKRVFIRADLNVPQDEAGNIVEDTRIRASLPSIRYCLERSATVMVTSHLGRPTEGECRAEDTLAPIAVRLGELLGKPVRLIRDWVEGGFEVRAGEVVLLENCRCNKGEKKDNEELAKKMAALCDIYVNDAFGTAHRAEATTHGIARFAPVACAGMLMGAEIDALTKATENPARPLVAIVGGAKVSTKLTILKTLAEKVDQLIVGGGIANTFLLASGKRIGESLAEPELVKEAQAIMDMMKARGAEVPLPVDVVVADEVSALARANRIPVDEVGPHDRILDVGPKSSAKLAEIIAHAGTIVWNGPVGVFEHNQFAGGTKMMASAIAHSEAFCIAGGGDTLAAIAKFHIAQDIGYISTGGGAFLEFLEGKKLPAIAALEARFAD

SEQ ID NO: 4299 - protein, 479 aa, Rhodococcus sp. RHA1
MSVLLVGVSHRTAPVPVLERVAVTDTDRPKLTDKLLASSHISEAMIVSTCNRVEIYAVVDAFHGALAEVGELLADHSGLDLTDLHRHAYVRYSEAAAEHLFAVASGLDSMVIGEQQILGQIRTAYASSDAQQAAGRTLHELAQQALRVGKRVHSETGIDSAGASVVSVALDRAAGIVGDGGLTGRTAVVVGAGSMGGLSVAHLTRAGIGRIVVVNRTKERAEHLADTARANGVEAEALELSELPAAMAQADVLVTCTGAVGAVVTLADTHRALAQPGRDAERPLVICDLGLPRDVEPAVSGLPGVTVLDMESLQRDPAAGAAASDADAARTIVAAELANYLAGQRLAEVTPTVTALRQRAADVVEAELMRLDSRLPGLDDPERDEVARTVRRVVDKLLHAPTVRVKQLASAPGGDSYAAALRELFELSPGSVEAVAKPTDLGGATDLSAIDITDGFIAGQDPRLRRFVTDDNHGKESQA

SEQ ID NO: 4300 - protein, 482 aa, Azoarcus sp. EbN1
MPRHTKIVATLGPASSDPQVLERMVHAGVDVVRMNFSHGKAEDHVARAEAIREAASLAGRPVGILADLQGPKIRVGKFAEGQVELQRDAGFILDARCELGNAERVGLDYKDLPKDVKAGDVLLLDDGRLKLTVTRVIGHEIHTVVKVGGTLSNNKGINRQGGGLTAPALTAKDMDDIKTAAKIGVDFVAVSFPKSAADMYMARQLMRASGVDALLIAKIERTEAVANLDEILDASDGIMVARGDLAVEVGDAAVPALQKKMIRAARDRNKLTITATQMMESMITSPVPTRAEVSDVANAVLDGTDAVMLSAETASGRFPVEVVEAMSRVCLEAEKSSDVALDRDVLNRVFTRIDQSIAMAAIWTAWHLKVKAIASLTQTGSTALWMSRLNSGVPIYALTPEASARNQMTLYREVFPLLMSQTHQDRDVLLWEAEQILIDQGVAERGDLIVLTIGEPIGASGGTNTLKIVRVGEHPPPHVTDQ

SEQ ID NO: 4301 - protein, 836 aa, Geobacter sulfurreducens PCA
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKYLDERFIVISGDLLTDFNLQKIIDFHEEKEALATITLTSVKDPLQFGVVITDKEKRISQFLEKPGWGEVISDTINTGIYVLEPEIFSHIPAEENYDFSQDLFPKLLEKQQSLFGYTAKGYWRDIGNTDSYREAHHDIFKGKVNVRIDEPKQDLVGKDLRLGSDVNLDEHVTLEGTVVIGDNSQVFESAHIKDTVIGRNCTIEAGVRLSRCVIWDNVYVKRGAKLNDSVLCGNVRVGNGVVMEEGVIVADDTSIGEESYIKRDVKIWPRKVIEAGATVTGNLIWGEKWKKALFEGALIKGLTNMELTPEFVAKLGCAYGTTLPKGSFVISGRDAYRSSRMLKRSFIGGLLSSGVNVRDLTMVPMPVLRYKLRSFGEVGGIQFRQALDDPASTEIIFLDGDGLDFSSSMGKNVERIFFKENFRRAHHTEPGGLTEIPQQVMDFYREGFLHAIGKTPLQKKAFKVVIDFNHSPASQLLPGILTQMGCEVISLNAYVDEERGVQALSDRGQSLSQLSKIVATLEANAGFWLDPTVEGVIMVDETGTVHEGADILLLMVGLALKAGEKGVFAIPVSAPSAIERMAQERGCAVTRTKSADRSMIEAALSSEVILAGSMDGRFAFPRFQAAFDGMFAIAKSIEMAARSGASISATAAEIPRRAFLHTRVPCVWDMKGGIMRKMSEDSLDKEASFIDGIKVHFGEDWALVLPDQYQPHVHIVAEARDPKAAQKLLTEYQKKVEQWKKELS

SEQ ID NO: 4302 - protein, 134 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4303 - protein, 195 aa, Physcomitrella patens subsp. patens
GESMWNDLKLFTGYFTCRDVDIPLTEKGVTEALSGGRVVSEIDFDIIFTSRLVRAKQTALIAMTQVALETASCWMVPVYADPALNERCYGDLQGLNKTAAIAEFGEETVTKWRRSYDTRPPNGESLQDTYTRSVAFFQATIEPRLKEGRNVFLVAHGNVLRCLISHIAGYSDLEMLQLQVFSVYLVPQSKYQNLC

SEQ ID NO: 4304 - protein, 215 aa, Physcomitrella patens subsp. patens
MESDEGHDRLLFAIAKAWKGLQGELLVQGDGDAPPAAAPALTLRSFSHGCSLISPLFGCLGIAFKFAEKDYVAKVHDLCEAAKEYDTLSVMVDQDIKNQTVRNGGSHTRNLLRVLRGVDMVRVLFEHILVTEGNSLKEPASKAYEQVFAPHHSWTIRKVVSAGMLMLPTKIQFLKKLNEEEDSAKGHIEEFVKSAGPVVQYVNNIYLNKELGTDW

SEQ ID NO: 4305 - protein, 397 aa, Burkholderia mallei ATCC 23344
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGPDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 4306 - protein, 744 aa, Gibberella zeae PH-1
MGSRQPAEQVGRPRRSLNEVNPNEGSTLQILRDMGIDKNIVVTEAPTEPFQLTFIDVTCLVVNRMIGTGIFDSPRTVMLGVQSPGIAILFWLCGCIYALSGAHVYVEYGLNVPRYVIDGIEQSVPRSGGDLHYLQYVFPWPRYKKGIVMLSGVLYGISFICIGNMAGNCINCALRLVEAANPQKEAGDLNGGTIRGIAIVIAIFPCLIHAFSRRGGILLNNLLAFIKVFMLIFMIIATWVVAGAPSGVRGIKANLGKPIDDPNLIGGKAHAQAFLAIIFAFSGFNQPNYVLGEIKHPRKTYPRSMWWGVILVSTLYMAVNICYMLVVPFFYIIFNPSAEDSKRYEIKRAVNAFLAISAFGNIVVMTYTAARMKQEIAKQGFLPFTSFLGRNRDVSLGRFLMWLQGGERKPTDQPVENRHQDTRKITGSRKPRNRFFKFLNPSNHLEETPVGALILHFTSCIVLILATYNTSASNAYAILSGLVAYLTSAFFGFFLSLGILILHFRGPPKTQPTLTLRHHQVPDQGPVQRSWAQMIQRSVNPNLSIVCGFLYLVGNFYPIITVWVPSKLFSEESLDWWKVPVISWSILGFSGLWFLGFIGVVKYKYLTSRRKFVYLSEPEFGPAESSENRHLSASCDDLSVGEGATRSGQGGLILLHETIYRGWEGIETDQMVSCIDDTADVVINPAQPMPVHGSEKRRPVDPPVDLYEDTDFPEFSQNRAPVQEPEIVYGSVQDHQNGGEQGRH

SEQ ID NO: 4307 - protein, 121 aa, Clostridium perfringens str. 13
MTKEQIIGALKEMSVLELNEVVKACEEEFGVSAAAPVAVVGGAAAGAAAEEKSEFDVVLTNAGANKIKVIKAVRELTGLGLKEAKEIVDGAPKTLKEAVAKEEAEDMKAKLAEVGAEVELK

SEQ ID NO: 4308 - protein, 305 aa, Ralstonia eutropha JMP134
MKADNILQTIGNTPHIRIRRLFGNGHEVWIKSERSNPGGSIKDRIALSMVEDAERRGVLKPGGTIVEPTSGNTGIGLAMVAAVKGYKLILVMPDSMSIERRRLMLAYGATFDLTPREKGMKGAIARAEELIASIPGAWMPQQFENPANIDVHARTTAQEILADFPEGLDALITGVGTGGHISGCAQVLKQKWPQLKVFAVEPTASPVISGGAPAPHPIQGIGAGFIPENLKTDLLDGVIQVDAEPAREMARRCAREEGILVGISSGATLAAIASKLPELPAGARVLGFNYDTGERYLTVEGFLPA

SEQ ID NO: 4309 - protein, 476 aa, Idiomarina loihiensis L2TR
MLRRTKIVTTLGPATDSEETLRELIKAGANVVRLNFSHGNGDDHKQRASMVRKIARELNAHIAILGDLQGPKIRVARFQQKQITLAVGDKFILDAALGKDSGNQERVGLDYKDLPTDVSPGDLLLLDDGRIQLKVEEIDGSQVKTEVTVGGVLSNNKGINRQGGGLSAAALTEKDLADIKLAAEINVDYLAVSFPRSGDDINQARHLLREAGGQGVLCAKIERAEAVASEHALDDIIRASDAVMVARGDLGVEIGDAQLVGKQKQIISRARQLNRVVITATQMMESMIENPMPTRAEVMDVANAVLDGTDAVMLSAETAAGKHPVATVKAMAEICLGAETHPTAQLRHQDLEEMFSSITEATAMSAMYAATHLNGVKAIIALTESGFTAKLMSRITSHLPIFALSRHPQSRDKSALYRGVYPIDFDSTSVSNPITEAIEVVKKSGHIKAGDLIILTHGDVMETVGSSNTCKMIEVR

SEQ ID NO: 4310 - protein, 726 aa, Arabidopsis thaliana
MERKTIDLEQGWDYMQTGITKLKRILEGLNEPAFDSEQYMMLYTTIYNMCTQKPPHDYSQQLYDKYREAFEEYINSTVLPALREKHDEFMLRELFKRWSNHKVMVRWLSRFFYYLDRYFIARRSLPPLNEVGLTCFRDLVYNELHSKVKQAVIALVDKEREGEQIDRALLKNMERYEEDFESFMLQDTSSYYSRKASSWIQEDSCPDYMLKSEECLKKERERVAHYLHSSSEPKLVEKVQHELLVVFASQLLEKEHSGCRALLRDDKVDDLSRMYRLYHKILRGLEPVANIFKQHVTAEGNALVQQAEDTATNQVANTASVQEQVLIRKVIELHDKYMVYVTECFQNHTLFHKALKEAFEIFCNKTVAGSSSAELLATFCDNILKKGGSEKLSDEAIEDTLEKVVKLLAYISDKDLFAEFYRKKLARRLLFDRSANDDHERSILTKLKQQCGGQFTSKMEGMVTDLTLARENQNSFEDYLGSNPAANPGIDLTVTVLTTGFWPSYKSFDINLPSEMIKCVEVFKGFYETKTKHRKLTWIYSLGTCHINGKFDQKAIELIVSTYQAAVLLLFNTTDKLSYTEILAQLNLSHEDLVRLLHSLSCAKYKILLKEPNTKTVSQNDAFEFNSKFTDRMRRIKIPLPPVDERKKVVEDVDKDRRYAIDAAIVRIMKSRKVLGHQQLVSECVEQLSRMFKPDIKAIKKRMEDLITRDYLERDKENPNMFRYLA

SEQ ID NO: 4311 - protein, 133 aa, Idiomarina loihiensis L2TR
MSEHDWSNRNEQEWREILGDEAYYVLREKGTERPFSGKYLSCDKDGVYHCAGCGQKLFEAGHQFDAHCGWPSFDEAIKGSIDYVKDSSHGMTRTEILCSQCGGHLGHVFDDGPTETGQRYCVNSLAMRHEDDE

SEQ ID NO: 4312 - protein, 195 aa, Vitis vinifera
MAYQHYRSPFGDTTFTKVFVGGLAWETPTDVMRRHFEQFGEILEAVIITDKNTGKSKGYGFVTFRDPESARRACVDPNPVIDGRRANCNIASLGRPRPSPPRGRNQGGNPYHAGASQGASSFSGVPAPLAPPPPPPPPPPPPPPMSLMQTCYHCYEENVGPIRQHSKLTFDRAPRTGPLSCVSLAFIQNGHNAIF

SEQ ID NO: 4313 - protein, 575 aa, Vitis vinifera
MVNRGLLILTCFFSFVIQLCLASKTRHFKWEVEYMYWSPDCMEGVVMGINGQFPGPTIRAVAGDTIVVELTNRLHTEGVVIHWHGIRQFGTPWADGTASISQCAINPGETFIYRYKVDKAGTYFYHGHYGMQRSAGLYGSLVVEVGEGQKEPFHYDGEFNLLLSDWWHKGSQEQEVALSSKPFRWIGEPQTLLINGRGQYNCSLAAHVTNSSSPQCQFRGNEQCSPQILHVQPHKTYRLRVSSTTALASLNLQIGNHKMVMVEADGNYIQPVAVDDLDIYSGESYSVLIHTDQDPSKNYWISVSVRGREPKTPQGLTILNYQTTSASKLPTSTPPVSPLWNDYNHSKSFSNKILALMGSPKPPTTYNRRIILLNTQNTINGFTKWAINNISLTLPPTPYLGAIKHRLSNAFDQKSPPENFPNDYDVMKPPTNTNSTYGNGVYMLEFRTTVDVILQNANALATGVSEIHPWHLHGHDFWVLGYGEGKFREKDAKRFNLKNPPLRNTAVIFPFGWTALRFVADNPGVWAFHCHIEPHLHMGMGVVFAEGVHLVKDVPNHALACGLTGKMLMSNYSHH

SEQ ID NO: 4314 - protein, 173 aa, Vitis vinifera
MTTSSSRIIEIQAKLSERALELLILPDDGVPRLLLDTGCGSGFSGKMLSENRHQWIGLDILESMLSVASMCDVDLLHEDMSQGLGLRPGVIEGANSISIVQWLCNVFFTSLYKYSVEGARVVFQVYPENVTQHELILGFAMGVGFSGGVVVDYPRIVLRVEKNTLSSFVAHPH

SEQ ID NO: 4315 - protein, 338 aa, Burkholderia xenovorans LB400
MNLQRFPRYPLTFGPTPIQPLARLSKHLGGKVHLYAKREDCNSGLAFGGNKTRKLEYLIPEVLAQGCDTLVSIGGIQSNQTRQVAAVAAHLGMKCVLVQENWVNYSDAVYDRVGNIQMSRILGADVRLVPDGFDIGFRKSWEEALESVRAAGGKPYAIPAGCSDHPLGGLGFVGFAEEVRQQEAELGFKFDYVVVCSVTGSTQAGMVVGFAADGRADRVIGIDASAKPAQTREQITRIARQTAEKVGLGRDITSEDVVLDERFAGPEYGLPNDGTLEAIRLCARMEGVLTDPVYEGKSMHGMIEMVRNGEFPEGSRVLYAHLGGVPALNGYSFIFRNG

SEQ ID NO: 4316 - protein, 271 aa, Rhodococcus sp. RHA1
MTRIAVIGGGKIGEALISGLLQAGHAVKDLVVAEQHPARADELAAAYAVRVTTPSDAAEGADVIVIAVKPGDVEAALTEVSKVELDGEREQLLVSLAAGIPTAFYETRLPAGFPVVRVMPNTPMLVGEGVSVLAPGRHVKKEHLELVRGVLSSVGKVVVVPESQIDAVTAVSGSGPAYFFLVAEAMIDAGVGLGLTRATASELVVQTMVGSAAMLDRSGESATELRAAVTSPGGTTAAAIRRLEGNGLRTAFFDALEAAKIRSAELGTSTE

SEQ ID NO: 4317 - protein, 328 aa, Klebsiella pneumoniae subsp. pneumoniae MGH 78578
MGQLVDGVWQDTWYDTKSTGGRFKRSVSAFRNWLTADGAAGPSGEGGFAAEKDRYHLYVSLACPWAHRTLIMRKLKGLEPFLPVSVVNPLMLENGWTFDDSFPEATGDTLYQHDFLYQLYLHADPHYTGRVTVPVLWDKKQQTIVSNESAEIIRMFNTAFDGLGARAGDYYPPALREQIDELNGWIYDNVNNGVYKAGFATSQQAYDEAVDAVFTSLERLEQILGQHRYLTGNQLTEADIRLWTTLVRFDPVYVTHFKCDKRRISDYLNLYGFLRDIYQMPGIAETVSFPHIRHHYYRSHKTINPTGIISIGPQQDLNEPHGRDQRFR

SEQ ID NO: 4318 - protein, 500 aa, Oryza sativa
  misc_feature (432)..(432): Xaa can be any naturally occurring amino acid
MYRIAGSHLRSLKRYSYSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALAKPLMAPQSAIHRLDSSILEEFIAENYTAPRMVLAASGVEHGELVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVAXSEDIGSQILTYGERKPIEHFLKDLEAITLNDISSTAKKIISSPLTLASWGDVIHVPSYESVSQKFFSK

SEQ ID NO: 4319 - protein, 357 aa, Geobacter sulfurreducens PCA
MAKKLFIPGPVDVHPEILQAMASPMIGHRMPEYAALHGRVTAGLKRVLATDGRVFLATSSAFGVMEGAVRNLVAKRCVNFCNGAFSDKWHDVTKRCGKEADAVKVEWGKPITPEIVDQALATGKYDAITLIHNETSTGVMSPLPEIARVLRNYPDVVSIIDTVSSMSALPVPVDELGIDCCIFGVQKAFALPPGLAVFTASDKALARARTVEGRGYYFDFLEFEANDEKNNTPSTPCISHIYAMDRQLERFFAEGLEQRWARHRQLAGMVREWVTDRGFGFFADEPYRSVTLTCALNTRDTDLARLKKMLGERGYAFDDGYGKIKGKTFRVAHMGDMQRTDLEEFLATADECLAELG

SEQ ID NO: 4320 - protein, 396 aa, Escherichia coli
  misc_feature (246)..(246): Xaa can be any naturally occurring amino acid
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSXNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4321 - protein, 375 aa, Nicotiana attenuata
MADANMGAGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLAKVFPHVNPLAIDLVDKMLTLDPTRRITVEEALDHPYLAKLHDAGDEPVCPVPFSFDFEQQGIGEEQIKDMIYQEALSLNPEYA

SEQ ID NO: 4322 - protein, 132 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4323 - protein, 428 aa, Zea mays
MRKKGRAVPEWLNSPIWSATPPAPAQPDPYGADLAPPPPPKPPPPPATASPVPPPPSYEQAVGVGGGRREEEDDEGAGAVIRAHLLSDFKAALSKKVVNMGELRRLACLGVPDGGTGVRPVVWKLLLGYLPTDRSLWTYELEKKRSQYSAYREEFLLNPSEKLRMIEETKLSRKKDTSIERIGFLSRFEVTNEEHPLSSGKSSLWNQYFQDSELLEQIDRDVKRTHPDISFFSSKSNQESLRRILIIFSKLNPSIRYVQGMNEVLAPLFYVFKNDPDPSNSASAEADAYFCFVELLSGFRDNYCKHLDNSSVGIRSTLSKLSQLLKRHDEELWRHMEVTTKVYPQYYAFRWITLLLTMEFSFNVCIHIWDAILGDPEGPSDTLMRICCAMLILVRKRLLAGDYSRRWSLYPFILKPGPWFISSSSLNG

SEQ ID NO: 4324 - protein, 381 aa, Bacillus anthracis str. A2012
  misc_feature (273)..(273): Xaa can be any naturally occurring amino acid
MERIYLDHAATSPTHLEVVEKMIPYMTETFGNPSSIHFYGRQTRHAVDEARRACARSIHANPNEIIFTSGGTEADNLALIGVARANRHKGNHIITTQIEHHAILHTCELLEREGFEVTYLPVDETGRVQVSDIQKALTEETILVSVMFGNNEVGTMQPIAEIGKLLKEHQAYFHTDAVQAYGLVEINVKEFGIDLLSISAHKINGPKGVGFLYAGTNVKFEPLLIGGEQERKRRAGTENVPSIVGLQHAILLAEKTREQKNAQYEEFKDIMVXVFQNEDITFEVNGNLEYRLPHVLNISFTGMNIEPFLVNLDLAGIAVSSGSACTAGSIDPSHVLVAMFGKDSDQIRSSVRFSFGLGNTKEQIEKAAYETVKIVKRLTQN

SEQ ID NO: 4325 - protein, 594 aa, Gibberella zeae PH-1
MAPRAAVARAAATKKSTTTTTAAAAKKDAKPTKAAAKKAEPAINGASKKRTRAEEQEVEEDEEEEVTRKTKKTKTTERVVKTATKPAAKAKTTKPAASKAKAKATSEEPEEKKPVAKAKTAKPAAAKKAEPKKKTSFPGIGKKINEAPTKILDVYVFGEGSSGELGLGSKRINNKKPIDVKRPRLNDNLAAATTGVVQISCGGMHAVALTHDNKILTWGVNDQGALGRDTTWDGGLRDMDSAEDSDSDDEDDSGINPKESTPTAVDDEFFAPGTKFVQVVASDSASFTLTEDGRVYGWGTFRSSDGILGFSETIKIQPTPLLIKDLKNIKALSAGSNHILALDHKGNVVAWGCGQQNQLGRRIIERNKMSSLIPQGVGLPRGKIAKIACGSYHSFAIDKEGVVYGWGLNNFGEIGVESNAGEDDAVILRPAKLTYLDDYNITEIDGGEHHSLACSDKGDLLTWGRVDGYQVGFEFDKLSEENSIYDERGNARILFKPTIQPDVKDIVSVAAGTDNNFAISSNGTVYSWGFSSNYQTGQGTIEDIHTPTLIDNTAIRGKKIIGAGAGGQYSVLIGEAEDVPQTNGAATNGTDDKA

SEQ ID NO: 4326 - protein, 736 aa, Zea mays
MSSGGPPRKRNFKIEAFKNRVDLDPKYAERTWKVLEHAIHEIYNRNASGLSFEELYRSAYNMVLHKYGEKLYDGLQSTMTWRLKEISKSIEAAQGGLFLEELNAKWMDHNKALQMIRDILMDMDRTYVPTSHRTPVHELGLNLWRDHIIHSPMIHSRLVNTLLDLIKRERMGEVINRGLMRSITKMLMDLGPAVYQDDFEKPFLDVSARFYSVESQEFIVCCDCGNYLKKAERRLNEEMERVSHYLDAGSEAKITSVVEKEMIANHMHRLVHMENSGLVNMLVDDQYKDLGRMYSLFRRVPDGLSTIRDVMTSYLRETGKQLVIDPESLKDPVEFVQRLLNEKDKHDKIISVAFGNDKTFQNALNSSFEYFLNLNSRSPEFISLYVDDKLRKGLKGATEEDVEVILDKVMMLFRYLQEKDVFEKYYKQHLAKRLLSSKTVSDDAERSMIVKLKTECGYQFTSKLEGMFTDMKTSQDTMQDFYAKKSEELGDGPTLDVHILTTGSWPTQPSPPCNLPTEILTVCEKFRAYYLGTHNGRRLTWQTNMGTADIKATFGKGQKHELNVSTYQMCVLMLFNNADGLTYKDIERDTEIPASDLKRCLQSLACVKGKNVLRKEPMSKDISEDDTFYFNDKFTSKLVKVKIGTVVAQKESEPEKQETRQRVEEDRKPQIEAAIVRIMKSRRVLDHNSIVAEVTKQLQARFLPNPVVIKKRIESLIEREFLERDKVDRKLYRYLA

SEQ ID NO: 4327 - protein, 151 aa, Zea mays
MTPRQIQCIKRYYYLKSSSTSQKCCAVNHIVHWRIVDMFFWHSVEISINDDEWNDGLLATIREKVHMEADRKAMSNQVNVPADLSFQSRTTYRIRNKVACAPQIIAFFIALYLNLRNIYTGCCHNQYICQTITADVMYGQAYVRRSRAKAA

SEQ ID NO: 4328 - protein, 229 aa, Listeria monocytogenes EGD-e
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNADLKPVNKYYLDK

SEQ ID NO: 4329 - protein, 133 aa, Saccharomyces pastorianus
EFTEVAVPEILEKEAGATTAVGPALTTSSPAPSYIELIDPGVRNIEIYAEQYSRPLYRVGLFFSLFLIAYAYGLDGSVRYTFQAYATSSYSKHSLLSTVNCIKTVIAAVGQIFFARLSDIFGRFSILIISVIF

SEQ ID NO: 4330 - protein, 306 aa, Oryza sativa
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPQFAHCKNSSSLLLFNFDKSKVLAPLPIGFAVFMVHLATIPITGTGINPARSLGAAVMYNNSKAWSDQWIFWVGPFIGAAIAALYHQVILRASARGYGSFRSNA

SEQ ID NO: 4331 - protein, 411 aa, Roseovarius nubinhibens ISM
MSDFIDKARAAERAMREVFPETPLLRNEHLSERYGANILLKREDLTPVRSYKLRGAFNAMRKVMARGEAPVFVCASAGNHAQGVAFMCQHFGVRGVIFMPVTTPQQKIGKTAKFGGESVEIKLIGDYFDDTLAAAQAHCAQIGGHFLPPFDDEDVIEGQASVAAEIEAQLGGLPDEIVMPVGGGGLSSGVRSYFGDRVGITLVEPEGGACLNAALAAGEPVRLAQVNNFADGAAVAQIGEKTFARLRDLDPARSRLVCEDRLCTTMIEMLNIEGIVLEPAGALSVDVLKDMRDEIAGKTVVCVTSGGNFDFERLPEVKERAQRHSGVKKYFILRMPQRPGALKDFLSILGPEDDIARFEYLKKSARNFGSVLIGIETGHAENFARIEAALKAQGFAYRDITKDEVLAEFLI

SEQ ID NO: 4332 - protein, 255 aa, Dechloromonas aromatica RCB
MSFDRERRFGGITRLYGVEGAERIQQANVCIVGIGGVGSWIVEALARTGVNRMTLVDLDMVAESNTNRQIHALGDIYGKAKVEAMAERVRAINPDCAVTCIEDFVTPENVGQIFEQQFSVIIDAIDQVRAKAAMIAFCRRQKIPIIIAGAAGGQIDPTQVRVADLSQTVQDPLLAKVRSLLRREYGFPKDTKKKFGVSAIFSTEHLRYPDKNNNSCEADRGPTGLNCAGFGSSVCVTSVFGMAAAAQAINLITTP

SEQ ID NO: 4333 - protein, 527 aa, Myxococcus xanthus DK 1622
MAIPIQMPSLSPTMTEGKIVKWLKKQGDKVSSGDAVAEVETDKSNLEIEAYDDGYLLQVLVGEGEMAKVGAPIAYIGAKGEKVGAGKQVAPAAAPPEQKPQPAPAAPAPQAAAKPASSGGGDNRIAIQMPSLSPTMTEGKIVKWLKKQGDKVSSGDAVAEVETDKSNLEIEAYDNGTLAEIVVGENQMAKVGAPIAYLTAKGAKAAPAAPAAQPKPPAPAPEKPAAAKPAAAPAQAGGRRLRASPVAKRIAREKGLDLTQVSGSGPSGRVVKRDIEEALARGPAAVPAAKKAPAAQPAPGVRPEPTVLPLSSMRKVIAQRMTEVKPGVPHFYLTIEVDMEAASKVREEAKAMDLKVSVNDLIVKAVAMAVRRYPKINVSLQGDKVVQFHSVDVGIAVALEEGLITPILRDADQKGLQAIASGVRELAERARKRALKPEEYTGGSITVSNLGMYGIDQFVAVINPPQASILAVGAVSEKAVVRDGQLAVRKMMTATLSCDHRVIDGAIGAEFLRELRGLLEHPTRLLF

SEQ ID NO: 4334 - protein, 397 aa, Bradyrhizobium sp. ORS278
MITPGRHRPLVHSAWGERAVRAAIDEIVADAIARFDPDQFWPAHPSDDGKTDGDPSFYTGAAGVIWALDYLHRIGATDARADFRPVLLRLMERTVIDHATHAPADYDKHGSLLRGEMGAALLAMRLAPASPLADLVHWHAEKNNALPIRELMWGLPGSMIAAVHMARMTEDDRWRRLFDVQAARLLSELEDTPQGPLWTQDLYGAKDRFLGPVHGFAGNVIPLLLGWDWLTGAQQAHVADFVPKALEANAWRYDIGTTWGHRSKREKRLFICQHCHGAPGMVTTFADAPFTSPEFEALLLDGGRFTWTAGPLSKGPGLCHGTAGNGYAFLKLYRRTTDPMWLDRARQFAMTAIVQCRGARMAAGRGRYSLWTGDVGLAIYLWHCITGDGRFPTIDVF

SEQ ID NO: 4335 - protein, 187 aa, Burkholderia xenovorans LB400
MPIINSQVKPFKAQAYHNGEFVTVTEESLKGKWSVFVFYPADFTFVCPTELGDLADRYAEFQKLGVEIYSVSTDTHFTHKAWHDTSDTIQKIKYPMVADPTLAISRNFDVLIEEEGLALRGTFVINPEGEIKVAEIHDNGIGRDAGELLRKVQAAQYIAAHPGEVCPAKWTPGAETLTPSLDLIGKI

SEQ ID NO: 4336 - protein, 251 aa, Rhodococcus sp. RHA1
MNGMSTGTLVLLRHGESEWNALNLFTGWVDVHLTDKGIAEGKRAGELLLEHNLLPDVLYTSLLRRAISTANIALDTADRHWIPVIRDWRLNERHYGALQGRNKAQVKEKYGDEQFMLWRRSYDTPPPPIEAGSEYSQDTDPRYANLDKVPLTECLKDVVVRLIPYWEDTISADLKAGKTVLITAHGNSLRALVKHLDGISDEDIAGLNIPTGIPLRYDLDENLKPLNPGGTYLDPEAAAAGAAAVANQGGK

SEQ ID NO: 4337 - protein, 316 aa, Klebsiella pneumoniae subsp. pneumoniae MGH 78578
MNVTICTIGELLVEFLAKEENQGFSRPGEFWGPYPSGAPAIFADQVAKLGFGSVLFSCVGNDAFGEMNIARLEKDGVNVNGIAMLQKATTGSAFVSYRSQAQRDFIFNMPNSACGLLTADHIDEALLNQCQHFHIMGSSLFSFRIIDAMRKAIENIKGRSGTVSFDPNIRKEMLNIPEMSQAFEYILDYTDIFLPSDGELDYFGLNPERNEQVLVDKLLKRGVKHVVIKRGPRGASYFSANETHHVAGFSVPVVDPTGAGDCFGATFVSLFLNGATPREALRWANASGSLAISQRGPMEGTSTQAEISAFLAAQHP

SEQ ID NO: 4338 - protein, 424 aa, Oryza sativa Japonica Group
MQNYLKCEVWILYIILASQFHAIGVFSVTTCLYEYRGEFLLFKYADMMRFSRNMEQNSKSTNMTYDRRSIQEWFSAGNQICPQTQQVLSHTIVIPNHLVRTMISQWCTENGLTLPEIENQEQDHVTNSEEKTFDEIFVKITSSANSGGRKQAIKDLRLLTKRNSEFRAVLGQRPDSIAQMILARSTPGLQNDPQVLEDMVTIILNFSIHDSNKKIIGDDSEAIQFLIWALKSGDMGSRSNSAAAIFTLSALDSNKEKIGKLGAMDPLIDLLEHGSIIAKKDAASAIFNLCLLHENRSIAARSGIVDVAMRAIDDQSLVEESLAILALLSRNQEMVEIITEFNGTASMLRSIRESECKRSKENAMVVLFAICTYNRTKLKEVEADESINGSLTFLAQTGTQRARRKASGILEKMKRTMHNRHCSC

SEQ ID NO: 4339 - protein, 463 aa, Physcomitrella patens subsp. patens
MAGPPGAGGGSGQKRGRPATANAGNSANHVGHVENATAGAAHQPSPGPNLGPSLQVSHNFAEQHTKRIVMALQSGLKGELAWAINALTLLSFKEKDDTRKDATPLAKVPGLLDSLLQVISEWRDIAHERMFAKLSRPRLLGADQPYTGFGLEHEIYIPDDALLHVRAAAERNAQGADATETKEGWCWDEEGLFNLDEIGRHEKQICAVAVSNVLRNMSFMPENESFMAQHRGCLETLITVLEDHETEDEELVTNSTETLLNLAPFLCLKIFTNNGNNKANNPGSSMSDKRMIDAIMTMLSSPLISWHCNAAELLGRLVVNPDNESSILPFVPLIFPRLVELISTEVSGDALAAAVAALLNFSEINTDCRLRLAGERWAVGRLLRVVGSWNHHPQEVCRKAALTLESLASEPQNRIVLLAYESLIAELAVVDQRMSDVFARILWELSSGVSSKMGSIRGVWGSA

SEQ ID NO: 4340 - protein, 280 aa, Listeria monocytogenes str. 4b H7858
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDKIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 4341 - protein, 424 aa, Oryza sativa Japonica Group
MNALAATSRNFRQAPRLLGLESKLEKSLLIPFPEIKVKRGRSVTPLSVQVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 4342 - protein, 933 aa, Oryza sativa Japonica Group
MEERSRWESECGREMWALRYGVRRENRYIWPKSTRFGASSIFGGLNAVSVGGPFSSRICHISDGGPDEGSPGDALRRVRGFWWWWGQCGGRWMGIPEVVVPPRAAGPRRYKGLVPWRFQPGFVRPPPVKPPAAAAAVAGGGVAGTPGGKGRGLGASGEGVGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 4343 - protein, 488 aa, Hedera helix
  misc_feature (111)..(117): Xaa can be any naturally occurring amino acid
GVSTLEKKNLGNITQIIGPVLDVAFPPGKMPNIYNALVVKGRDTVGQQINVTCEVQQLLGNNRVRAVAMSATDGLTRGMEVIDTGAPLSVPVGGTTLGRIFNVLGEPVDNXXXXXXXTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRRLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 4344 - protein, 173 aa, Oryza sativa Indica Group
MAILLLALLMPATLCSRSGPPSSKHGHGGHAKRAPPPASPVVPVAPQAAALVRATCNSTAYYDVCVSALAADPSSTTADALLRACAGKYGDARDALAAAKESMGQQDYDLATVHVSAGAEYPQVCKALFRRQRPGAYPAELAAREEALNKLCAVALDIIALLTSSPASNNNNS

SEQ ID NO: 4345 - protein, 190 aa, Candida albicans SC5314
MSISFMLPDPDSAIIWRGAKKNGLIKQFLKDVNWGEKLDYLVVDTPPGTSDEHLSVTTYMKEVGIDGALIVTTPQEVALLDVRKEIDFCRKANIKILGLVENMSGFVCPNCKGESQIFKATTGGGKKLCEELGIPFLGSVPLDPRIGKACDMGECFFDSYPDSPAATAILDVVDALRDQVELSLENLAIK

SEQ ID NO: 4346 - protein, 138 aa, Candida albicans SC5314
MSPSQTQIEKSQLAAPEPEHCPGPESELAGQGDACKGCANQEICSSQTVKGPDPDLPIITERLSAIDHKILVLSGKGGVGKSTFTSMLAWAIAADEEIEVGAMDLDICGPSLPRMLGAEGESVHQSNSGCHQYMSRII

SEQ ID NO: 4347 - protein, 213 aa, Oryza sativa Indica Group
MAILLLALLVPATLCSRSGPPSSKHGHGGHAKHAPPPASPVVPVAPQAAALVRATCNSTAYYDVCVSALAADPSSTTADVRGLSAIAVSVAAANASGAAQAAAALANGTAPLAAGDGTVQALLRACAGKYGDARDALAAAKESMGQQDYDLATVHVSAGAEYPQVCKALFRRQRPGAYPAELAAREEALNKLCSVALDIIALLTSSPSPSNNS

SEQ ID NO: 4348 - protein, 176 aa, Herminiimonas arsenicoxydans
MNRSSQDSDWQADVQRYGLRRPFLKEQSIWAVWSYRFGRRVDRMQSGLAKKVLTSFYWLWFRLLETAVGISLPKAAVIGPGLRIWHFGGIFLHPDVRIGANCTLRQGVTIGNRVADGPVPVIGDDVDFGAYAQVLGGVRIGNGCHIGALSVVLCDVPDGATAVGVPARVILKSGVQ

SEQ ID NO: 4349 - protein, 482 aa, Vitis vinifera
MGRRQKPKAKIDHQEDEEGANSSRSVIYLSSSDDEEANEDLSLKIVEKAMKRASKTDHNDAVLAGRSAVIDLGSSPSEEAEVITDRSGPTTDDDAEVKSKKKKSRKEKRANKNIENQEKTDEILMEEKKGESDKALEILKMVEPYPVEGSDNIVLRKLLRGPRYFDPPDSGWGACYNCGEEGHNAVNCASVKRKKPCFVCGSLEHNAKQCMKGQDCFICKKGGHRAKDCPEKHRSGSQNSKICLKCGDSRHDMFSCRNDYSPEDLKEIQCYICKSFGHLCCINYVDTGPIEPSCYKCGQLGHTGLACARLNAETADVQTPSSCYRCGEQGHFARECKSSTKVSKRYSEVSTQSRRFLKEDKDKLGFKSAPKDLGMGRKRKKPWYEERGNITPRKPKQRGGWITEDPGDSPQRKAKVKSWRSPATPTNKNHKRPMLTAGHYTSSQSSKNTQKLLSIDFLQIQSCSFACALVRARFLAFSPCSC

SEQ ID NO: 4350 - protein, 286 aa, Roseovarius nubinhibens ISM
MTVYCLGSINADVTYRVARLARPGETIVAQEMRRGLGGKGANQSVAAARAGARVVHIGMVGAEGDWCVAELASYGVECRHVAQDAGPSGHAIIHVDAKGENVITVFAGANARQDLARIDAALGQAGPGDWLLLQNETSHQQEAAQLAQVRGVQVAYSAAPFEAEALRRVLPYVSLLLLNEGEFVALGAAGIALPADCATLVTQGAAGAEWRQGEARLQQRGFAVEAVDSTGAGDCFAGYVVAGLEAGRGPEEAMALAAAAAALSVTRPGAAGAVPDRAEVERFLSP

SEQ ID NO: 4351 - protein, 772 aa, Roseovarius nubinhibens ISM
MSWGRGADKDWETDLLEQANDMSKPKFTREEALAFHLEPTPGKFEITATVPMTTQRDLSLAYSPGVAVPCEAIAAAPETAYDYTNKGNLVAVISNGTAVLGLGNLGALGSKPVMEGKAVLFKRFADVNSIDIELDTEDPEKFIEAVRLMGPTFGGINLEDIKAPECFIIEQRLKEVMDIPVFHDDQHGTAVICAAGLINALHLSGKKIEDVKIVLNGAGAAGIACIELLKSMGARHENCIVCDTRGVIYQGRTDGMNQWKSAHAVKTELRSLEEAMVGADVFLGVSAKGAVTQEMVKSMAKDPVIFAMANPDPEITPEEAHEVRSDAIVATGRSDYPNQVNNVLGFPYLFRGALDVHARAINDEMKIACAEALARLAREDVPDEVDMAYGRKMSFGRDYIIPAPFDPRLIHTIPPAVARACMDTGAARRPIVDMEAYELTLKSRMDPTASMLRSINARARAAQARMIFAEGDDPKVLRAAVQYQRAGFGEALVVGREADVKAKLEASGLGDAVSELQIVNAANTEHLAEYKAFLYKRLQRKGHDRHDVHRLAARDRHVFASLMLAHGHGDGLVTGATRKSSHVLDLINHVFDADAEHGAVGVTAVMHKGRVVLIADTLVHEWPDETDLANIAERSAGVARHLGLEPRVAFVSFSTFGYPRSERSEKMHLAPNVLEARGVDFEFEGEMTVDVALNLQAQKSYPFQRLTGPANILVVPARHSASISVKLMQEMAGATVIGPILAGVDKSIQICSSTSTANDILNMAVLAACKVG

SEQ ID NO: 4352 - protein, 139 aa, Astragalus membranaceus var. mongholicus
TAIGVYLEENAIASLAPKWKGKTPAELIQSLDFYRDIIKGPFEKLVRGSKLKKLDGNEYVRKVSENCASFIKSEGIHSEAEEKAIEEFREAFKDRVFPPGSTVFYRQSPAGELGLSFSKDETVPEHEHAVINNKAPSDA

SEQ ID NO: 4353 - protein, 182 aa, Listeria monocytogenes
EERGFRQVTGFKLGPWNYRFGRRQKKAFVESVRRALYFSKMACYAQGFAQMRAGSEEYNWDLQYGEIAKIFRAGCIIRARFLQKITDGYNQDKNVKNLLLDPYFKDIAHNYQGDLCTVVAEAVKAGIPVPTFTAAISYYDSYRSEVLCANVIQAQRDYFGAHTYERVDKPGVFHTEWPQVED

SEQ ID NO: 4354 - protein, 496 aa, Mycobacterium sp. JLS
MTTVAERVDNAGDHERLLTALQRQRSAFRAEGPPTAAVRRDRIDRLTALMLDNADAIVDAMAADYGTRPRPGALFTEIMGALPVIEHTRSHVAKWMRRTTLLRPARLAGLRAEVEPVPVGVVGIVGPWNFPVNLVVLPAAAAFAAGNRVMIKMSEITAHTAELLEARAPEYFDAAELTVVTGGPDTAAAFTALPFDHLFFTGSPAVGVHVQRAAAANLVPVTLELGGKNPAVVGPRADLRRAAVRIAQGRMVNGGQVCVCPDYVLVPEYLVDEFSATVLATWRRMFPSITGSEDYCSSVNDANFDRVVGLIDDARAGGARVNSVVPPGETLPDRRSRKIAPTLIRDVTPTMRIASEEVFGPVLSVLGYSTTDEVIDHINSRPAPLVAYWFGPDDQDFRTFVRRTRSGGVARNDFAAQMIPSDAPFGGVGRSGMGAYHGKAGFDTFSHHRSVVGSDLPFSITGSAAPPFGAAMRRSTEFRLRMARRRNHRRLRRSHG

SEQ ID NO: 4355 - protein, 971 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 4356 - protein, 434 aa, Geobacter sulfurreducens PCA
MNIVVVGLSHKTASVEIREKIAFAPTQMEKPLRMLIAIDDIAEAVIVSTCNRVELYASTRDVAGGMARLKRFLGDYHGVPVEVLEPHLYSHHGEAAIRHVFRVAASLDSMVVGEPQILGQIKTAYGYAAEFRTSGIILNRFLHKAFSVAKRVRTETKIASSAVSVSFAAVELARKIFGDLSDKTVMLIGAGEMCELAAKHFLNNGARGVMVTNRTYERAERLAEEFEGKAIHFEDLFDQLHKADIVLSSTGATHYIIRPKDIDEVIRRRKMKPMFFIDIAVPRDIDPKVNDVENVYLYDMDDLQNVVASNLQQRAEEAKKAEGIIEEEIGQFYKWISSLEVTPTIVALRSKFEDVRRAELEKTLSAWKDLPPDGAKRLEALTAAIVNKLLHPPTATLKRTGQGGRTDLYVDALRTLFDLQTELPEPEGSLELEE

SEQ ID NO: 4357 - protein, 158 aa, Oryza sativa
  misc_feature (82)..(82): Xaa can be any naturally occurring amino acid
YPNRQKYPYFYPSSTSVGDQRRRDSWSAAGAARGRVFVTGGVRAGYDPAVTRSGALWDPAASPPTAAWEPILPLRDGRFSRXAVCSGGKVCMVNLRSRNAKERLVFDLRADRWKDMPPRMLAGWKGPAAASPLDNGETIYVLDEERGALTAYDWGTAR

SEQ ID NO: 4358 - protein, 693 aa, Physcomitrella patens subsp. patens
MATLKVRVRAASGGPTLRVQLQQPCTLQALKDAIALQIEKSASSFEISLNKKDPISGPPDLLLSAFGVINGDLVFYIPSTGSSVSDSLKNPRIPTRLHRSAQGCIGQHFKNLFFPDLRNFAKIALFMQGRVSLKNLEPAVEVTVLLVITCEYVCTFCTQSGAPASFNVLRNASPHSTPTSIGSSGSNLGSPSDIQSTSSNKNKTLDPSSLRRELCAAAALQRTTLSQPEASSSDLRASPTNDAEESRLTSGDSATCSRGEELKPHSAKGKDKMDSTIASASGNEVTEMEIEEDEHCLTESLSSQKSYSSLPDLLQRVLQHEHGKVKERQAFLVLAIHAVMLETGFVLQHPTDAVGSSDRCGLPVDWSGKGGLANLTYTLPEITTAASASAQTSAVGDALLRCQFIGNFLVVYGAVTGGQGSEVYRLSLPVSRYLQKDFVVEDKDNTRDALKNLAKDGEEIKEGATPMECLTSEGIVTPSKVDMFCNVFELWQQVKDNLSLPLLTCICEKAGLQPPASLLLLPTELKIKLLENLPAAALATLCCVCSELKFLASSEELWKARFKAEFKSDATRAPGGRGWKVAYARELARKRRREEDRRVFERQLRSEPFLPLLMRPPPVIPHFPGVLGGDYDRFPALGNIGGFRPRSPGGAYWSTNYSGANGIGEPDELSLPGQGVGRGSLGRGRSGRSTHFW

SEQ ID NO: 4359 - protein, 483 aa, Austrobaileya scandens
  misc_feature (242)..(242): Xaa can be any naturally occurring amino acid
EEKNLGRITQIIGPVLDVAFPPGKMPNIYNSLVVKGQDTVGQQINVTCEVQQLLGNNRVRAVAMSATDGLMRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVSGGVGERTREGNDLYMEMKESGVINEQNIAESKVALVYGQMNEPPGARLRVGLTALTMXEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLEVESKLKK

SEQ ID NO: 4360 - protein, 255 aa, Geobacter sulfurreducens PCA
MSLHRFSRTEILIGPEGLQRLHGSTVAVFGLGGVGSFAAEALCRAGVGRLVLVDFDDICLTNVNRQLHALDGTVGRAKVQVMAERLRLINPQADIVPHKDFYEAANSDFLLSGGHDYVVDAIDHITSKLHLIRSCKERGLPIVSSMGAANKLDPARIRVADIAQTSTCRMAKVVRKLLRKQGIKNGVKVVYSTEEYREQAMPDAGCRSDCICPNKEEQRFSCEHRRTILGSISFIPSIFGLTMAGVVVNDLLEPR

SEQ ID NO: 4361 - protein, 565 aa, Physcomitrella patens subsp. patens
KEGNAAKYITRNKALNRLQIKLPEFRRLCILKGIHPREPKKKVEGHNKTYYHVKDIAFLAHEPLLNRSRELKAYEKKIVKARAKRNFDLVERLLGRKPEWNLNHLVKERYPSFVDALRDLDDPLTILHLFAWLPADNSQKIRPEHIESARKLSLQWQAYCIRVRALRKVFVSVKGVYYQAEVGGQNITWLTPHCTSQVLPSDVDFRVMLTFLEFYKTLVGFVNFKLYHELGLRYPPILDDKLEKAANELYGLMKGLASAAPVIEDTPKTDGGDNDTEMAEEDPRAVESQARLASLHSRLLAIDTEQESPVLNTEATKEPEDEDLDPSVNIFKGSKFFLGREVPREALLFVIRSFGGTVSWDGEGAPFPESDEFITHQIVDRPTQGHKFLSREYVQPQWIFDSVNNKFLLPTDAYLVGKICPPHLSPFVDAEAEGYMPEYAETIKRMQAATSDDLPIFEKPDDANAATETSKTDVNVKLEKSFTQDLSKEIAGISYSASLKRKAETAPEEDDQKSDAAPAVVPEADEAVRMGRMMMTRKARGLYDAAKMGQAKKAAKIELLKERKK

SEQ ID NO: 4362 - protein, 301 aa, Gossypium barbadense
LPLTMTAACGVDCANLKSAFFLDVIFIAVTTYVSVLAAKEVPLGSVEMSTASHEERPEHSGGNAEEAFLWELFGTFRYFSGTIWIILFVTALNWIGWFPFLLFDTDWMGREIYGGQPNEGANYNSGVRMGAVGLMLNSVVLGITSVLMEKLCSKWGAGFIWGVSNIVMALCFLSMLILSYVTDHMDYIGHDLPPAGIMIAALLIFSILGFPLAVTYSVPYALISTRIESLGLGQGLSMGVLNLAIVIPQVVVSMGSGPWDELFGGGNSPAFAVAGVASLTSGLIAILAIPRSSPQKIRALP

SEQ ID NO: 4363 - protein, 187 aa, Enterococcus faecium
GIEYGDMQLIAESYDLMKNILNLSVEEMADIFKEWNQGELDSYLIEITADILTRKDDEGTGKPVVDVILDAAGNKGTGKWTSQSALDLGVPLPLITESVFARYISAYKEERVQASKILSRTNDFEFTGDKKELVEKIREALYFSKIMSYAQGFAQLRVASKEFDWDLPFGEIAKIWRAGCIIRARFL

SEQ ID NO: 4364 - protein, 339 aa, Herminiimonas arsenicoxydans
MKILVTGGAGYIGSHTCVELINAGYQVVVVDNLCNSKASVLERVAGITGATIPFIQADLRHRNAIEKIFTQYNFDAVMHFAGLKAVGESVTEPLRYYDNNVEGSLVLLQVMAKHDVTKLVFSSSATVYGDPATVPILEDFPLAATNPYGRSKLMIEEMLRDLAHSDPAWRIALLRYFNPAGAHESGLIGEDPNDIPNNLFPYVAQVASGRRDLLSVYGDDYPTDDGTGVRDYIHVVDLAIGHVKTLEKLLASAAGVQAYNLGTGCGSSVLQMIQAFERASGRRVPYRVVARRPGDIAVCYADASLAQRELGWRAERSIEQMCVDTWRWQSMSEERFAYA

SEQ ID NO: 4365 - protein, 391 aa, Herminiimonas arsenicoxydans
MKAMILAAGKGTRVQPLTYELPKPMIPILGKPVMEYLVEHLVKYGITEIMVNVSYLHQKIEDYFGEGQRFGAQIGYSFEGYMTDDGEVMPKPIGSAGGLKKIQEFGGFFDETTLVICGDALIDLDIKSALFEHRQKGALVSIITKEVAPEKTVDYGMVVTDEEGRVLSFQEKPKPEEALSNLASTGIYIFEPEVLELIPSGEEFDIGSQLFPLLVEKGVPFFAQKRFFNWIDIGNVKDYWAVSQSVMLGEMAHMTMPGTQIAEGLWVGLNTSIDWEGTTIEGPVYLGSGSTIEAGSTIIGPTWIGHGSQICSGSKVERSILFAYTRVSPHSSMSELVVCTEYCVSREGKMRHVSDCVQDSWRDARDRRGQTRPAASSATPDTPVRKLEDAA

SEQ ID NO: 4366 - protein, 436 aa, Herminiimonas arsenicoxydans
MLQETVLRVAGWPEIAPPLIVCGDDHRFLVAEQLRQIDSKPTAILLEAEGRNTAPAVAAAANYLLARDPDALMLVLPADHLIIDADAFHEAVLVAAHAVGKHALATFGILPSAAETGYGYIRRGAAIDRSETCFAVERFVEKPDLATAQAFLADERYSWNSGMFLFRADTYLAELERLQPEMAACSKAAVQDAYSDLSFCRLHEAAYAACPSQSIDFAVMEHTQQAIVIPADIGWSDIGSWSALSEMQDGNAQGNVLQGDVYADNVQNSLIRAESRFVSVIGLDNVVVVETRDAVLIVNKDQVQRVKNVVDFLKQKNRCEHLNHTRVYRPWGSYEPIDAGERFQVKRITVDPGEKLSLQMHHHRAEHWVVVTGTARITCGETVRLLTENESIYIPIGMTHRLENPGKMPLHLIEVQSGAYLGEDDIVRFDDVYQRA

SEQ ID NO: 4367 - protein, 411 aa, Yersinia pestis CO92
MAELPAKRRFTRIDRLPPYVFNITSELKMAARRRGEDIIDFSMGNPDGPTPPHIVEKMCSVAQREDTHGYSTSRGIPCLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 4368 - protein, 518 aa, Funaria hygrometrica
RSSTKKSRKERRPNPFAQDGYHGNLQILKNQPKARILDKYVLGRELGRGEFGITYLCTDKETQEIFACKSISKKKLRTAVDVEDVRREVAIMKHLPEHPHVVTLKGAYEDDNAVHLVMELCEGGELFDRIIARGHYTERGAAQVTRTIVEVVQACHRQGVMHRDLKPENFLFANKNENSPLKAIDFGLSVFFKPGEKFSEIVGSPYYMAPEVLKRNYGPEVDVWSAGVILYILLCGVPPFWAETEQGVAQAILRGILDFKRDPWPKVSDSAKSLVRHMLEPDPKARYIAQQVLDHPWLQNAKKNPNVPLDAVRSRLKQFSAMNKLKKRALQVIAEHLGGEEIDGLKEMFEKLDSDNTGAITFEKLKMGLIEIGSQLTEHEVRLLMEAADVDGNGTLDYGEFVAATVHLQRLDDDEHLRRAFDVFDVNESGFIEVEELREAVGQSLMGSPSESDVVQAILSEVDLDKDGRISYEEFAVMMRRGTDWRKASRQYSRDRFNSLSMRLLRDGSLNPPSYSMR

SEQ ID NO: 4369 - protein, 174 aa, Enterococcus faecium
LYLGNRHARVEGETYYEFIDQFVQSATELFPELLLHWEDFGRGNAAAILEKYEDQITTFNDDIQGTGIVVLAGVLGGLNISGEQLKDQIILTFGAGTAGVGIANILLDEMIRQGVPEEEARQHFYQVDKQGLLFEDTEGLTPGQIPFARKRSEFINADELTNLEAVVKAIHPTI

SEQ ID NO: 4370 - protein, 494 aa, Mannheimia succiniciproducens MBEL55E
MTKDLNVFDKHYGLLINGEWTDGSEGKTLTAHNPANGAELATFIDATDADVDAAVTAAQEAFKTWKHTTAAERAAILNKIADVIDENTELFALQETLDNGKPIRETRAADIPLAADHFRYFAAVIRSEEGSANQLDDEDLSLILREPIGVVGQIIPWNFPFLMAAWKIAPALAAGCTVVIHPSSSTSLSLLSLAQKINHLLPKGVFNVITGKGSKSGEYMLHHTGFNKLAFTGSTEIGRKIGVAAAEMLIPSTLELGGKSANIFFDDMPFDKALEGAQKGILFNQGQVCCAGSRIFVQENIYDKFIAALKEEFKKVKVGLPWEDDTQMGAQVNSNQIKVISKYVDIAREEGCEIIIGGEKATDPALAKGEFFQPTLILAPDNTKRVAQEEIFGPVAVVIKFKEEADVIHMANDSEYGLGGAVWTHNINRALRVARALETGRVWVNCYNRLPAGAPFGGYKTSGIGRETHKMMLDAYTQVKNIFISTREEREGMY

SEQ ID NO: 4371 - protein, 473 aa, Nocardia farcinica IFM 10152
MAVTTSTTSGGHSNPPLPHPKWRLPIINDLLTINPIKPTLTSLRDAEQLGGIFERRLVDWPMIVVSDSELITEICDERNWAKHLGVPLRKMRHIARDGLFTARNDEPNWAKAHAVLAPAFTKEAMRSYHQTMLTTIGELLDYWAKRDGQWVDVGEDMNKLTLEIIARTGFDYTFDSFTRSEVHPFVAAMLRGLTYISRNSNMPPFLQKTIGARAAARHSRDITYVRTVVDDVIKARQASGTVGDHHDLLDRMLTVPDPASDELLDTTNVRSQILTMLVAGHETSAGVLAFALYELSRRPELVAAARAEIETRFADGDLSTIAYDDVAKLRTLRRIVDETLRLYPVAPGFFREARHETTIGGGRYRFGPGDWVLVLTLHAHRDPATWGPDAGEFQPDRWLPERMRSLDGRQVFKPFGTGLRACIGRQFAYHEIVLALAHILHTFEFTPDPGYELDIAEQITLKPHRFRLRLNHR

SEQ ID NO: 4372 - protein, 464 aa, Bacillus anthracis str. Ames
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 4373 - protein, 243 aa, Chlamydomonas reinhardtii
DYYTLRRFLRARTYNLQLATEMWVNHIQWCRDLDIDNLLQNFNFPERDEILKYFPQGYHKVDKQGRPVYVQQVGGLNIAQLKKVADEDRLFMFHLFEYERVCKVVLPFCSRLAGRKIETTFNIMDVKGMGLSQVTGDALKMFQRIAKADQDNFPEMLGHICIINAPAVFRLIWNMAKGFIDVRTQGKIEILGANYKSELLKWIDEDSLMAMFGGSSAGTLAEDVGPWNDPELMVGRASGWVGG

SEQ ID NO: 4374 - protein, 328 aa, Solanum lycopersicum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 4375 - protein, 680 aa, Geobacter sulfurreducens PCA
MEQYAVYFALVCAAAAVVYGLASAQWILGLPQGNERMRQIAAAVQEGAGAYMKRQYTIIAVVGVVMFIALFATLGMKTAVGFAIGAIFSGLTGFIGMFVSVRANIRTTEAAKSGIHKALNVAFKGGAITGMLVVGLGLLGVAGYYLVLQQLMPGAPVKDIVSQLVGLGFGGSLISIFARLGGGIFTKGADVGADLVGKVEAGIPEDDPRNPAVIADNVGDNVGDCAGMAADLFETYAVTLIAAMLLGAIAFNNFSGAVTYPLILGGISIIASIIGTFFVKLGASQKIMPALYKGLIASGVIACIAFYFVTVQMFPEGNPTGYSATNIFISAIVGLVVTGAIFWITEYYTATEYAPVKHIAQASTTGHATNIIAGLGVSMKSTAMPIIVIAAGIIVAFQCAGVYGIAIAAVSMLSLTGIVVAMDAYGPITDNAGGIAEMAELDDSVRAVTDPLDAVGNTTKAVTKGYAIGSAGLAAVILFTSYVDELKLAGQNIEFSLADPYIIVGLFLGGMLPYYFAALCMEAVGKAGGSVVEEVRRQFREIKGIMEGTGKPDYAACVDIVTKSALKEMVIPGIIPIAAPVIIGFTLGPKALGGVIVGTIVTGIFVAISMTTGGGAWDNAKKYIEDGYHGGKGGEAHKAAVTGDTVGDPYKDTAGPAVNPMIKIINIVSLLIVPLLAKMG

SEQ ID NO: 4376 - protein, 514 aa, Oryza sativa Indica Group
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 4377 - protein, 418 aa, Azoarcus sp. EbN1
MQLYALGLNHHTAPLTIREQVAFQPERLDDALHDLTHERTVREAAILSTCNRTELYFATEQPQHAADWLARFHHMPLSEVSPYLYTYPQRDAIRHVFRVASGLDSMVLGEPQILGQVKDAVRRAEEAGTMGTLLHKLFQNTFAVAKEVRSTTAIGANIVSMAAAALHLSERIFERMSDQRVLFIGAGEMIELCAAYFAGACPKRIAVANRTEARAQLVAHRFGAEVMRLDVVGEMLPHFDVVVSCTASPLPIVGLGMVERAIKARRHRPIVMVDLAVPRDIEAEVGELDDVFLYTVDDLAQIVDAGLESRQQAVLEAEEIIDSRVNGFLHWMQARDAVPTIRALRQHAETVRAVELERATRLLAKGEDPRKVLDALSHGLINKLMHSPTRYLNQSEGEQQADASRLVQQLFNLSNSPD

SEQ ID NO: 4378 - protein, 91 aa, Zea mays
MASGQESRKELDRKAREGETVVPGGTGGKSVEAQEHLAEGRSRGGQTRREQLGQQGYSEMGKKGGLSTTDESGGERAAREGVSIDESKFTK

SEQ ID NO: 4379 - protein, 84 aa, Glycine max
HASVCCVLKAAAQWKPLENYNYNKEEINKVVCNSKSSFVAAADDNGEVKIIDIRQQCLYKTLRAGHTSICSTVEFLPWRSWEGT

SEQ ID NO: 4380 - protein, 536 aa, Geobacter sulfurreducens PCA
MKEGYDLIQRPIKSVSIDQIEKQHFKKRMTVWERIKVLSDKEPNVLYQNWGKNLDGASLVTAILNIGGRDVAVYGHDFTVRAGSIDATNGSKLARLFNMAGEKGIPLIGMNDSAGAFVPAGVGGLDGYAEAFTALRKISGVVPSIMCMFGFNAGGGSYLPRQGSFVIQPADTFFGLTGPGVVKSVLGEDITPDELGGPKVHGKSGVADLTVSDEVAALRTAVRLLSYIPDNNSVGAPFQETSDPLNRKTWEINTLLKKAFNSPTGFNTPFDVSIIIQQICDHGDYFELQPERAKEAVTAFGRLGGQVVGFVANNSAVASGQIDCDSAVKIARFVRFCNIYNIPIIFMEDTTGFLPGREQESRGIVQAGRSMLDAIVDVRTPRILLILRNAFGGAYASYNNYPTGADLVLALPTTRLAVMGPAGKEFVYKDEIRKIRGAVADMVKKGVEERTKAGMEAGAAKKDAEKEAAEWLKGQEAALNQRYEKELMNPKEGLALGSISSIVMPTDLRQVLGENIAFLMRHYKPSPMCGPQREFH

SEQ ID NO: 4381 - protein, 92 aa, Triticum aestivum
  misc_feature (49)..(49): Xaa can be any naturally occurring amino acid
MKFFSAFDPWPVFFRREWGRTWAFLAGFRRHGRLITKMTAGSPRKDLKXPNSSKAHKKVSPPPAVRRQAQGQQLITGCVLYAAASSPHYGIT

SEQ ID NO: 4382 - protein, 409 aa, Yersinia pestis CO92
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPLELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 4383 - protein, 349 aa, Gloeobacter violaceus PCC 7421
MQTPLSDGFIQPAEWQPHSACWLAWPSDAELWQSDLPKAQVEFAGLCRTIADPDPQSGLPRGEYLKILVPDAEAERAARLALEGLGARFHRIRFGDIWLRDTAPIFLTGPCRALAAVRFAFNGWGGKYVLDHDTEVAAAVAATADLPTYSFPWVLEGGSVEVDGEGTCLTTRQCLLNPNRNPGMDSKAIEQGLKEALGVRKVLWLDEGLLNDHTDGHIDTIARFAAPGVVVCMQAAPDDPNAPVLDNIAATLAGFTDAAGRMLTVVRVPSPGRVVDDNGEVMPASYVNFYIANRTVAVPTYGAPQDAAAVSAIAALFPGRRTVGLPARTILLGGGAFHCITQQQPEAGS

SEQ ID NO: 4384 - protein, 465 aa, Haemophilus influenzae R2846
MGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 4385 - protein, 136 aa, Gloeobacter violaceus PCC 7421
MDQKHILVAEDVADNLLLIQSILESSGYMVSVAQNGAEAIDLVTSKLPDLVLMDLSLPIVDGWEATRVLKAQDATRHIPIIALTAHAMQGDREKALLAGCDDYLSKPIDIVEIEQVTADWLARSQLDGGHPALLDS

SEQ ID NO: 4386 - protein, 596 aa, Brassica napus
  misc_feature (571)..(571): Xaa can be any naturally occurring amino acid
  misc_feature (590)..(590): Xaa can be any naturally occurring amino acid
MVSDASKKKALQKKAAAAAKRGGKAAAAKAAASSSNGADSLSSGVDALQISDRTCTGILCSHPQSRDIRIESLSVTFHGYDLIVDSMLELNYGRRYGLLGLNGCGKSTLLTAIGLRELPIPDHMDIYHLSHEIEATDMTSLEAVMSCDEERLKLEKEIETLVEQDDGGGERLDTIYERLEAMDASTAEKRAAEILFGLGFDKEMQAKKTKDFSGGWRMRIALARALFIMPTILLLDEPTNHLDLEACVWLEESLKNFDRILVVVSHSQDFLNGVCTNIIHMQSKQLKYYTGNFDQYCQTRSELEENQMKQCRWEQEQISHMKEYIARFGHGSAKLARQAQSKEKTLAKMERGGLTEKVARDSVLVFRFADVGKLPPPVLQLVEVSLGYTPDYLIYKNIDLGVDLDSRVALVGPNGAGKSTLLKLMTGELHPTEGMVRRHNHLKIAQYHQHLAEKLDLEVPALIYMMNEFPGNEEEKMRAAIGRFGLTGKAQVMPMKNLSDGQRSRVIFAWLAYEQPNMLLLDEPTNHLDIETIDSLAEALNEWDGGLVLVSHDFRLINQVAHEIWVCEKQXITKWNGDIMDFKKHLKAKXGIEDGR

SEQ ID NO: 4387 - protein, 554 aa, Haemophilus influenzae R2846
MKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPQTTLFLVASKTFTTQETMTNAQSARDWLLKAAKNESAVAKHFAALSTNAKDVEKFGIDTNNMFEFWDWVGGRYSLWSAIGISIALSIGFENFEELLNGAHEMDKHFRSAPIEQNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQTHNPLADHHNKLLSNFFAQTEALAFGKTKEEVEAEFIKAGKSLDDVKNIVPFKVFTGNKPTNSILVQKITPFILGALIAMYEHKIFVQGVIFNIFSFDQWGVELGKQLANRILPELTDSEKVASHDSSTNGLINQFKAWR

SEQ ID NO: 4388 - protein, 506 aa, Mycobacterium tuberculosis H37Rv
MSDRVKAVAPPDGRTMMTTESVARKTQKSETEAPREPAPVSDEKQTDVAKTVARLRKTFASGRTRSVEWRKQQLRALQKLMDENEDAIAAALAEDLDRNPFEAYLADIATTSAEAKYAAKRVRRWMRRRYLLLEVPQLPGRGWVEYEPYGTVLIIGAWNYPFYLTLGPAVGAIAAGNAVVLKPSEIAAASAHLMTELVYRYLDTEAIAVVQGDGAVSQELIAQGFDRVMFTGGTEIGRKVYEGAAPHLTPVTLELGGKSPVIVAADADVDVAAKRIAWIKLLNAGQTCVAPDYVLADATVRDELVSKITAALTKFRSGAPQGMRIVNQRQFDRLSGYLAAAKTDAAADGGGVVVGGDCDASNLRIQPTVVVDPDPDGPLMSNEIFGPILPVVTVKSLDDAIRFVNSRPKPLSAYLFTKSRAVRERVIREVPAGGMMVNHLAFQVSTAKLPFGGVGASGMGAYHGRWGFEEFSHRKSVLTKPTRPDLSSFIYPPYTERAIKVARRLF

SEQ ID NO: 4389 - protein, 368 aa, Vitis vinifera
MTPGGLLAALFLLLALYCGIDPLKHSSIANFPEFEAHLVEMPPWSEVPAAKDDRNLLQKAEIKFLNQVQGPESVAFDPLGRGPYTGVADGRILFWNGEAWSDFAYTSPNRSELCDPKPSPLSYLKNEHICGRPLGLRFNKRTGDLYIADSYLGLMKVGPEGGLATSLVTEADGVPLRFTNDLDIDDAGNIYFTDSSSKYQRRNFMQLVFSSEDSGRLLKYDPLTKETTVLLRGLQFPNGVSLSKDGSFLVLCEGSPGRLVKYWLKGDKAGTSEVFAILPGYPDNVRTNEKGEFWVAIHCRRTMYQYLLHIGGRLHAVVVKYSPEGKLVKILEDSEGKVVRAVSEVEEREGKLWMGSVLMPFVAVYQLE

SEQ ID NO: 4390 - protein, 221 aa, Zea mays
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPVRDAVTPLSESEAIDLVKDVFASATERDIYTGDKLEIVVINKAGTMREYIDLRKD

SEQ ID NO: 4391 - protein, 295 aa, Hordeum vulgare subsp. vulgare
MHSCNDHGQKVKLNVVQADSAAHGVTAHGARTPPASAVALKPALIRVPSPPVGVTAARAETPLPFPASPACPPLPFLIPSSTPPRPDPVVRPRTNQMASARRLLQTYPGQFQAAEPPDALGADSDVVVILAALLCALLCVVGLAAVTGCARSRRGAGGARSAAPDAAAPSKGLKKRALMALPRLAYEDAVAARGAMAGEEREGVLLSECAICLSEFADKEEIRVLPQCGHGFHVACVDAWLRAHSSCPSCRRVVVVIVADAAPRGMPPQPKRCRKCEAMEEASSSSSSAAAQFLP

SEQ ID NO: 4392 - protein, 522 aa, Glycine max
MLRLSIQRVRKLNFLSPQISALGRSHLSTAAEPSSSKSNPPRVPNLIGGSFVDSKASTVIDVINPATQEVVSQVPLSTDEEFKEAVSAAKKAFPSWRNTPITTRQRVMLKLQELIRRDMDKLALNVTTEQGKTLKDAQGDVFRGLEVVEHACGMATLQMGEYVSNVSHGIDTYSIREPLGVCAGICPFNFPAMIPLWMFPMAITCGNTFVLKPSEKDPGASVMLAELALEAGLPEGVLNIVHGTHDIVNAICDDDDIKAISFVGSNVAGMHIYSRAAAKGKRVQSNMGAKNHAIVMADANVDATLNALVAAGFGAAGQRCMALSTVVFVGGSKPWEDKLLEHAKALKVNAGTEPDTDLGPVISKQAKERIHRLVQSGVESGARLLLDGRNIVVPGYESGNFIGPTILSDINANMEADSLEEAINIINSNKYGNGASIFTTSGVAARKFQTEIEAGQVGINVPIPVPLPFFSFTGNKASFAGDLNFYGKAGVNFYTQIKTITQQWKDSTGGSKINLAMPTSQK

SEQ ID NO: 4393 - protein, 326 aa, Burkholderia sp. 383
MAHAVRFHETGGPEVLRWEEVDVGDPGPGQVRLRHDAVGLNFADTYFRSGLYPVPLPAGLGVEAAGVVEAVGPGVTNVAVGDRVTYTGFLNTLGAYSTERLIPAAPLVRLPAGISCETAAAMTMRGLTSAYLLRRIHAFAPGDTILLHAAAGGVGLIVSQWAKLLGLNVIGTVSSEHKAGIARAHGCDHTIDYSREDVAKRVRELTDGAGVDVVFDSVGKDTFEGSLDSLKRRGLMVCVGTASGPIPPFDPQRLAMKGSLYLTRPALADYIADPAEKNDLAGELFAHVAAGRIRIEINQRYALQDAAQAHRDLESRKTTGSSVFIV

SEQ ID NO: 4394 - protein, 152 aa, Brassica napus
  misc_feature (133)..(133): Xaa can be any naturally occurring amino acid
LQRSARKKKQRAMASGGPKPKLAYIILYVRDVEKAASFYDAAFGYTVRRLDQSRKWAELESGATTIAFTPLHQRETDELSGAVQLPDSSAAGRGSVEVCFAYADVDAAYKRAVDNGAVAVSAPEDKPWGQEVXGFVRDMDGNIVRIASYVRE

SEQ ID NO: 4395 - protein, 186 aa, Streptococcus agalactiae 2603V/R
MSLVGKEIIEFSAQAYHDGKFITVTNEDVKGKWAVFCFYPADFSFVCPTELGDLQEQYETLKSLDVEVYSVSTDTHFVHKAWHDDSDVVGTITYPMIGDPSHLISQGFDVLGQDGLAQRGTFIIDPDGVIQMMEINADGIGRDASTLIDKVRAAQYIRQHTGEVCPAKWKEGAETLTPSLDLVGKI

SEQ ID NO: 4396 - protein, 643 aa, Klebsiella pneumoniae subsp. pneumoniae MGH 78578
MAEFETTFADLGLKAPILEALTDLGYEKPSPIQAECIPHLLDGRDVLGMAQTGSGKTAAFSLPLLNNIDPELRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTAYGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLSKRRLEKFAAKVQQQLESSDLDQYRALLAKIQPTAEGEELDVETLAAALLKMAQGERSLIVPPDAPMRPRREFRDRDDRFDRRGDRNDRGPRGDREDRPKRERRDVGDMELYRIEVGRDDGVEVRHIVGAIANEGDISSRYIGNIKLFASHSTIELPKGMPGEVLQHFTRTRILNKPMNMQLLGDAQPRTERRGGGERREGGRGFGGERREGGRGFGGERREGGRGEGRRFSGERREGRAPRRDDASAPRRDDSAGRRRFGGDA

SEQ ID NO: 4397 - protein, 544 aa, Antrodia cinnamomea
MSLNMNVSSSEPSWAAQAHAQLASPSRLILLFVVNIPLIAVVFNVLYQLVMPRDRTVPPVVFHLIPWFGSAAAYGGDPVEFFKSCREKYGNVFTFILLGKRVTVALGPQGNDFVFGGKHTVIAAEDVYQHLTTPVFGKDVVYDVPNEVLMEQKKFVKVSLTVEKFREYVGMIEEEMTEFMKGDPAFLIWQMKDINEWGTFDAYKTLAEMTILTAARTLLGREVRESLDKGFADLYSDLDHGMTPLHWMFSDLPLPSYRKRDAAHQKISGFYQSILQKRKRQESEYEDDVMGSLMKQQYRDGRALQDHEIAHILIALLMAGQHTSSSSTSWALLHLADRPDVADALYQEQVEHFGTPDGGLRDMTYEEMRKLPILDAVIRETLRMHTPIHSIMRQVRSDITVPPTLGAPSEDNVYVVPKGHIVLASPALSQMDPKIWKDADKWDPSRWYDADGFAAQAHRQYDEDGKVDFIFSKGTGSPYLPFGAGRHRCIGEQFATLQIGVIISTFVRKIEMRLDQPFPKPDYASMMVIPLRPCQILYRRRKFD

SEQ ID NO: 4398 - protein, 333 aa, Azoarcus sp. EbN1
MRRVTLTQFLIEQQRAGRTSPDLRLLIEVVARAVKAIAVNVSKGALADLLGEAGTDNVQGEAQKKLDVIANEILLQANEWGGHLAAMASEEVEEVHQIPFDYPKGGYLLLFDPLDGSSNIDVNISVGTIFSVLRFPEGIQEPNEQCFLQPGREQVAAGYALYGPSTLLILTVGNGVHGFTLDREMGSFVYTHPFMTVPVDTQEYAINASNARHWEPPVQRYVAELQQGRTGPRGKDFNMRWVASMVADVHRVLTRGGIFMYPLDEKCRDQGGKLRLMYEANPMAMIVEQAGGSATTGRQRILDVQPAKLHQRVPVILGSTHEVERVTAYHREG

SEQ ID NO: 4399 - protein, 345 aa, Oryza sativa Japonica Group
MSGILAWAADVVGGAGAANDDEADDARAVASAAMTPEQRLRAADLDAKAASLRRSIHDLRLRVPPPHVAQRLPHLHAHSLASSAALALQLNAHSSTKEQALQREITLQEENAAYEKAISNCRQKIQEKQMEVTLLRSNLKEMEISEQDLKAQLDNAQNEQYASQNKASAAASDNTGNALMEAESLINLKSNDLKEKNEELKLLESSVRVLEMEWSVVEGESLKNPTPAQREKVLEKQLHSLIEQLTAKQAQAEGLIVDVHAKEKELERLNNLHKNLQSRNNDGSVARNPFRAVHEDSDAKAVRRPYQFGLRTEGLKRLMILRSAFVLYILVLHIVVFIKLSVSKQ

SEQ ID NO: 4400 - protein, 309 aa, Saccharomyces cerevisiae
MSHTETQTQQSHFGVDFLMGGVSAAIAKTGAAPIERVKLLMQNQEEMLKQGSLDTRYKGILDCFKRTATHEGIVSFWRGNTANVLRYFPTQALNFAFKDKIKSLLSYDRERDGYAKWFAGNLFSGGAAGGLSLLFVYSLDYARTRLAADARGSKSTSQRQFNGLLDVYKKTLKTDGLLGLYRGFVPSVLGIIVYRGLYFGLYDSFKPVLLTGALEGSFVASFLLGWVITMGASTASYPLDTVRRRMMMTSGQTIKYDGALDCLRKIVQKEGAYSLFKGCGANIFRGVAAAGVISLYDQLQLIMFGKKFK

SEQ ID NO: 4401 - protein, 636 aa, Saccharomyces cerevisiae
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEERQVNEDRHSTEKHQFLTKAKRFF

SEQ ID NO: 4402 - protein, 653 aa, Desulfovibrio desulfuricans G20
MSHSILLVDDEEGIRTVLGLSLADAGYNVSVAATGEEALRLFDQSRPDIILTDIKMPGLSGLDLLKRVKNIAPDVEVIMITGHGDMQLAIQSLKQDATDFITKPINDDVLEIALNRAHERISMRNQLREYTENLENKVREQSARLVEAERQLAAQQMMDGFSVGLKALLNAMDSTLGGVFNELPCFVAVHSRYLEIIAANDLYREKLGNLVGHQSWEAYYGRDKDSNGCPVLTAIREGRGSRTEEMLVDKTGKGIPVLVHTAPILDNDGEVELVLEISVDTSEARRLHEELRLTRHRYGQLFDEAPCYITVQDKQFRVVEANRRFREDFGDAVGGFCHEVFVHRQTPCTGCPVQRTFNDGQPHQYETVVTSRSGEQYNVLVWTAPLRDAAGNITEVMEMSTNITELRKLQDRLSNLGLLLGSTAHGIKGLLTALDGGIYRLGSGLERNNTERVHDSYEDIRHLTDRLRKMVLDLLYYAKKRELNWEVVLASHFAPEVAALVRPKAEAQKVRFTIEVAPDAGTFEADAGALSSAFVNLLENAVEACTADRTPDKKHAVHMAVSGLPDRVEFCITDNGVGMDRETREKLFTLFFSSKGAAGTGIGLFVASQTVQQHGGSISVGSEPGKGTTFVITLPRTLPDSAKSEPRHPAPAT

SEQ ID NO: 4403 - protein, 472 aa, Klebsiella aerogenes
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDLSDVKPTGKTVAIIGAGPAGLACADVLTRNGVKAVVFDRHPEIGGLLTFGIPAFKLEKEVMTRRREIFTGMGIEFKLNTEVGRDVQLDDLLKEYDAVFLGVGTYQSMRGGLDNEDAPGVYDALPFLIANTKQIMGFGETADEPYVSMEGKRVVVLGGGDTAMDCVRTSVRQNAAHVICAYRRDEENMPGSKREVKNAREEGVEFQFNVQPLGVEVNANGKVCGVKMARTEMGQPDAKGRRRAEIVPGSEHVVPADAVVMAFGFRPHSMEWLAKHSVELDSQGRIIAPEGSENAFQTSNPKIFAGGDIVRGSDLVVTAIAEGRKAADGILNYLEV

SEQ ID NO: 4404 - protein, 494 aa, Didymeles perrieri
PTTSSPEVSTLQEKNLGRITQIIGPVLDVAFPPGKMPNIYNALVVKGRDTLGEQINVTCEVQQLLGNNRVRAVAMSATDGLMRGMEVIDTGAPLSVPVGGATLGRIFNVLGEPVDNLGPVDIRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNSEVESKLRK

SEQ ID NO: 4405 - protein, 201 aa, Candida albicans SC5314
MGKAKKTRKFAAVKRTLNTKKDQRLTQNNANNNNTNKKKGGGSGGVVDDPELTRSVPQVSSALFFKYNESIKPPYQVLIDTNFINFSIQKKIDIIRGLMDCLMAKCIPIITDCVIAELEKLGSKYRIALKLAKDPRIQRLKCSHVGTYADDCLVNRVIQHKCYIVATNDADLKRRIRKIPGIPIMSVGGHSYVIERLPDVF

SEQ ID NO: 4406 - protein, 322 aa, Yersinia pestis CO92
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTQGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 4407 - protein, 184 aa, Zea mays
  misc_feature (147)..(147): Xaa can be any naturally occurring amino acid
  misc_feature (175)..(175): Xaa can be any naturally occurring amino acid
MASSSASLLKASPVKSDWVKGQSLLIRQPSSVAAIRSNAAPSALTVRAASYADELVKTAKTIASPGRGILAMDESNATCGKRLASIGLENTEANRQAYRTLLVSAPGLGQYISGAILFEETLYQSTVDGKKMVDVLVDQNIVPGIKXDKGLVPLVGSNDESWCQGLHGLASRTAXYYPTGARFG

SEQ ID NO: 4408 - protein, 455 aa, Herminiimonas arsenicoxydans
MSTVEVKVPDIGDFKEVEIIELLVKVGDTIKIDQSLITVESDKASMEIPSSHAGVVKEIKVKLGDKVAEGSLLLTVEESAAAAEAAPAEAPAPAPVEAPKAEPVKAAEPTPVAPAEAPAPAPAAAPAAPAAPVAAAVPATAANAKAHASPSIRKFARELGVDLGSVAGSGPKGRITQQDVQTYVKTALAAGPVSSAPVAAPPGASRGGAGLDLLPWPSLDFSKFGETTLQPLSRIKKISGPNLHRNWVMIPHVTQYDEADVTELEELRKSTNTALAKSGVKLTILAFVIKACVAALKKYPEFNSSLDAAGENLILKQYYNIGFAADTPQGLVVPVVKGVDQKTVTQIAQEMGELSAQARDGKLKPADMQGATFTISSLGGIGGTYFTPLINAPEVAIIGLSKTSMKPVWDGKQFVPRLIMPLSLSYDHRVIDGAQGARFVTYLSEVLTDLRKSLL

SEQ ID NO: 4409 - protein, 575 aa, Yersinia pestis CO92
MISGILVSPGIAFGKALLLKEDEIVINRKKISADQVEQEVERFKAGRAKAAEQLEAIKTKAGVSLGEEKAAIFEGHIMLLEDEELEQEIIALIKDEHASADAAAYSVIEGQAKALEELDDEYLKERAADVRDIGKRLLKNILGLNIVDLSAIQDEVILVATDLTPSETAQLNLDKVLGFITDIGGRTSHTSIMARSLELPAIVGTSNVTKQVKNDDYLILDAVNNKVYLNPTADVIEQLKAVKNQYITEKNELAKLKDLPAITLDGHQVEVVANIGTVRDIAGAERNGAEGVGLYRTEFLFMDRDSLPTEEEQFQAYKAVAEAMGSQAVIVRTMDIGGDKDLPYMNLPKEENPFLGWRAIRIAMDRKEILHAQLRAILRASAFGKLRIMFPMIISVEEVRELKAELELLKSQLREENKAFDETIEVGVMVETPAAAVIARHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKVLAEQALAQPTAKELMDLVTTFIEEKTLC

SEQ ID NO: 4410 - protein, 142 aa, Oryza sativa Japonica Group
IFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLR

SEQ ID NO: 4411 - protein, 611 aa, Herminiimonas arsenicoxydans
MSTIEVKVPDIGDFKEVEIIEMLVNVGDTIKVDQSLITVESDKASMEIPSSHAGVVKELKVKLGDKVAEGSLLLILEASESAAAPAAAPAAPAPAAVAPTPEPAAAPAAASVKAAAPVSAPAAAPVNAPAAASFAGKADIECDMMVLGAGPGGYSAAFRSADLGMATVLIERYSTLGGVCLNVGCIPSKALLHVAAVIDEAAAMTAHGVTFGKPQIDIDQLRGYKEKVIGKMTTGLSGMAKARKVNVVQGVGQFVGTNHIEVTAADGSKKTIQFKQAIIAAGSSVVNLPFIPEDPRIIDSTGALELRSVPKRMLVIGGGIIGLEMATVYSTLGARIDVVEMLDGLMQGADRDMVKVWQKFNEKRFDKIMLKTKTVAVEALKEGIKVSFEAAEAGVTAPEPQVYDMVLVAVGRSPNGKKIAADKAGVAVTDRGFIEVDAQMRTNVHHIFAIGDLVGQPMLAHKAVHEAHVAAEAAAGEKSYFDARVIPSVAYTDPEVAWVGITEDEAKAKGIKLEKGHFPWAASGRAVANGRDEGFTKLLFDAETKRIVGGGIVGTHAGDMIGEIALAIEMGADAVDIGKTIHPHPTLGESIGMAAEVYKGVCTDLPPMKKK

SEQ ID NO: 4412 - protein, 240 aa, Zea mays
MADAGNEAEGLTLLGLHVSPFALRVRMALSLKGLSYEYIEQDLFHKGELLLSSNPVHKKVPVLIHHGKPICESLAVVEYVDEVWPGAAATILPADPHGRATARFWAAYIDGKLFPAWTGIMKAATEEARADKLRETHAAVLNLEKAFAEISSSSSNDGAAFFGGDSVGYLDLALGCSLPWFGALRAMLGVEIIDAAQAPLLVAWAERFGETPVAKEVLPQPDEAVAYAKKIQAYWASAKN

SEQ ID NO: 4413 - protein, 713 aa, Physcomitrella patens subsp. patens
MHSLQDMALGASPFVGFDGLRVNTPGQLGTHIAVGSCSTLPGGFCVRAVATPVKPPTTLPPKRSKVEIIKQNSDFLRFPLKQELQTEAPNLNEESVQLIKFHGSYQQDNRELRGPGKKAYQFMLRTKNPSGIVPNRLYLVMDELADKYGIGTLRLTTRQTFQLHGVLKVDLKTVMSSIIRNLGSTLGACGDVNRNVLAPAAPYKTKEYMNAQELASKLASLLAPQAGAYYDIWVDGEKVTQDEPEDVTIARNDNSHGTNFENSPEPIYGVQFLPRKFKIAVTVPGDNSVDVLTNDIGIVVISDEQGEVEGYNLYVGGGMGRTHRNEATFPRLADQLGYVSKDDILYVVKAIVATQRDYGRRDDRRMSRMKYVVEEWGIEKFRTVVEQYFGKKIESFKEIVPFEFQSYLGWHKQGDGLLFYGLHVENGRIKGEAKKALREVIEEYNLNVRITPNQNMILCDIRPSWRPKIAKRLAAVGMVSPRFVDPLNVTAMACPALPLCPLAIAEAERGAPDILKSIRKLFDKVGLNSTESLVVRITGCPNGCARPYMAELGLVGDGPNSYQIWLGGAPNQTRLAESFMERVKLDKLESVLEPLLYMWRTERREDESFGDFSFRQGFGALKSYIENYTGPRKSPRKVGIHLESHVHDILSKAAESQGINPTKLATKTTLATNADVNESASSSLIHLCSRGSHHSYLYPLMQAYLGLQQYTLV

SEQ ID NO: 4414 - protein, 548 aa, Gloeobacter violaceus PCC 7421
MTSTFAPTPLTQRAAWQALAAHYEQIREIHLRALFAEDPSRGERFALEAEGFYLDYSKNRLTDETLRLLSVLAEESDLRGRIEAMFSGEKINTTEQRSVLHTALRAPRGATVIEDGENVVPEVHAVLDRMAEFADRVRGGEWRGYTGRRIRTVVNIGIGGSYLGPDMAYDALKHYSDRDLKVRFAANVDGSNFAEVIHDLEPDETLFIVCSKTFTTLETMTNAHSARQWCLAALGDEQAIAKHFVAVSTNAAEVEKFGIDTAHMFGFWDWVGGRYSMDSAIGLSTMIAVGPEHFRAMLAGFHAMDEHFRTAPFERNLPVLMALIGLWYNNFFGAQTLAVLPYDYYLGKLPAYLQQLDMESNGKHVDIDGQPVTYQTGPIIWGQPGTDGQHSFYQLIHQGTKLIPCDFIGFCQTLNPIAPHHDQLMANFFAQTEALAFGKTEAEVRAEGVADWLLPHRVFEGNRPTNTLLAERLTPEVLGKLIALYEHKVFTQGVIWNLDSFDQWGVELGKVLAGRIIPELESAEEPELAHDSSTNALIRRYRRAKRQN

SEQ ID NO: 4415 - protein, 163 aa, Nitrosomonas europaea ATCC 19718
MRHIISLLMENEAGALSRVAGLFSARGYNIESLSVAPTEDPTLSRMTLVTNGPDEIVEQITKQLNKLIEVVKLIDLSSEGYVERELMLVKVRAVGKDREEMKRLADIFRGNIIDVTNELYTIELTGTRSKLDGFLQAVDCNLILEIARTGVSGLSRGERVLKL

SEQ ID NO: 4416 - protein, 380 aa, Zea mays
  misc_feature (257)..(258): Xaa can be any naturally occurring amino acid
  misc_feature (306)..(306): Xaa can be any naturally occurring amino acid
MGKEGVAAGPAAEGSKSRTECINSCNPYHECSDYWLRKIAEARHCLDDELPDSWKRPSEQRTGHPDCINASNPYHECSDYCFKRIADAKCFNAPNPLRECSDHCFKRIADAKSPACGLEREERQPPADVFAAAGMSDAVEQHRPIDNDSDEQEGAGPDDGYPQMTEKQKKLFELRLKMNEARKANQQAMVAEKKRMEPRGESRGVSKQKWLDDRKKKIGKLQDSNGLDMKMAYMLDTQETAEAKYKKWEKEPAPYGXXDVFNQKTLYDAYKKRTKNIEVDMESYNKAKEADPEFYRDASSLQYGKXSNVPKGKHCKMVKELKEREEKRKSFSRRRKFNEDKDIDSINDRNEHFNKKVERAFGKYTLEIKNNLERGTALPD

SEQ ID NO: 4417 - protein, 398 aa, Fulvimarina pelagi HTCC2506
MTFQFRTIDDADVTGKRVLVRVDFNLPMKDGKVTDATRIDRALPTIAELADKGARVILLAHFGRPKGKPNPEMSLKPIAPVLSDRLGKPVGFADDCIGPVAAGIIEMLKDGDVVLLENTRFHAGEEANEAEFAESLASLGDIYVNDAFSAAHRAHGSTEGIAHHLPSYAGRTMQAEIEALQAGLEAPEKPVVAIVGGSKVSTKIDVLTNLLDRVDYLVIGGGMANTFLAAKGVDIGKSLCEHDLADTARSVMSRAEEKGCEILLPTDAVVARHLRSGAPTETVPVEETPEDMMILDAGPLSLKAVVARLDLAKTLVWNGPLGAFEVEPFDEATVGAARHAAELTRAGKLVSIAGGGDTVAALNQAGVSDDFSYISTAGGAFLEWMEGKALPGVEVLKE

SEQ ID NO: 4418 - protein, 294 aa, Listeria monocytogenes EGD-e
MTKTLQDRMILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE

SEQ ID NO: 4419 - protein, 482 aa, Bradyrhizobium sp. ORS278
MGKVTGFLEIERHDRKYAPVAERLKHFQEFVVPLSEKELRDQAARCMNCGIPFCHGTGSAAPGTTGCPVNNQIPDWNDLIYNGNWEEASRNLHSTNNFPEFTGRICPAPCEASCTLNIDDNPVTIKTIECAIVDKAWENGWLKPEPAAVKTGKKVAIVGAGPAGLAAAQQLARAGHEVHVYEKHAKAGGLLRYGIPDFKMEKGIIDRRIAQMEGEGVVFHYGAHVGGKDGIDPKSLLKDYDAVALTGGAEAPRDLPIPGRDLSGIHYAMDFLPQQNRRVGNEPVNATEILAGGKHVVVIGGGDTGSDCIGTSLRQGALSVTQLEIMPAPPERENKALTWPNWPLKMRTSSSQAEGAAREFAVLTQTFEGENGAVKKMHCVRVDAQFKPIPGTEFELAADLVLLAMGFVHPVHEGLLKSLGVDLDPRGNVKANLSDYQTSLPKVFSAGDMRRGQSLVVWAIREGRLCAQAVDKFLMGKTELPR

SEQ ID NO: 4420 - protein, 265 aa, Glycine max
KRPVPLSIGYMAQYMLKPLLGVLIARVFRMPSAFFAGFMLTCCVSGAQLSSYASFLGKGDVALSILLTTYSTISSVIVTPILTGLLIGSVVPVNGIAMAKSILQVVLLPVTLGLLLNTYAKPVVNVIQPVMPFVAMVCTSLCIGSPLAINRTMLLSSQGFMLLLPIVTFHIAAFVVGYWVSKLPQLRQEEPVCRTISVCTGIQSSTLAGLLATQFLGISQAVPAACSVVVMAIFGLTLASYWGSGMRIRDLPLRFFPQASADARS

SEQ ID NO: 4421 - protein, 295 aa, Geobacillus kaustophilus HTA426
MKKVRKAIIPAAGLGTRFLPATKAMPKEMLPIVDKPTIQYIVEEAIASGIEDIIIVTGKGKRAIEDHFDYAFELEQMLKQKGKLDLLEKVKEPSKVDIHYIRQKEPKGLGHAVWCARNFIGDEPFAVLLGDDIVQAEKPCLKQLIEQYEQTFSSVIGVKRVPEEETHRYGIIDPLEQQGRRYQVRRFVEKPAPGTAPSNLAIVGRYVLTPEIFLFLEKQEAGAGGEIQLTDAIGRLNEIQRVFAYEFEGKRYDVGEKLGFIETTIEFALQNEELRDDLLSFLERVVAEAKGSKNN

SEQ ID NO: 4422 - protein, 176 aa, Heterocapsa triquetra
TMKAAIVEEFGKPLVIKEIPVPEPGYGEVLIKVITSGVCHTDLHVRDADWHVKPKCPIIPGHEGAGIVAKLGEGVTTLKIGDRVGHAWLHDSCGSCDYCLKGWETVCGKQNQTGFAADGCFAEYTVAKASYVGKIPDGLSFSQAAPVLCAGVTTYKALKETEAKPGQWVAIIGACG

SEQ ID NO: 4423 - protein, 253 aa, Lactococcus lactis subsp. lactis
  misc_feature (159)..(159): Xaa can be any naturally occurring amino acid
  misc_feature (174)..(174): Xaa can be any naturally occurring amino acid
  misc_feature (178)..(178): Xaa can be any naturally occurring amino acid
  misc_feature (184)..(184): Xaa can be any naturally occurring amino acid
  misc_feature (188)..(188): Xaa can be any naturally occurring amino acid
  misc_feature (191)..(191): Xaa can be any naturally occurring amino acid
  misc_feature (193)..(193): Xaa can be any naturally occurring amino acid
  misc_feature (204)..(204): Xaa can be any naturally occurring amino acid
  misc_feature (226)..(226): Xaa can be any naturally occurring amino acid
MAFSKKTRQEAITKIQNEEMDLLVIGGGITGAGLTLQAAAAGMKVAVLEMQDFSEGTSSRSTKLVHGGIRYLKNFDVEVVSDTVSERAVVQGIAPHIPKPDPMLLPIYDDEGKTTFDMFSVKIAMDLYDRLAGVDEDSPYANYTISPEEVLHREPLIKXKGLQGAGVYLDYRNXDARXVIDNIXKAVXDGXQXISKMKVIDFIXTDGQISGIRARDLLTDQVIEVXAKLVINTSGPWVDKIRYLNFTRPIVPR

SEQ ID NO: 4424 - protein, 513 aa, Bacillus cereus ATCC 14579
MLDQKQQSNSFEERVETIKQGGAPKYHEQNKAKGKLFVRDRLALLFDNGEYVEDALFANCEQTGLPADGVVTATGKIHGRTACVMANDSTVKAGSWGSRTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSVSGCGDVLCKTEEDAITQARQYISYFPNNYLEKTPLVTPQEPKQFDKTLEQIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERASFIAEKREEYKKDIDIYHLASEMVIDGIVHPNNLREELKGRFEMYMSKYQVFTDRKHPVYPV

SEQ ID NO: 4425 - protein, 292 aa, Burkholderia sp. 383
MRVEVQIVNALTDGNTGGNPAGVVIDADELTAGQKLRVAQQTALSETAFVSTSDIATVKLEFFTPTRQIAHCGHATIATFSLLRELGRAGDGKSSKETIDGCRDIVIDGDTVLMEQRSPRYRSIDADSPLSARIAQSLGVSTAQIHSVETPTVVNTGNSFLMIALPDEQSVAAIRPNQHAIESISDELDLIGYYVFSTTTKIPGRHAGARMFAPRFGIAEESATGTAAGPLACLLYERMGAGDTEMAIEQGHLMQPPSPSVIKVILDVDSGKISRLMAGGTGVVMRSITVEV

SEQ ID NO: 4426 - protein, 488 aa, Oryza sativa Japonica Group
MSLADDLAAVERGGHMVPSKAAGVDGDGEPRRTGTMWTASAHIITAVIGSGVLSLAWGVAQLGWVAGPAVMLLFGAVIYCCSVLLVECYRTGDPYTGQRNRTYMDAVRANLGGTKVRLCGVLQFANFFGVCVGITIASSISMLAIKRAGCFHVRGHDQREACGGSSRPYMVVYGALQVVFSQIPNLHKMWWLSTLASAMSLSYSAIGIALGVAQIVANGGIRGTITGVFVGAGAGVTSMQKVWRSFQAFGNIAFAYGFSFILLEIHDTVKPVAPPSTETKVMRKAVAVSVATTTAVYLMCGCVGYAAFGNDSPDNLLTGFGFFEPFWLLDLANAGVVVHLVGTYQVVAQPVFAFLDGRAAAGAWPGSAALGKRRRVLRVGSLAEIEVSPFRLAWRTAFVCVTTAASTLLPFFGSMVGLIGAASFWPLTVYFPVEMYIAQRRVPRGSAQWLSLQALSAGCLVVSVAASAGSIAGVVEAFKAHNPFCWTC

SEQ ID NO: 4427 - protein, 263 aa, Arabidopsis thaliana
MAEIKDEGSAKGYAFPLRNPNVTLNERNFAAFTHRSAAAHPWHDLEIGPEAPTVFNCAVEISKGGKVKYELDKNSGLIKVDRVLYSSIVYPHNYGFIPRTICEDSDPMDVLVLMQEPVLTGSFLRARAIGLMPMIDQGEKDDKIIAVCADDPEFRHYRDIKELPPHRLAEIRRFFEDYKKNENKKVDVEAFLPAQAAIDAIKDSMDLYELTSKLACNANEETSPFPFLPVCLDITEAAFYTTCMLDKISIGAFNFVMLIRKHC

SEQ ID NO: 4428 - protein, 269 aa, Arabidopsis thaliana
MGTMGKAFYSVGFWIRETGQALDRLGCRLQGKNHFREQLSRHRTLMNVFDKTPNVDKGAFVAPNASLSGDVHVGRGSSIWYGCVLRDIPFDLMTDSAGDANSISVGAGTNIQDNALVHVAKTNLSGKVLPTVIGDNVTIGHSAVLHGCTVEDEAYIGTSATVLDGAHVEKHAMVASGALVRQNTRIPSGEVWGGNPAKFLRKVTEEERVFFSSSAVEYSNLAQAHATENAKNLDEAEFKKLLNKKNARDTEYDSVLDDLTLPENVPKAA

SEQ ID NO: 4429 - protein, 126 aa, Nicotiana plumbaginifolia
EAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYH

SEQ ID NO: 4430 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 4431 - protein, 139 aa, Brassica napus
MFALTSKFAVGWIVNPAYMGPPGRGFLAAVESTGPIGRRLAGLNVKTVETNKRVFRGLFLTALGAFLGLSGVILLGETFYQKSSDGRLFVAIWKEGGVLPGLKVDRGPVRLAGTNGETTIQGFDGLGGRCRKYYKAGAR

SEQ ID NO: 4432 - protein, 132 aa, Physcomitrella patens subsp. patens
MSGRGKSSGKKTVSRSSKAGLQFPVGRIARFLKAGKYATRVGAGAPVYLAAVLEYLAAEVLELAGNASRDNKKTRIVPRHIQLAVRNDEELSRLLGQVTIANGGVLPNIHTVLLPKKTGVTAGKPGKAGSPE

SEQ ID NO: 4433 - protein, 370 aa, Zea mays
MSDGKDSLDLSALGAAIPNSAELSAEDKANLVASIKNTLEGLASRHTDVLENLEPKVRKRVEKLREIQGEHDELEAKFFEERAALEAKYQKLYEPLYSKRYEIVNGVVEIEGITKESAAETPEEQKSGDETSAEQKEEKGVPAFWLNAMKNHEILAEEIQERDEEALKYLKDIKWYRISEPKGFKLEFHFGTNMFFKNSVLTKTYHMIDEDEPILEKAIGTEIEWYPGKCLTQKVLKKKPRKGSKNTKPITKTEDCESFFNFFSPPQVPDDDEEIDEDTAEQLQNQMEQDYDIGSTIRDKIIPHAVSWFTGEAAQDEDFEVMDGEDDDDEDDDDEDDEDEDDDDYDTKKTKGTAGGEGQQGERPAECKQQ

SEQ ID NO: 4434 - protein, 431 aa, Synechococcus sp. WH 5701
MGGTIGAGILRTPGLVAEQLGSAPLIVAAWVAGALYALLGAFAVAELSTSMPRAGGWTVYARRALGDQAGFSVGWIDWVGHCAGLAWVAVTIGDYTIGLLPALPVGSKVVALLVLLAFALIQQLGLEAGSLSQKILSLGKAIAFLGLITACFLHPPVRELAGLSEPLLEAAGPADPLAAGGISLGIGAVFAMQAVITTYDGWHSPIYFAEEFAEPSKDLPRSLVGGVLSVAGLYLLVNLALLRLLPVSRIAGSVLPLADAAEVIFGSWSSQLIVVLALISSFGLVNAVVMGAPRILYGLSRDGLFLPQFAAVSAGGTPVLALVLTASTAGLLVAFGDFTILLGIASFLYVLLYLSGITSLLLLRWREPGLERPFRDPGYPISALIVWLGSLAFLIAAIRNDTANSAAALGLILLSLPLHQMTRRLAPSPEA

SEQ ID NO: 4435 - protein, 731 aa, Candida albicans SC5314
MSQDSSDQRPPQSESLQTISSDNTTTTTKHTEKRISETKLENGNHCLSDIARGHNPSSIKGNGSTKNSVASGIKVNTNSASGIAPPTKILTNSSKEVTSPVLQNSNTPILGSANTSGTNIPVRNQSVSFSDIDNQERSRRFTISAKPSTVNVPQEVQLPQSSRHPSSAAPSRQSSVKTKRVTSPVNSGEGNVYNDVLTFMTNHSHGKLNTALPSNVHVGAIRSDNSSPITPEGAIDPGFNFDYNKNSLNRIASPSPPPFSRSNGSSSTSSPKRSKTPNTQEPVPPQEPITTTEKLISEPSSQSAIKPLPSSQIVQPIKITGTGSANSSRRGSLKKSNKTIVSSPIGPPVPFQQFLSKQDDGKFHILLACTGSVATIKVPLIIDKLFQIFTTSKISIQLVLTKSSSHFLRGCKIHEDVKIWRDEDEWANFSDAYNSASTTVCSTMGNDGLNVVNKKPKNPFEKLILHNELRKWADIMLIAPLSANTLAKIANGIADNLLTSIVRSWCPSTFQQVKKPIIVAPAMNTFMYTHPITAKQLNIISSPDFGIEVLKPVEKILVCGDIGMGGMREWAEIVDVLRRRVHSIKAEQKKLLDEEQRLNEEEEEEEEDDDNDEEGDDDDDDDDDDDDDDDDDDDDDDDDDDDDDDDDVEEDNEEEDVDDTNKRKLVRNNTSNSEELPKKDDDEMIFEITDQEQSEQDDEGEIVTNESRTISPVPSHRQQKIKIPKETQNLI

SEQ ID NO: 4436 - protein, 597 aa, Nitrosomonas europaea ATCC 19718
MWIFRIKLATLLLTVLLVACNTQPARLNYTVPVQPEGSSGYTEKPGWQTATFAVAVANPLATDAGYQILKAGGSALDAAVAVQMVLTLVEPQSSGIGGGAFLMYFDGESVEAYDGRETAPAAANEDLFLKPDGKPMSFMEGAVGGRSVGVPGVVRMLEQVHQQHGKLPWATLFEPAIRLAEQGFKVSARLNTMLAADRYLRQDPEAAAYFYDSNGQPWPVGHVLRNPELARVLRGIAMHGSMALLEGPVAQSIVDKVRSHVTNPGEITLADLARYQPRKREPLCHDHAVPPKVYRLCGFPPPGSGAIAIGQIFGILQNTPGAALPLSSDGLPTADWLHFYTEAARLAFADRAKYVGDPDFVAPPAGAWMSLLSPGYLAGRARLIGDRPMKVTRPGQPEGMRINLAPMPDQPEYGTSHISIVDAQGHAVALTTTIENAFGSRQMVRGFLLNNELTDFSFTPRDAQGNFVANRVQPGKRPRSSMSPTLVFDKATGQLVMVGGSPGGAFIIHYIAKILWGTLHWGLNMQQAIDLPNFGSANSFTLLEEKGFPAATVKALEAKGHNVQEMDMTSGLQAIQRIPGGYFGGTDPRREGVVMGD

SEQ ID NO: 4437 - protein, 382 aa, Listeria monocytogenes EGD-e
MNHSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVAETFQKRLEYIAKRVEKIPYLSLHPLKGSIYAFINISKTNMDSVSFTEYVLKETQVLVIPGLAFGESGDNYVRLAATQDISVLEEAFNRLAKLTF

SEQ ID NO: 4438 - protein, 216 aa, Mannheimia succiniciproducens MBEL55E
MSDSANSSCIIIAIAGASASGKSLIASTVHRELRDQVGSDDISIISEDCYYKDQSHLDFATRTQTNYDHPNSMDRDLLLEHLRALKAGKSVDIPQYSYVEHTRMKEVTHFTPKKVIILEGILLLTDERVRNELSLSLFVDAPLDICFIRRLKRDMEERGRSLESVIEQYRKTVRPMFLQFIEPSKQYADIIIPRGGKNRIAINMLKAQILHLLGRK

SEQ ID NO: 4439 - protein, 610 aa, Arabidopsis thaliana
MGSGTNHLKSNTFIKREANMLGKNPWPEKDSGGSSVSRDTGTGKDVQDMTLEDTNTSDHGFNGGHVDVVENFSTGDPMLCDTSAATNDGVYNYSLNSIPDAENDLSFFDNGDKEKNDLFYGWGDIGNFEDVDNMLRSCDSTFGLDSLNNEGDLGWFSSAQPNEETAGAMTDDLKPDKMLENQRTAMLQVEDFLNNSEPNHAVEDEYGYTIEDDSAQGKSSQNVFDTSLQKKDILMLDVENCLRLPRHMQPLTTWDVTFYDDLFSCTFSSVKSSNYDMTLFTMVANLEKKQTDHLHHLDGKSDGFSENSFTLQHSGISREIMDTNQYYPPSAFQQRDVPYSHFNCEQPSVQVSACESKSGIKSENKPSPSSASNESYTSNHAQSIESLQGPTVDDRFRKVFETRANLLPGQDMPPSFAANTKKSSKTDSMVFPDAAPIQKIGLENDHRKAATELETSNMQGSSCVSSVVDDISLEATSFRQLQQVIEQLDVRTKLCIRDSLYRLAKSAEQRHHGGNRPEKGAGSHLVTGEADKYAGFMDIETDTNPIDRSIAHLLFHRPSDSSLSSDNNVLSYKSHPMIPQPNSSPSLRIEKQEETTELRPEAEVVTSDNN

SEQ ID NO: 4440 - protein, 257 aa, Bacillus anthracis str. Ames
MYFEYKNRKVFYNIEGSGPVILFLHGLGGNANNWLYQRQYFKKKWTVISLDLPGHGKSEGLEINFKEYVNVLYELCKYLKLQKVVICGLSKGARVGIDFAIQYPDFVSSLIIVNAFPYLEPEDRKKRLEVYDLLSLHDNGKKWADTLLEEMGVASNEVIVRGFYQSLQSINPVHIQRLFAELVDYDQRPLLLNISCSTLIIRGENDDFVPEKYVREFERRLKNTTFIEFKNSGHLPYLEQPSSFNMTVEKFLNHVIN

SEQ ID NO: 4441 - protein, 404 aa, Azoarcus sp. EbN1
MDKNAFLKAGHPPTLLAAFLYFDLAFMVWVILGPLGVQIAADLGLDHAQKGLMVAIPVLAGAILRIFMGVLVDHLKPKMAGAIGQVIVIAALFVAWQFGIHSFEQTLLLGVFLGVAGASFAVALPLASRWYPPEHQGTALGIAGAGNSGTAIAALVAPGLAIAYGWTNVFGLALVPLVVVFAFYLAVAKDAPECPPAKPLAEYFKVLKDKDAWWFMFFYAVTFGGFVGLASSLTIYFNTQYGLDAKMAGYFTAACVFAGSMVRPIGGAVADRIGGIKSLSVMYVLAALFLGIVSVGLPTAWMALVVFVAAMLALGMGNGAVFQLVPQRFRREIGVMTGLVGMAGGVGGFYLASSLGYAKQATGSYQSGFLIFAALALAALVGLTAVKTRWRTTWGAAHLTSAKI

SEQ ID NO: 4442 - protein, 487 aa, Burkholderia sp. 383
MNSHSLDLGGNAGGPASARPPAAAAGVDADASALPARRVTLGDFMDDLPVGALHRFVVWVIGIGLFFDMYEIFLVSTIGSALQNEYGLSRQSTDFKLLLASAFIGMFVGAMCLGSLADRIGRRKAFLLTLTWYSAFSLVGAFSVNADMLVACRFLTGIGVGAIYPVADSFLSEILPKEKRGRLAAWAYTTSYVAVPLVGFLALWLNPLHVGGVAGWRIILAIGSLGAVYVMLVQHRLPESPRWLLAQGRTADAHAALRRFAEGTGVRVPEQFAEPVEPQRPLGLGERIALLRREPYGARYLMLAIFHLFQGFGYYGFGTLAGTVVKSRGFDVTDSTLFIALSFIGYPVGSLLSIPLLNRIERRTLVIVSILSIAVFGLCFAYSGNTVLIVGFGFLTTCASNVFSNAYHVYQAEIFPARVRSTAIGSTYALSRIVSGVLPFVLLPVLASYGAGAMFGVISVALGIVAVTLRVLGPLTTRRSQDEINPV

SEQ ID NO: 4443 - protein, 250 aa, Vitis vinifera
  misc_feature (35)..(35): Xaa can be any naturally occurring amino acid
  misc_feature (249)..(249): Xaa can be any naturally occurring amino acid
MAIELCSDSCSMCMSPRISFSHDLCQADVVPVEHXPSQSNSPTNDFDFCVYESFYQDTSSADELFYDGKILPIQIKKKIATPKSTVQQPKPPLPLAPPPLPTQNNRKKESSREIKRTINEVYEKQNSKSFWRFKRSTSLNCSSGYARSLCPLPLLSRSNSTGSVSNAKRSALSSKDGNNIKNWHKHPSVAPIKSPHSSSSTSYQKPPLKKTYGSHSNGVRINPVLNVPTPSLFGLGSIFSNGKDKINKXK

SEQ ID NO: 4444 - protein, 401 aa, Glycine max
MEGKLSRAAKKITSSSIQELSQLAQRCNAINLAEGFPDFPSPPHLKNAAVSAINSDFNQYRHVQGVCDLLAKMVKQMHGLDIDPVTDVAICCGQSEAFAAAIFATIDPGDEVILFDPSYETYEGCVAMAGGVPIHVPLDPPQWTLDPSKLLRSFTEKTKAIVLNSPHNPTGKVFTKEELEIIAGECCSRNCLAITDEVYEHITYDNLKHISLASFPGMLERTVITSSLSKSFSVTGWRVGWAIAPAFLASAIRNIHGRVTDSAPAPFQEAALTALRSPPEYFESLRRDYQSKRDYIIKLLDGVGFKIVFIPQGSFFLFAELPDNWLLSDVEFVKKLIIEAGVVAVPGQGFFHTNLSSNEVSSLNYQKRYVRFAFCKSDTTLTTVAERLGKLLDAAGHLALH

SEQ ID NO: 4445 - protein, 433 aa, Chlamydomonas reinhardtii
MCDSPNARLAVLARQLCAGGPGGSTWEHVQQAPPDPIIGVNDSYRADTDPRKLNLGVGAYRTEEGKPYVLRAVREAEAALAADPAANKEYLPIAGLPEFNRLSRELALGPSHPAIRDGRVATVQALSGTGALRVGAEFLAQHLPPGQPRVVYLPNPTWGNHKTIFGRAGMQVREYRYFDAKTRGLDFAGMCADLSAAPPGAVLLLHACAHNPTGVDPSPEQWRQLLALTQERKLLPFFDSAYQGFASGDLDADAASVRLFASAPGPQEMVLAQSFAKNMGLYGERAGALSVVCKSKEVAGRVESQLKLVIRPMYSNPPMHGAAIAARVMADPRLNALWKEELAGMAHRIKAMRQALYGQLVARQLPGDWSFVLKQIGMFSYTGLSKAQCEVLTRKWHIHLTMDGRISMAGLSAASCPYLAEAIADVVTNGGSA

SEQ ID NO: 4446 - protein, 345 aa, Neisseria meningitidis FAM18
MKFRFTAWSIYMSIKVAINGFGRIGRLALRQIEKAHDIEVVAVNDLTPAEMLLHLFKYDSTQGRFQGTAELKDDAIVVNGKEIKVFANPNPEELPWGELGVDVVLECTGFFTNKTKAEAHIRAGARKVVISAPSGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 4447 - protein, 372 aa, Robiginitalea biformata HTCC2501
MKLKIALLPGDGIGPEVAAQAVACLQAVEEAFGHQFEFTKAPVGAIAIDQTGNPLPDDTLELCKQSDAVLFGAIGDPKYDNDPESKVRPEQGLLRLRKELGLFSNIRPVKVFPTLIDKSPLRKERIENTDFVIYRELTGGIYFGEKFLSEDGNTASDLCIYSEEEISRIAHLAFKAAKGRRKKLTLVDKANVLESSRLWRRVVTRIGESYPDVELHYLFVDNAAMQMILNPSQFDVILTENMFGDILSDEGSVIGGSIGLLPSASVGESSAMFEPIHGSYPQATGKNIANPIASILSAAMLLDHFGLDEEAAAVVRSVNKALKKGMVTPDLDPKSKHGTDDVGQFIAGHISDSDDFKGLNQENIGLGKSTII

SEQ ID NO: 4448 - protein, 500 aa, Desulfovibrio desulfuricans G20
METNIYDVLIVGGGINGASAARDAAGRGLSVALCEAEDIGWATSSASSKLIHGGLRYLEHYEFRLVREALAEREVILANAPHISWPMRIVLPHAPWLRPAWLIRAGLFLYDHLSPLRQIAGSEKVNLKKHLAGRPLSDKFKTGFEYSDLGVLDTRFCLYNALDAALRGAAVHTRTRVEKAVRENGLWVARIRNTRTGEESEIRARSMVNTTGPWSNEFLTSRAESSDSGRIRMVLGSHIIVPRLYDHPYSYILQNDDNRIVFAIPYEYDYTMIGTTDVDYQGDPANAACSQAEREYLCKITNSYFRTQITPEDIVWDFAGIRPLYSDGKDATSATRDYVFKVEKDAAGNAPLLNVFGGKITAGREIGEKIVNQLLPLLGRSEAPETSQWTATAPLPGGDMPEGFDAYLYAFHRRYPWLPERMAHRLCRHYGTLAHDVLAGATSLDDLGEHFGGGLYEAEVRYQQKNEWADDAESVIWRRTRLGLHMTEEEQDRLRRWFDA

SEQ ID NO: 4449 - protein, 397 aa, Streptomyces coelicolor A3(2)
MLGIVLAGGEGKRLMPLTAARAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSLVITPGSDGQTVTGFLEKPPNPPGLGHDPGCVFPSMGNYVFTTKALVEALHRDAEDPDSVHDMGGSILPQLTDRGEAALYDFSANHVPGETTRDQGYWRDVGTLDAYYDAYMDLIAERPAFNLYNRDWPVYTHSTQLSPARFNAGGIASESIISAGCLIRGQVTRSVLSPGVVVDPGAVVQGSVLHNVHIGRGAVVRGAVLDKNVQVPPGATIGVNPQRDGELYTVSKGGVIALGKGQRVP

SEQ ID NO: 4450 - protein, 304 aa, Saccharomyces cerevisiae
MVTQQEKEFLESYPQNCPPDALPGTPGNLDSAQEKALAELRKLLEDAGFIERLDDSTLLRFLRARKFDVQLAKEMFENCEKWRKDYGTDTILQDFHYDEKPLIAKFYPQYYHKTDKDGRPVYFEELGAVNLHEMNKVTSEERMLKNLVWEYESVVQYRLPACSRAAGHLVETSCTIMDLKGISISSAYSVMSYVREASYISQNYYPERMGKFYIINAPFGFSTAFRLFKPFLDPVTVSKIFILGSSYQKELLKQIPAENLPVKFGGKSEVDESKGGLYLSDIGPWRDPKYIGPEGEAPEAFSMK

SEQ ID NO: 4451 - protein, 339 aa, Desulfovibrio desulfuricans G20
MKKVRVGINGFGRIGRQVLKTIWERHRDTVDVVAVNDLFDINTNAHLLSHDTNYRGFAPEVSVDGDIMRVGGDFVIKNYAERDPRAIPWGAMDVDIVIESTGIFTSGPKAAMHLEAGAKKVVISAPAKEEDITVVLGVNHQDYDPAKHRIISNASCTTNCLAPVVKVMHENFGIQKGVMTTVHSYTNDQRILDQPHRDMRRARAAACNMIPTSTGAAKAVALVIPEMKGRFEGYSVRVPTPTVSLVDFVAILERETTTEELRATLKNAAQGSLNGILGYSELPLVSSDFIGDPHSGIVEADFTLVQTGNLAKVYVWYDNEWGYSCRVADLVEYMRERGL

SEQ ID NO: 4452 - protein, 292 aa, Yersinia pestis CO92
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAADNPDAVIVAIICDRGDRYLSTGVF

SEQ ID NO: 4453 - protein, 455 aa, Yersinia pseudotuberculosis IP 32953
METTLMTKHYDYLAIGGGSGGIASINRAAMYGKKCALIEAKQLGGTCVNVGCVPKKVMWHAAQIAEAIHLYGPDYGFNTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGAVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 4454 - protein, 375 aa, Saccharomyces cerevisiae [sequence omitted]

SEQ ID NO: 4455 - protein, 158 aa, Mycobacterium sp. MCS
MSLPRVGLGTDVHPIEPGRPCRLLGLHFDGEDGCAGHSDGDVAAHALCDALLSAAGLGDLGGVFGTGRPEWEGVSGADMLRHVRGLLQEAGFRVGNATVQVIGNRPKIGPRRAEAQELLSELIGAPVSVSATTTDGLGLTGRGEGLAAIATALVVDEG

SEQ ID NO: 4456 - protein, 125 aa, Glycine max
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKTPFAPKVYPYDNLRVELGGEP

SEQ ID NO: 4457 - protein, 310 aa, Aeropyrum pernix K1
MLEHLVQAVAVGHALVDLRLYVERIPGVDEEAVIKDETRSVGGSAANVAVVLRRLGVQSGIIGKIGLDDFGRIAVDNLMREGVDISGLRVSLRDRTGFSVVVRDKEGSITIYSFKGAAEKLEPGEIDADAIGRSKHVHVASLRPDTTLKTVEIAKKRSITVSWDPGRVLSKMGAERLANIISKVDIIFVNRNEAKNLTGYHDYRQAARHLKKLGPKIVVIKLGASGSYILYSDGEVFVPAIKPERVVDTTGAGDSYAAGFIAGLLRGYTIEKASLYATIVASIKVSRLGSNAAPSHEEVVEKARELGVEI

SEQ ID NO: 4458 - protein, 390 aa, Nitrosomonas europaea ATCC 19718
MKKITIAGTGYVGLSNAMLLAQHHAVTALDIDAHKVELLNNRQSPIEDAEVQNFLAHKSLNFTATQDKQQAYAEADWVIIATPTDYDPQTNYFNTRSVESVVRDVLAINPRAVMVIKSTVPVGFTRRLREETGSGNIFFSPEFLREGKALYDNLHPSRIVVGECSDRAQVFADLLREGAIKKDVPVLLTDSTEAEAIKLFANTYLAMRVAFFNELDTYAAVHGLDTRQIIEGVGLDPRIGGHYNNPSFGYGGYCLPKDAKQLLANYAQVPQNLVQAIVEANRTRKDFVADDIVRRNPKVVGIYRLVMKAGSDNFRASSVQGVMKRLKAKGIEVVVYEPVLDTPDFYKSRVIRDLAAFKAMSDVIVANRCSAQLDDVKDKVYTRDLFGNDL

SEQ ID NO: 4459 - protein, 266 aa, Clostridium sticklandii
MDKKIGFIGCGNMAQAMISALVKSKLIESNQIIVSNRSKNILEKMNKEYGITIAANNIEVAEKCDIVFLAVKQNLYEMVMKEIKDSVTKDKIFVSIAPGKTMEFLEAHLGAYAKILRTMPNTPSMVSEGMTAICPNSNIASEELELLVKLIESFGAVEIIEEKLFDAVVAVSGSSPAYVFMFIEAMADAAVIQGMPRAQAYRFAAQAVLGSAKMVLESKSHPGELKDMVCSPGGTTIEAVAVLEERGMRSAVIEAMRKCAQKSKEM

SEQ ID NO: 4460 - protein, 341 aa, Oceanobacillus iheyensis HTE831
MNTKRIAITGFGRIGRMIFRQAIQNDQFEVVAINASYPAETLAHMVKYDSVHGIFDGDVKALEGYLEIDGKKVEIVNNRQPELLPWKKLDIDIVIEATGKFNSKEAAGLHIKAGAKKVIITAPGKQVDKTIVMGVNEAAYIPESDDVISNASCTTNCLAPVVKVIDDHFTIKNGLMTTVHAFTNDQKNLDNPHKDLRRARGCTQSIIPTTTGAAKALGEVLPHLNGKLHGMALRVPTPNVSLVDLVIDVEENVTVEQLNQLFKDASKGYMKGVLEYSDEPLVSIDYTTSDFSAIIDGLSTIVMEGKKIKVIAWYDNEWGYSKRVLDLALYVGDRLKKEMKV

SEQ ID NO: 4461 - protein, 565 aa, Shewanella sp. MR-4
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEARAGVKFEPKRDVVIGDRGDRYGWVEGVDGKWHLTLFIESGRIKDVPGKSLQTGMREIAKIHKGDFRMTSNQNMIIAGVAPEDKATIEGLARKHGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAIERNAGETFGNFTVRTGVVKAVIDAAKDFHG

SEQ ID NO: 4462 - protein, 179 aa, Gloeobacter violaceus PCC 7421
MESAPENKTGIWLRNGIVALASVLIAVLVFFAARNQAPTMQQLAAEAVPLDEALANGKPTLVEFYADWCASCQTMAPTVARLKERYGEQANFVMLNVDNPRWLPELQQYKVSGIPHYAFLDAAARPLGSAIGLQPSQILEDNLTALAAGAETLPKAGAPAGQTSKFTPPKKVDQPRDHS

SEQ ID NO: 4463 - protein, 340 aa, Arabidopsis thaliana
  misc_feature (92)..(92): Xaa can be any naturally occurring amino acid
  misc_feature (121)..(121): Xaa can be any naturally occurring amino acid
  misc_feature (156)..(156): Xaa can be any naturally occurring amino acid
MADKKIRIGINGFGRIGRLVARVVLQRDDVELVAVNDPFITTEYMTYMFKYDSVHGQWKHHELKVKDDKTLLFGEKPVTVFGIRNPEDIPWXEAGADFVVESTGVFTDKDKAAAHLKGGAXKKVVISAPSKDAPMFVVGVNEHEYKSDLDIVSNAXSCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 4464 - protein, 256 aa, Zea mays
  misc_feature (38)..(38): Xaa can be any naturally occurring amino acid
MKPQTLCIYPLRVYLVEQSRKLELPMAGGNDLKVLVFXTSPFVIRVRIVLNLKGLAYEYVEEDLGNKSALLLGSNPVHKSVPVLLHAGRAINESQVILQYIDEVWAGTGFSLLPADPYERAVVRVWGAYIDDKVESAWLGMLSRCANDEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 4465 - protein, 481 aa, Zea mays
MDPNDAEDSLYEAWEHRNLLLRRELIFDLRNEDHVGTEEEGDACSLDVGDGLGRGVGRGGGVSRGRITTGVGRASTSLGRGVGRGSTGSLARGTAGATGVGCSSVSLESSTGAPTGVPADGLPPLGIGRGCGKRASQGSQGSIRSVRGRGRGHASSSQSYNPPRSTSLDVDLNLNSEPTADDDVEEMIHNTTKQIYDKAAWTFDNSRIFCEICIQEINAGNRSNGIMTSRGYNNIAEKYKIATGLRHSKVQLKNKWDLLKGLYGFWLQLHKDTGLGWNATLGTYSASDEYWNRLTKGHSNWKQLKKGPPEHEELLHEMFGGIVVDGSSACTPGEVLGGNDEEDVAVDGCYGGDDKNTFASPAASSYAPKGSFPRNRATARTATSPLKPKNQMVKVMQNIHATLKENCKIANKVMLGEHLDEVIREVQSMAVRCGAKEGSAEHFMATELFRKAENRSSFKAFETDEGRLLWLKRHCARAGLM

SEQ ID NO: 4466 - protein, 338 aa, Bacteroides fragilis
MGSSHHHHHHSSGLVPRGSHMKKFTCVQDIGDLKSALAESFEIKKDRFKYVELGRNKTLLMIFFNSSLRTRLSTQKAALNLGMNVIVLDINQGAWKLETERGVIMDGDKPEHLLEAIPVMGCYCDIIGVRSFARFENREYDYNEVIINQFIQHSGRPVFSMEAATRHPLQSFADLITIEEYKKTARPKVVMTWAPHPRPLPQAVPNSFAEWMNATDYEFVITHPEGYELDPKFVGNARVEYDQMKAFEGADFIYAKNWAAYLGDNYGQILSTDRNWTVGDRQMAVTNNAYFMHCLPVRRNMIVTDDVIESPQSIVIPEAANREISATVVLKRLLENLP

SEQ ID NO: 4467 - protein, 457 aa, Glycine max
MASETNQSKNVCVIGAGPSGLLAARELRKEGHKVVVLEQNHDIGGQWLYDPNVQEEDPLGRDPWLKVHSSIYESLRFMSPREIMGSTDFPFLVKKGRDTRRFPSHTEFLLYLKDFCEWFKLSEMIKLNTKVHYVGPLNYGVPSEDLKWVVRSKENKSEEEVEQVFDAVVVATGHFSNPRLPCIQGMDTWKRKQMHSHIYRSSEPFRGEIVVVVGNFLSGQEISMELVKVAKEVHLSSKSLIIFEGLSKVISKNENFHLRPQIDTLQEDGTVIFTDGSNIIADTILYCTGYNYSYPFLDTKGIVVVDDNRVGPLYEHTFPPSLAPSLSFVGIPRKILGITFFESQGKWIAQLLSGKKVLPSYEEMMESIEEFYHSNEVAGIPKRYTHVVDAFDYCDKYGENVGFPKTEEWRKELCISAGMNAFANLETYRDSWNDDIDEKLQEALRSPYFTQLEQLSL

SEQ ID NO: 4468 - protein, 542 aa, Robiginitalea biformata HTCC2501
MLSVSNLSVQFGKRVLFDEVNATFNPGNCYGVIGANGAGKSTFLRILAGEVDPTSGHVHLEPGKRMSVLEQNHNAYDAHGVLETVLMGNKPLFAIKTEMEALYADYDDANADRIGELQVAFEEMNGWNAESDAAALLSNLGIREDLHHASMAEMEGKLKVRVLLAQALFGNPDVLVMDEPTNDLDYDTIQWLENFLADYENLVIVVSHDRHFLDAVCTHIADIDFGKINLYSGNYTFWYESSQLAARQRAQQNRKAEEKAKELQEFIQRFSANVAKSKQATSRKKMLEKLRVEDIRPSSRRYPAIIFEREREAGDQILHVEGLAARSEEGDWLFRKGELNLAKGDKVALISKDSRATTAFYEIITGNRKPDAGTHSWGVTTTTSYLPADNSAYFDKDMNLVDWLRQWAKTQEEKEEVYLRGFLGKMLFSGEEALKKCTVLSGGEKVRCMLSRMMMQRANVLLLDEPTNHLDLESITAFNNSLKQFKGTVIFTTHDHQFAQTVANRIVELTPTHTIDRYLTFDDYMSDPAIREQRQKLYGVPA

SEQ ID NO: 4469 - protein, 662 aa, Oryza sativa
MANSIAIFRRSTTYGPLQKAALTTICCMLAVAAGPNPQECLPFSCGDLGNISYPFRLQGDSRQCVSTPRPWYNLSCSRGKATIHINTRKYYVISINYTRENFLVVDATMQLDDDTNGTSCPLPRSDHLPYMIYWSDLSSIDSYGFKDLVTASDTWACFVNCSRAITNDSRYKPVTCLSGNNSFPYVYVYIYDDYGCCPVKRLQPSCRYLGMIPFDYVYQPGSYDDDIMSNVLQSASYRDIVGFIRKGFRVNFPLYNNDQRAPTIVERCLNNSMRFVLAPLVVLTFLAHKYWKTRIAIDAVEKFLRMQEMLGPKRYAYTDIIAITSHFRDKLGQGGYGSVYKGVLLPGDIHVAIKMLDGKSDCNGEDFISEVATIGRIHHINVVRLVGFCSEEMRRALVYEYMPRGSLNRYIFSSERSFSWDKLNEIALGIARGINYLHQGCEMQILHFDIKPDNILLDDNFIPKVADFGLAKLYPREKSFVSDRALRGTFGYMAPEMACRSFGVISSKSDVYSFGMLLLEMAGGRKNADPNANSNSSRAYYPAWVYDQLIVDQQVDEISSAIDMHEKERKLWLVVFWCIQMKSYDRPTMSEVIEMLEGDVDALQVPPRPFFCDGDSTPPPPVPVMDSICLYSSELTAISEEEDVDGITQLDSSCLLGYERSI

SEQ ID NO: 4470 - protein, 290 aa, Oryza sativa
MAEHLASIFGTEKDRVNCPFYFKIGACRHGDRCSRLHNKPSVSPTLLLSNMYLRPDMITPGIDAQGNPIDPEKIQADFEDFYEDIFEELSKYGEIESLHVCDNFADHMIGNVYVQFREEDQAARALQALTGRYYSGRPIIVEFSPVSDFREATCRQYEENSCNRGGYCNFMHVKEIGRDLRKRLFGHLHRSRRSHSHGRSRSPSPYHYRRDYDRRSSSRSRDHDDYYRGGSHDYYRGGSRRSSERHRSSYDSDGSRRRHRSRTRSPVRDGSEERRAQIEQWNREREAAQV

SEQ ID NO: 4471 - protein, 319 aa, Zea mays
MELFENARSVRLKSHLGTYLCAADDAEAVSHGYRRNSRGTVWAVEPAGDEYVRIQGQRGLYLGAADPTAALDAATPSCRVVQGVPSTPNDSAFLWTPRRERGAGCLTLSGPLGRLLRASFGETPRDNAVTLDFDVGPEESAWVVEAVPAEQAARPPPCRAQSCDARMQATAATTSDTASSSFIRFYSTKEPKTKLEEPPPTEEPLHMPARRTIFHNTAREDGAVDDFDEGTWRYFTFDEQSLSALSRRLQEETKHKDFVICRRSAGGDAPRLFPVVLDLPPGNDEMEFVLVLVPSTVANDLQWPLGRDDQFGKKGTFLF

SEQ ID NO: 4472 - protein, 205 aa, Zea mays
MTRSRSCSSLSRPAGDARRLSSSPPPPVHRPSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 4473 - protein, 488 aa, Bordetella petrii
MGKITGFMEFQRLQEAAEAPQKRLKNWREFVLHLNDEQSKQQAARCMDCGIPFCNNGCPVNNIIPDWNDLVYRQEWRRALDVLHSTNNFPEFTGRICPAPCEAACTLNINSDAVGIKSIEHAIIDKGWAEGWVVPQVPARKTGKKVAVVGSGPAGLACAQQLARAGHSVTVFDKSDRIGGLLRYGIPDFKLEKAQIDRRIAQMEAEGVEFAPSTYVGNPADPIADGLTVRTPDSLLAEFDAVVMSGGSETPRDLPVPGRELDGVYFAMDFLRQQNKAVAGDRLTGQTLAKGKHVVVIGGGDTGSDCVGTSNRQGAASVTQFELMPQPPESENKPLVWPYWPLKLRTSSSHEEGCERDWSVTTKLFKGSNGKVEKLVGARVEWFKDEATGQMKMREVEGSEFEIQADLVLLAMGFVSPVQNVLDAFGVDRDARGNVRANTDDYRTSVDKVFAAGDMRRGQSLVVWAIREGRQCARAVDEYLMGATELPR

SEQ ID NO: 4474 - protein, 392 aa, Neisseria meningitidis FAM18
MAFLKLTEQNVQGKTVLIRADMNVPFKDGKISDDTRIRASLASIQYCMDNGASVIVMTHLGRPTEGEFHPEDDVAPVAAHLGGLLGKNVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFTADAEAVVKDIADVAEDDMILDIGPKSAAELADLLKAAGTVVWNGPVGVFEFDQFAGGTKALAEAIAQSKAFSIAGGGDTLAAIAKFGVTDQIGYISTGGGAFLEFLEGKELPAVAALEKRGA

SEQ ID NO: 4475 - protein, 231 aa, Triticum aestivum
  misc_feature (200)..(200): Xaa can be any naturally occurring amino acid
NKFVQKSRLVPVRNSRDIVDPRVRSPVATPVAVTPRRSNSHPAARLRLRCCCSAGDPAAMVKAIRVHELGGPEALRWEEVEVGEPGDGEIRIRNTAIGVNFIDVYFRKGVYPAPLPFTPGMEAVGVVTAVGPGLTGRKVGDVVAYAGKPMGSYAEEQIIPADVAVPVPPKVEHKTAAAIMVKGMTVHMLVRRIFRLKPAXSVSRHPAAGGVGPPLWQGEKPLGCPGHWKLV

SEQ ID NO: 4476 - protein, 549 aa, Emiliania huxleyi
MAGTEAWSKLQQHYDAGMKTQKMRDLFSKDSDRFESFSATFEDVLLDYSKNIVTEETMTLLSKLIDEAQVKEMAKAMFAGEKINLTEDRAVLHVALRNRANTPILVDGVDVMPEVNGVLAKLEPFVNKVRSGEWKGHTGKPITDVVNLGIGGSDLVPVMVTEALKPYSKRDLKVHFVSNVDGTHIAEVTKALDAETTLFLIASKTFTTQETMTNANSAKSWLLAELGGDKAAIAKHFAALSINGKAVKEFGIDEQNNMFGFWDWVGGRYSSWSAIGTSIALSIGWENFVAFLEGAHEMDKHFLEADFSPEKGFKNLPMVLAALGVWYGNFFGAESYAILPYDQYMHRFAAYLQQGDMESNGKCVTRDGKHVAVGTGPIIWGEPGTNGQHAFYQLIHQGTKMIPCDFLAPVATQNPDFPEHHPILLSNFFAQTEALMKGKTKPEVEAELEGKMDTDEIKKLAPHKVFEGNKPSNSILFDKLTPRTLGSLIAMYEHKIFVQGVIWNINSFDQWGVQLGKELANKILPELNSDEPVTSHDCSTNGLMNHFKA

SEQ ID NO: 4477 - protein, 620 aa, Synechococcus sp. WH 5701
MIDTPSSTADVIEGLLADLHRRYSLLEDGAPADYIPELAKANPSDFGISITTVDGRVYEVGDTRKPFTIQSISKPFAYGLALKLFSGEYLATKVGVEPSGDAFNAISLDQKTGRPRNPMINAGAIATTAQIWNHDPHQAEALMLDFFSELAGRRLSIDQAVFQSERATGHRNRAIGHLLRNFGIIEDDPEDSLDLYFKQCSITVTCHDLAVMAATLACQGHNPFTGARPLTPEITVRMLALMATCGTYDFAGQWLYDVGMPAKSGVGGGVLAVVPGRLGISTYSPPLDVLGNSVRGIAVCNELSDSLGLSLFNQYPQTSSTIRRSYKGSQRQSRRWRAADQAKLLQGRRDAVRIVHAQGVLDFAAIERLLSELSEIMSDAWILVLDVAHVTELPEESRELFLNELTSLRRRGVIVLMARGRHLSLPRTLSVAGGVEEMPQFDQLDQALECAEDLLLESRKDEDPDPPFSTEIDQTLGFLGMLQPTHRQTLADLMQCRNFAKGEHVVKKGDPGHELFLVREGRFTITVELRGSDGQTYASRLATFEPGMCFGEIAFLSGTPRTANVTADLDGSCWVLERHDFDNLRQWEPDAVTELLLALTRDLGTKLALTSYQLTLMEHL

SEQ ID NO: 4478 - protein, 368 aa, Bordetella petrii
MKTKAAVAWKAGAPLTIEEVDLEGPRAGEVLIEVKATGICHTDYYTLSGADPEGLFPAILGHEGAGIVVDVGAGVTSLKKGDHVIPLYTPECRQCKFCLSRKTNLCQAIRATQGKGLMPDATSRFSLNGKPLLHYMGTSTFANHIVVPEIAVAKVREDAPFDKICYIGCGVTTGVGAVVYTAKVEAGANVVVFGLGGIGLNVIQGARMVGADKIIGVDLNPGREAMARKFGMTHFVNPKDVDNVVDHIVQLTDGGADYSFECIGNTQVMRQALECCHKGWGQSIIIGVAEAGAEISTRPFQLVTGRQWKGSAFGGARGRTDVPKIVDWYMEGKINIDDLITHTLPLERINEGFDLMKRGESIRSVVLY

SEQ ID NO: 4479 - protein, 806 aa, Arabidopsis thaliana
MSNQKKRNFQIEAFKQRVVVDPKYADKTWKILEHAIHEIYNHNASGLSFEELYRNAYNMVLHKYGDKLYTGLVTTMTFHLKEICKSIEEAQGGAFLELLNRKWNDHNKALQMIRDILMYMDRTYVSTTKKTHVHELGLHLWRDNVVYSSKIQTRLLNTLLDLVHKERTGEVIDRVLMRNVIKMFMDLGESVYQDDFEKPFLEASAEFYKVESMEFIESCDCGEYLKKAEKPLVEEVERVVNYLDAKSEAKITSVVEREMIANHVQRLVHMENSGLVNMLLNDKYEDMGRMYSLFRRVANGLVTVRDVMTLHLREMGKQLVTDPEKSKDPVEFVQRLLDERDKYDRIINMAFNNDKTFQNALNSSFEYFVNLNTRSPEFISLFVDDKLRKGLKGVGEEDVDLILDKVMMLFRYLQEKDVFEKYYKQHLAKRLLSGKTVSDDAERNLIVKLKTECGYQFTSKLEGMFTDMKTSHDTLLGFYNSHPELSEGPTLVVQVLTTGSWPTQPTIQCNLPAEVSVLCEKFRSYYLGTHTGRRLSWQTNMGTADIKAVFGKGQKHELNVSTFQMCVLMLFNNSDRLSYKEIEQATEIPTPDLKRCLQSMACVKGKNVLRKEPMSKEIAEEDWFVVNDRFASKFYKVKIGTVVAQKETEPEKQETRQRVEEDRKPQIEAAIVRIMKSRRVLDHNNIIAEVTKQLQTRFLANPTEIKKRIESLIERDFLERDNTDRKLYRYLALLKVDKLRLIEVCGTSESEFHCDLTSMMDLCFDFFRVSKEKKDLKETKGSKSLVDVVPQKKRRLDDTHLMMSLM

SEQ ID NO: 4480 - protein, 482 aa, Neisseria meningitidis FAM18
MKGDIGVIGLAVMGQNLILNMNDCGFKVVAYNRTIGKVDEFLNGAAKGTGIIGAYSLQDLVDKLEKPRKIMMMVRAGSVVDDFIEQLLPLLEKGDIIIDGGNANYPDTTRRTHYLAEKGILFVGMGVSGGEEGARHGPSIMPGGDERAWEAVKPIFQAIAAKTPQGEPCCDWVGRDGAGHFVKMVHNGIEYGDMQLICEAYQFMKDGLGLSYDEMHRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 4481 - protein, 544 aa, Arabidopsis thaliana
MASLQLYGVKTPGLALSSKRLEFASKGACFSVTLPSSSAVFRDVEHSCRNIGLRVSCEALRVDLLQRKEPETCDSSGTGKELTCVMKFGGSSVGSAERMKEVANLIFSFPDERPVIVLSAMGKTINKLLKAGEKAVTCGVTNVESIEELSFIKELHLRTAHELGVETTVIEKHLEGLHQLLKGISMMKELTLRTRDYLVSFGECMSTRLFSAYLNKIGHKARQYDAFEIGFITTDDFTNADILEATYPAVSKTLVGDWSKENAVPVVTGYLGKGWRSCAITTLGRGGSDLTATTIGKALGLREIQVWKDVDGVLTCDPNIYPGAQSVPYLTFDEAAELAYFGAQVLHPLSMRPARDGDIPVRVKNSYNPTAPGTVITRSRDMSKAVLTSIVLKRNVTMLDIASTRMLGQYGFLAKVFTTFEDLGISVDVVATSEVSISLTLDPAKLWGRELIQRVNELDNLVEELEKIAVVKLLQRRSIISLIGNVQKSSLILEKVFQVFRSNGVNVQMISQGASKVNISLIVNDEEAEQCVRALHSAFFETDP

SEQ ID NO: 4482 - protein, 468 aa, Arabidopsis thaliana
MTSSEPLDLVVTVVSAKHLKNVNWRNGDLKPYVVLYLDQDHPLSTRSDDSSSIKPVWNERITLPLTRSVHESVLNIEVFHSNSSDLAKTLVGSVRFPLARLIDSDGSMIPELINSLELVRPSGRPQGKIRLKLAIKDRPIPPPQHPPPRPQSQPLDYYSAPQGNHYYSPSPPPPPPPQAPITAPSPQRDYREFSQSPSPSPYAFTDHYYSGYYYPPPPPRSMYDRASNYGLPSGPSAPVDAFSSIDHKQPPLAPPRFSNYGPPPSGPSAPVDAFLVTEYKPQAPPMGSRLSSYGVPNGPSAPVDYSPYDHRQLQKTMGGLSLEEERAAAESRRLMKGICIHKATGIKRSNLNTRPVQRDASAKQTAIKGPYGKSPGCTTSCGLRLPRKTEVTAAKLIKHLGCKFAKGLRLVVMRKKKRSPPSKVSSFSGRSQPPIIPINNDSHRSEAIEDCIQFINSSSSFTRSNSTS

SEQ ID NO: 4483 - protein, 298 aa, Arabidopsis thaliana
MDSPFKPDVVRGQVALITGGGSGIGFEISSQFGKHGASIAIMGRRKQVLDDAVSALRSLGIQAIGLEGDVRKQEDARRVVEATFQHFGKLDILVNAAAGNFLAAAEDLSPNGFRTVLDIDAVGTFNMCHAALKYLKKGAPGRDSSSGGGSIINISATLHYTASWYQIHVSAAKAAVDATTRNLALEWGTDYDIRVNGIAPGPIGGTPGMSKLVPEEIENKTREYMPLYKVGEKWDIAITALYLSCDSGKYVSGLTMVVDGGLWLSKPRHLPKEAVKQLSRAVEKRSRAKPVGLPTSKL

SEQ ID NO: 4484 - protein, 422 aa, Oceanobacillus iheyensis HTE831
MTQAEKIVVENGKMNVPDTPIIPFIEGDGTGPDIWASAQKVIEAAVDKAYDGKKSIEWMEVYAGQKAYDKTGEWLPKDTLDKINEYKIAIKGPLTTPIGGGIRSLNVALRQELDLFTCLRPVRYFEGVPSPVKRPEEVDMVIFRENTEDIYAGIEWQKGSDEVKKVINFLKEEMGVKNIRFPETSGIGVKPVSEEGTKRLVRSAIDYALNEGRKNVTLVHKGNIMKFTEGAFKNWGYEVAEQEYGDKVFTWAEYDRIVEAEGKDAANKAQDEALASGKILVKDAIADIFLQQVLTRPKEFDVVATMNLNGDYISDALAAQVGGIGIAPGANINYDTGHAIFEATHGTAPKYAGLDKVNPSSVILSAVLMLEHLGWREAADLITKSMDKTIGSKVVTYDFARLMDGAKEVKCSEFGQELIKNM

SEQ ID NO: 4485 - protein, 586 aa, Oceanobacillus iheyensis HTE831
MRNTKIVCTIGPASESIEKLEQLIEAGMNVARLNFSHGDYAEHGARIENIRKAAKNKNKTVAILLDTKGPEIRTGSFKEGRADLMQGNPVTIAMDEVEGTAEKFSVTYQGLINDVHEGSKILLDDGLIELEVKSIDKSKGEIETIALNSGEIKNKKGVNVPNVSVNLPGITEKDTNDIIFGIEQGVDFIAASFVRRASDILEIKEVLDQHQAQYIKIIPKIENQEGVDNIDSILEVSDGLMVARGDLGVEIPAEDVPLVQKKLIKQCNNAGKPVITATQMLDSMQRNPRPTRAEASDVANAIFDGTDAIMLSGETAAGTYPVESVQTMSNIALKAESALDHKQMLEERSQYVDMTITEAISQSVTHTASNLNVDTIITPTESGHTARMISKYRPKASILAVTFNEVVNRQLSLVWGVHAVLGKPATSTDEMLEIAVDKGLNTGICSRGSRVIITAGVPVGESGTTNLLKVHVIGDVIAKGQGIGRRSAYGHAVFAKTNKEALEKVQDGDILVTYATEKEMMPAIEKASAIITEEGGLTSHAAVVGLSLGIPVIVGVDNVFEILQDGQDITVDGNRGDIYAGHAGVL

SEQ ID NO: 4486 - protein, 574 aa, Shewanella sp. MR-4
MDADSINSFFLIGALLAAVSVLLSPVSSRLGIPILLIFLAVGILAGEDGPGGILFDDYSTAYLVSNLALAIILLDGGMRTRVASFRVALWPALSLATFGVAITTSITGVMAAWLFDLHWLQGLLVGAIVGSTDAAAVFSLLKGRSLNERVGATLEIESGSNDPMAVFLTVTLIAILGNVDAELSASFMLISFIKQFGLGIFLGLGGGWLLWKLVNLSKLAEGLYSILVLSGGLMIYAASNKLGGSGILSIYLVGLFLGNKPTRGRHSILNVLDGMTWVSQIGMFLVLGLLLTPSDLLDIWLPGLALAFGMILFARPLAVWLSLLPFKSFSSRDRWFISWVGLRGAVPIILAVFPMMAGLPGAQLYFNLAFFVVLVSLLVQGASLTTAARLAKVELPPKPLPISRSGVEIYPSSEWEVFVYRLSENKWCIGEPLKRLSMPDGTRIAAVFRHNTLLHPSGSTCLEAGDILCVLGQEKSLEALSNLFSQAPETKEVPRFFGDFFIDTEVKLLDLAPIYGLELDEATGDMTVADLVAAELGSHPVLGDQFLWQSLHWVVAGLYEGKVTNVGIRLPAEA

SEQ ID NO: 4487 - protein, 311 aa, Oryza sativa Japonica Group
MDAPPAFRSSSPSSSNASVPMVVITVVGILAAFALLASYYAFVTKCQALRGLWSRGAMPWRGHGGGGARRRAAREASVIRTVATEERGLGMPFIRMLPVVRFTAAACGGAGGEGGGGGVGARISVSECAVCLSEFVERERVRLLPNCSHAFHIDCIDTWLQGNARCPFCRSDVTLPFTPPAAAAPVRPTSATHPDDDEDAESARRHHHHHHNHNHRPDDELINSIVIEVRGEHESWVSHRGGAAAAPPATKRTPQRRRKPESVGDEAIDTRKKYDEEFAVQPMRRSLSMDDSCHKQLYVSVQEFLTQQRQV

SEQ ID NO: 4488 - protein, 323 aa, Geobacillus kaustophilus HTA426
MILVVGGAGYIGSHLVKELVEKEQVIVLDNLSTGHRYLVDDRAVFVQGDLGNKADLEPIFGKYPIQAVMHFAANSLVGESVVNPLKYYQNNVAATLTLLETMLKYNVKNFIFSSTAATYGIPNVELITEDCPTNPINPYGRSKLMIEQILADFASAYGLNYVVLRYFNAAGAHESGEIGEDHNPETHLIPLVLQHLLGQRDKISVFGTDYDTPDGTCIRDYIHVTDLAKAHILALEALLSGKKKTAVYNLGNGLGYSVKEVIETCEKVTGRKAVIEYTDRRPGDPARLVASSQKIYEELGWKAEYSLEQIIESAWKWHSRNTK

SEQ ID NO: 4489 - protein, 251 aa, Magnaporthe grisea 70-15
MKVSPERAQALASQLRAVTERLQSAAKGRPVRLVAVSKLKPANDILALHSAPVGHTHFGENYAQELSQKAQVLPRSIQWHFIGGLQSTHCKSIAKIPNLWCVSSVDTLKKAQLLDRARGQAGEPPLNIHVQVNTSGEESKSGCAPGEETIALCRAVASDECPNLRLLGLMTIGAIARSRATTPETENEDFVCLREQRDLVAKELALEGELELSMGMSDDFEGAISMGSHEVRIGSTIFGERPAKVDAKIVE

SEQ ID NO: 4490 - protein, 456 aa, Salmonella enterica subsp. enterica serovar Typhi str. CT18
MTTRLTRWLTALDNFEAKMALLPAVRRYGRLTRATGLVLEATGLQLPLGATCIIERQDGPETKEVESEVVGFNGQRLFLMPLEEVEGILPGARVYARNGHGDGLQSGKQLPLGPALLGRVLDGGGKPLDGLPAPDTLETGALITPPFNPLQRTPIEHVLETGVRAINALLTVGRGQRMGLFAGSGVGKSVLLGMMARYTRADVIVVGLIGERGREVKDFIENILGPDGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILDGHIVLSRRLAEAGHYPAIDIEASISRAMTALITEQHYARVRLFKQLLSSFQRNRDLISVGAYAKGSDPMLDKAITLWPQLEAFLQQGIFERADWEDSLQALDLIFPTV

SEQ ID NO: 4491 - protein, 584 aa, Vibrio fischeri ES114
MQWKASTLALLISTSIVSPASFSAQSTDNIAPEASTGLTKQNLVKGKEWMIASANPYASEAGAEMLRKGGNAIDAMVATQLVLGLVEPQSSGIGGGAFLVYWDAKKQDLTTFDGRETAPLAVTPQLFQDQKGEPLKFYDAVVGGRSVGTPGTIKLMWDTHQKLGKLDWKTLFKPAIKLATEGFIVSPRLAKLVDNDQEFLQRSPVTKAYFFNQDGSPIKAGQQLKNLQYANTLEAISEQGAKAFYQGEIAEDIVNTVRNETSNPGVLNLIDFTAYQVKEREPVCAPYRQYAICGMGPPSSGALTLGQIMGILSHYPISNMGKDNVQSWRLLGDASRLAFADRGKYIADSDYVPMPTQGLLDKNYLEQRAQLLQGENALVETTAGSPPWSHANNYALDEAIELPSTSHFSIVDNERNVVSITTTIENGFGSRLMVRGFLLNNELTDFSFRSHVNGIPIANRIEPGKRPRSSMAPTIVMKDNKPYIAIGSPGGSQIIGYVAKTLVAHLDWGLNLQQAIDLPNMNNRFGAFEIEKDTPAEAWVPKLEKLGFKVQVKELNSGVQAIKLQENSLIGAADPRREGKVITK

SEQ ID NO: 4492 - protein, 458 aa, Geobacillus kaustophilus HTA426
MKLVLLSGGSGKRLWPLSNDARSKQFLKVLETQNGELQSMVQRVWEQLGNVGLADSAVIATSKSQVDMIQSQLGQDVPIIIEPMRRDTFPAIALASVYLYSVEGIRLDEVVAVLPVDPYVEDRFFHRVKDLEETVLASGADLALIGVEPTYPSAKYGYIVPASKSSDSGYLRVSHFTEKPTEEKAAELIKQGALWNCGVFAFKLDYIISLLQEKGFPIQYDELLKQYDKLPKISFDYEVVEKTEHIVVLPYDGYWKDLGTWNTLTEEMATNQIGKGVISADCENTHLINELDIPVTVLGISNAVVAVSPDGILVADKAKSPKIKELVNDFDQRPMYEERRWGWYRVLDYTKFEDGREVLTKRIGVTAGKNLSYQMHHHRSEVWTIIKGEGEFALNGEIRRVKPGDVLEIPVGAKHGIKAITDLEFIEVQTGTQLIEEDIVRIYMTWEEVEANCFSASK

SEQ ID NO: 4493 - protein, 331 aa, Zea mays
MAGDWQELGQAAAIGLLFAFLVAKLISTVIAFKEDNLRITRSPPTSPTAAAAAAPPVPSHDGSTDGGSGSDSDSDWEGVESTELDEEFSAASAFIAASAASGTSVPEEAQLRLYGLYKIATEGPCTAPQPSALKLKARAKWNAWHKLGAMPTEEAMQGYITIVQELFPNWDAGASAKRKDEDSIASASASKGPMGPVFSSLMYEEDEGNESELGDIHVSAREGATDDIVKLLAAGVEVNVRDTEGRSPLHWAVDRGHLSAVEVLANANADLNAKDNEGQTALHYAAVCEREDIAELLVKYHADLRIKDEDGNTAHDLCPSTSSWSFMNQAN

SEQ ID NO: 4494 - protein, 314 aa, Yersinia pseudotuberculosis IP 32953
MTSKNIAVIGECMIELSQKGTDLSRGFGGDTLNTAVYIARQVSAPDLNVHYVTALGTDSFSEEMLTAWQQENIQTDLIQRMDNKLPGLYFIETDESGERTFYYWRNDAAARFWLTSPAADDICQRLETFDYLYLSGISLAILDSASRQRLLKLLRACRAKGGKVIFDNNYRPRLWQSKEEAQEAYRDMLACTDIAFLTLDDEDMLWGEKPLEQVIDRTQALGVSEIIIKRGADSCIVWVKEGSEAQQYDVPAVKLPKEDVVDTTAAGDSFSAGYLAVRLTGGNAHDAAVRGHLTASTVIQYRGAIIPLAAMPTA

SEQ ID NO: 4495 - protein, 513 aa, Saccharomyces cerevisiae
MSTARPRIITSKAPLLPQQTTPEQRYWRQYTSAQLVKEHNSVTHISFNPQHPHDFAVTSSTRVQIFSSRTRQVIKTFSRFKDVVYSASFRSDGKLLCAGDATGLVSVYDSYNPRTILLSINASTHPTHVTKFHTQDNKILATASDDRVTRLWDISNAYEPQLELTGATDYVRTLSFIPAAPHLVATGSYDGLIRLYDTRSSGSTPIYSLNHDQPVENVIAVSPTQIVSCGGNNFKVWDLTSNKKLYERGNFNKAVTCLDYVENFDSPMQSALIASSLDGHVKVFDPLDNFQVKFGWKFSGPVLSCAVSPSTAQGNRHLVAGLSSGLLAIRTKKKEKRSSDKENAPASFNKNAKSNNFQRMMRGSEYQGDQEHIIHNDKVRSQRRMRAFERNINQFKWSEALDNAFVPGMAKELTLTVLQELRKRGKVRVALYGRDESTLEPLLNWCLKGIEDVRSASIVADWVAVVLELYGNTLESSPVLQELMIDLKTKVRHEIHKSKEAQRIEGMLQLLTS

SEQ ID NO: 4496 - protein, 852 aa, Bordetella petrii
MDIGFIVFGLSGLLTLVCFMPPLAGRVKLPYSVLLAIVGCLLGIGLHLHGWAPPVLGDLFDTIERFEISSETFLMVFLPVLLFETALAMNVRRLMDDIGPILMMAIVAVVVCTVVVGFAVNAVSSYGLVACLLLGAIVATTDPVAVVGIFREVGAPRRLTTLVEGESLFNDAASIALYSVLLAVLGGKGSLSVSGVFNDFVFHFVGGGIAGYVMGRGACLLFAWLRGFPTAEITLTLTLAYLSFFTSEHYLGVSGVVATVIAGLVVGSAGRTRMSPVTFEHLASSWEQFGFWANSLIFLFAAMLIPKLMAAADLEELLLVGVVFVVTLVARAIVVFGLLPLLGMTPLGTKVSTPYKTVMLWGGLRGAVSLALALAVTEQTAVPEAARQFIAVVTTGYVLATLFVNGITLRPLIRMLGLNQLSPVERTIRNQALVVALEDLQGKTDEVAKTDHISGEASERIHAVFDASLASVHDGQLSQMTDEQRVAVGLAIVAQREQEMFFDILKAQIVDWRMAESLLARSERLEDAIRTGGLAGFERGIEADVRHSKAFRLALRMHYMFGFQGWLARELGQRFANLMTKRSVAQRLMAFAREQIAPLLGEAAAQQIVAAHQRRLDLIEHALQALNLQYPSYSLWLQESHLGRTARELERIRYHDMLEQSLISGEVYADLMGQLKSRWRHIDRHPPLDMELGAAELITRVPLFEGLSADSLRAISKLLRPRLALPDQPVLTRGRHGQEMCFVASGAVSVQLPDGTAIELGSGEFFGELALLGKQNINPDVHSLGYSKLLMLSLRDFEALLARDPDLRERIQVVAKQRLRAIEVWKQFSQTGTTTPPEPPAPPRPPAEPADA

SEQ ID NO: 4497 - protein, 483 aa, Pseudomonas fluorescens Pf-5
MSVRRTKIVATLGPASNSPEVLEQLILAGLDVARLNFSHGTPDEHKARAKLVRDLAAKHGRFVAILGDLQGPKIRIAKFANKRIELKIGDKFTFSTSHPLTEGTQDIVGIDYPDLVKDCGVGDELLLDDGRVVMRVETATATELHCVVTIGGPLSDHKGINRRGGGLTAPALTEKDKADIKLAAEMEVDYLAVSFPRDAADMEYARKLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRMGKVFESCDQSIALAAMYTANHFPGVKAIIALTESGYTPLIMSRIRSSVPIYAYSPHRETQARAAMFRGVYTIPFDPASLPPEQVSQAAIDELLKRGVVEKGDWVILTKGDSYHTTGGTNGMKILHVGDPMV

SEQ ID NO: 4498 - protein, 152 aa, Synechococcus sp. WH 5701
MAVERTFLAIKPDGVQRGLVGEILGRFERKGFKLVGLKQLVPSRELAESHYGVHRERPFFAGLVDFITSGPVVAMVWEGDGVIASARKLIGATKPLEAEPGTIRGDLAVNIGRNVIHGSDAPETAVFEIGLWFEPSELSDWTPADQVWRRED

SEQ ID NO: 4499 - protein, 225 aa, Triticum aestivum
  misc_feature (98)..(98): Xaa can be any naturally occurring amino acid
DCSVCLGEFRDGESLRLLPKCSHAFHLPCIDTWLKSHSNCPLCRCNIAFVAVGMVSPEPEGGAAPAPREDRRGSQEFALTIDDYSSGQARDEPQIVAXATGGGNQEAKDRPGRSEAANGAVVEIREDGTVPPVPARAPPPMPDTQREARMSIADVLQASPEDERTVGREGGLLQAGSSRRCHGEHSKDGGGRAPPDAPTKKLPPAGRSCFSGKGGGRGKDSGPPV

SEQ ID NO: 4500 - protein, 111 aa, Allium cepa
ELQGVVMEIVITFALVYTVYATAADPKKGSLGTIAPIAIGFIVGANILAAGPFSGGSMNPARSFGPAVAAANFAGHWVYWVGPLVGGALAGLVYGDIFIGTSYEPVAQDYP

SEQ ID NO: 4501 - protein, 331 aa, Candida albicans SC5314
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 4502 - protein, 444 aa, Streptococcus pneumoniae
MRGSHHHHHHMSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 4503 - protein, 568 aa, Magnaporthe grisea 70-15
MSHSSPASSNGVKNHMVVESSPLKPFSFPTPPLPDDEEHVPFKKARTISRELSGASENRSDGSLPDDILISIFEHLDLLELLRLRAVSRHWKEVLTTSPRLCTHVNLAQYSRRINDWSIINVLAPFIGPRPLSIDISNCFHLSDEGFQTLWKSCGRNVKKWRMKSVWEVSAGQILEMSDNVKGLEEIDWSNCRKVGDNLLARVVGWVVPHPPSPTTNTTIGPGGKAVVSRSRSAKQAQHQNQPPPSMPPPGTVIGCPKLRKLDLSYCKHITDRSMAHLAAHASNRLESLSLTRCTSITDHGFQAWADHRLNALSRLSLADCTYLSDNAIVALVTAAKNLTHLDLSFCCALSDTATEVVALGLPQLRELRLAFCGSAVSDASLGCIALHLNELEGISVRGCVRVTGMGVENVLEGCGRLRWLDVSQCKNLAGWLNGGGVERWGFDDRGSRALRYTQSPEEMTFPHLQQGAVVRNSSYQNIPGYMGPGQPPSQRSARGSFSAPESVGPSVAGGSPRAATWHPGRRPGMYAPPGAGFGPVLRPVMLPKGVAKGRTKQPVRFIVEKGHVGLR

SEQ ID NO: 4504 - protein, 440 aa, Pseudomonas fluorescens Pf-5
MDISNTLPAGSAAAPATEKTTASRLKSIFSGSVGNMVEWYDWYVYAAFSLYFAKVFFPKGDTTAQLLNTAAIFAVGFLMRPIGGWLMGLYADRKGRKAALMASVLLMCFGSLIIALTPGYETIGVGAPILLVLARLMQGLSVGGEYGTSATYLSEMATKERRGFFSSFQYVTLISGQLIALAVLIVLQNILTTEELQSWGWRIPFGIGALCAVVALYLRRGMEETESFTKKKEKPKESLMRTLMRHPKELMTVVGLTMGGTLAFYTYTTYMQKYLVNTVGMSISDSTTISAATLFLFMCLQPVIGALSDKVGRRPILIAFGILGTLFTVPILTTLHTIQTWWGAFFLIMAALIIVSGYTSINAVVKAELFPTEIRALGVGLPYALTVSIFGGTAEYIALWFKSIGMETGYYWYVTACIACSLLVYATMKDTRKHSRIETD

SEQ ID NO: 4505 - protein, 333 aa, Chlamydomonas reinhardtii
SRNFATKPLALASSPRDSANGVDMLPKPLVVVGSVNADLVLPIERLPKPGETLAAASIETVPGGKGANQAAAAARAGFPTFFVGQFGRDDPNASLLRNALLGCGVDLTHAAEVDGPCGTALILLQAGGENSIIIVGGANQAAWRLSDGVKALIAGAGAVLLQREIPEPVNVEVAKLAAAAGVPVILDAGGVEGPIDPTILPCLALLSPNETELARLTGLPTDTEAQVQAAAEQLMSAGVKSVLVKLGADGSLLLPGPGQPPLRQAAIRAEQVVDTTGAGDCFTATYAVAVLEGKAPAEALRFASAAASICVQRKGAMPSLPARAEVDTLLAKQ

SEQ ID NO: 4506 - protein, 834 aa, Saccharomyces cerevisiae
MTNMAEDKTSISKVHSEFSNSSNTTGSEEESRSHQESFDGESSSGESKSKSKLNLEYSADIEPLKFRMTKTNNTNDKLKYSNNGNATDSFMRLKEHLQRGNTLNSNLRVNEFYPFNSIDTEQFENYLREPKYIKMLKRRKNLKQFRRLFLAQELMAYEGETVTSTSKSSEPTSKAIWSTKFSRDGKFMATGSKDGKIRIWKVIGSPVERAELDSSAESNKEARAKSMRIKQQVSSLNNPKEKQFLDSATEKYEEKEKLLNLYAPVFHPTPLRLYKEHVQDVLDINWSKNNFILSASMDKTVKLWHPDRKNSLKTFIHPDFVTCVEFHPTDDRFFISGCLDHKCRLWSILDDEVSFEYDCQDLITSVTLSPEEGKYTIIGTFNGYVHILMTRGLTPVSSFHVADRQTQEQNAHVMVTETDSKIRHGPRVTGLQAFRSQLDNSFRLVVTSNDSRIRIFDLEQRKLLEVLKGFHSGSSQHKAQLSIWHGQPIVVNSSDDHWVYGWRLKSSDRENDQDEPKRKPKGLARSGSLRSIFSKSMSRSSSQNNEEKPHHHLKLTNLLPLPHHSNDHYIKNTDYISFHAHNAPVTCVSIAPPETSKTLSLSNDVICELSLEFFQTSDSFDVLSRSNDDGIMSDVESSLGYNSKPGSISNASATSAIPDVVDAIGTILISTDNVGTIRVFRADMPSVIRKRVLLKLEEYNREVRRRFNSSDSLHSLSRSFNSRAKSNLAGQPAAAYTNTGKGYATGRGYSNICPKSSTSLKTLGSNAQPRTPRESMSSIFSNAHGPTTPTSAMNLPIRCNVCNGSRFEAFSGANDQQDRNYYCVDCGTVVNNFR

SEQ ID NO: 4507 - protein, 304 aa, Physcomitrella patens subsp. patens
MKHAFRKHLEKSILHKSQNLKQKPSNKVPANVEDVQTFKEQREMNKFRNMLITDNLLPQHLDNYYTLLRFLKSRRHDVNRAKRMWEGMLQWRHEFKVDTIKTDFQFTELDSVRKYYPQGHHGVDKEGRPVYIEQIGKVDAQKLMECTTLERYLKFHVLEFERTINLKFPACSLAIESHVHSSTTILDVDGVGMKNFNKQARDLLIAIQKIDSANYPEASTLYRMFIVNASPGFKLVWNTIRGLLDNKTAAKINVLGTNYQSKLLEIIDANQLPTFFGGTCTCAEEGGCLMSDKGPWNDPKIVQV

SEQ ID NO: 4508 - protein, 536 aa, Oryza sativa Indica Group
MDRVLLSSQLSSQTVVNTRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALREGKFVIAVDDESGDNEGDLVMAATLADPESIAFMIRNGSGIISVGMKEEDLTRLMIPMMSPIAEIEDISAAASTVTVDARVGISTGISAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 4509 - protein, 411 aa, Oceanobacillus iheyensis HTE831
MANLRDEALHLHKVKQGKLEINTKVPVKDAKDLSLAYSPGVAEPCKEIYDRKETVYDYTMKGNMVAVVSDGSAVLGLGNIGPEAALPVMEGKAVLFKGFAGVDAFPICVDTHDVEQIVQTVKLLEPNFGGVNLEDIAAPNCFIIEDRLKSETNIPIFHDDQHGTAIVTVAGLINALKLVGKKFSDIKVVANGAGAAGIAIIRLLQSFGVRDMIMCDSKGAIYEGRPYGMNTVKDSVAKYTNANKVEGSLSDVLEGADVFIGVSVGGALTKDMVRSMNDDAIIFAMANPDPEILPEDAKEAGARVIGTGRSDFANQVNNVLAFPGIFRGALDVRATRINEEMKVAAAEGIATLISDDELHDDYVIPSPFDERVAPLVASHVAKAAMSTGVARMNVDPEEVAEKTRKLTQQEK

SEQ ID NO: 4510 - protein, 450 aa, Mannheimia succiniciproducens MBEL55E
MANLSVAKFGGTSVANYAAMTACAKIVIADPNTRVVVLSASAGVTNLLVALANGCEATQRAKLLAEVRQIQENILNELKDAGTVRLEIEELLTNIEYLAEAASLATSSALTDELISHGEMMSTKIFVQVLRELNAQATWVDVRTVVATNSNFGKAAPDDEQTQKNSDNVLKPLIDRGELVITQGFIGRDPNGKTTTLGRGGSDYSAALIAEVLNAKDVLIWTDVAGIYSTDPRIVPNAQRIDTMSFAEAAEMATFGAKVLHPATLLPAVRSNIPVYVGSSKAPEQGGTWVTRDPQPRPTFRAIALRRDQTLLTLSSLNMLHAQGFLANVFNILAKHKISVDTITTSEVSVALTLDKTGSASSGAELLSSDLLNELSEVCTVKVDTGLALVALIGNDLHLSAGIAKRIFGTIEEYNIRMISYGASTNNICTLVHSAHADDVVRALHKELFE

SEQ ID NO: 4511 - protein, 487 aa, Fulvimarina pelagi HTCC2506
MRAQPKASHFIDGAYVEDKNSEAFDCVYSATGETIATLHAATPAIIEKAMTSAAKAQGEWAEWTPVQRSRVLRRAADIIRERNQALSELETLDTGKPIQETIVADATSGADALEWFASIAATLSGESVPLGADFAYTIREPLGVCVGIGAWNYPTQIACWKAAPALACGNAMVFKPSELTPLCALKVAEIMHEAGAPAGLLNVVQGFGKVGAALTGHELCAKVSLTGSVETGPKVYAAAAEGMRHVTMELGGKSPILVFDDASLENAISGAMLGNFYSTGQICSNGTRVFVQRGIYEKFLDRLAERTRTIKLGDPLDPDTQLGPMVSFAQLQKVQGYLKKAGEEGARLVIGGGVPEGPAFAEGAYIEPTVYADVTDEMTIAKEEIFGPVMSVFPFETEEEALSRANQTPFGLAAGVFTSDLTRGHRVAKKLQAGICWINAYNLTPVEVPFGGVKKSGLGRENGKAAVEFYSQLKTVHVGMGPVESPY

SEQ ID NO: 4512 - protein, 267 aa, Bradyrhizobium sp. ORS278
MSADTPPVPQLAARALQIADRINTAGFEGQVLSATPLAVRIGETGIAVVFRYGVVVFIGLTVAEELNFLDQLSSRLFGAITPHEEETARVQVAGESDEPIPVGGPIQVKELSLERLLIVADALAKSVVLGRSEREIANVFDTIEPFARELASLGRTSRSRVAMVRLLGAALLVQHRVSGRVAVSEKPDVLWDRPDLERLYARLEDEYELKEREDTLNRKLVVIAETATAVADIIDTKRSLRLEIIVVILIACEIVLGFYEIFARGGH

SEQ ID NO: 4513 - protein, 192 aa, Bacillus anthracis str. Ames
MNLPNKITISRIFLIPIFMVIMLAPFDWGSYTIGDVDLPIQHLVGALIFIVASATDWIDGHYARKYNLVTNLGKFLDPLADKLLVSAALITLVEMQYVPAWIVIIIISREFAVTGLRLVLAGTGEVVAANQLGKIKTWTQIIAIAAYLLHDVPLNLIHIPVADIFIWIALIFTVISGWDYFWKNRAAFVNSK

SEQ ID NO: 4514 - protein, 444 aa, Zea mays
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 4515 - protein, 168 aa, Geobacillus kaustophilus HTA426
MKKYFRVVREDFKRNNSFLSKMVISIFRLGNVYKDKKGFYCFFHLIHAFLDLFIIKLLIGSDIPKQIECGEGLRIPHGGRGIIIHPTVKIGKNVTIFHQVTIGVKEPIIQGATIENNVYIGAGAKIIGSVLIGENCRIGANAVVVKDVPPNSTVVGIPGKIIKRAEEK

SEQ ID NO: 4516 - protein, 734 aa, Glycine max
  misc_feature (193)..(193): Xaa can be any naturally occurring amino acid
MVVTTTKSSPMAQDLKTSMSSFTLPKTLKLKTKQQELLIRVATLSLIYVLAFITRLFSVLRYESMIHEFDPYFNYRTTLFLTRNGFAEFWNWFDSESWYPLGRIIGGTLYPGLMLTAAAIHSLLRFLRLFVHIREVCVLTAPFFASNTTLVAYFFAKEVWDSGAGIVAAALIAICPGYISRSVAGSYDNEGVXAIFALLLTFYLFVKAVNTGSLAWALGSAFGYFYMVSAWGGYVFIINLVPLYVLVLLVTGRYSMRLYVAYNCMYVLGMLLAMQIRFVGFQHVQSGEHMAAMGVFFLLQVFFFLDWVKHLLSDTKLFQAFLRITVTSAVAVGAVALGVGTASGYISPWTGRFYSLLDPTYAKDHIPIIASVSEHQPTAWSSFMFDFHILLFLFPAGLYFCFKRLSDATIFLVMYGLTSMYFAGVMVRLILVATPAVCLISAIAVSATVKNLTRVVRAKSQAVQSGSTKGTSSAKSSAKGVVDNSQPFQKNGAIVLLLGAFYLLSRYAIHCTWVTSEAYSSPSIVLAARGAHGNRVIFDDYREAYFWLRQNTPQDAKVMSWWDYGYQITAMGNRTVIVDNNTWNNTHIATVGRAMSSYEDEAYDIMRSLDVDYVLVVFGGVTGYSSDDINKFLWMVRIGGGVFPVIKEPDYLVNGEYRVDKGAAPKMLNCLMYKLSYYRFGELTTEYGKPPGYDRARGVEIGNKDIKLEYLEEAFTTQNWIVRIYKVKPPKNRW

SEQ ID NO: 4517 - protein, 348 aa, Clostridium perfringens ATCC 13124
MKILKWLLIFIPISIIGEFMHFSPTLMFILSALAIIPLAGLMGEATEEISFYTGPKLGGFLNATFGNATELIISFFALKDGLFDVVKASIAGSVIGNILLVLGASMLAGGLKYKTQSFNKKVMETSSSMLLFAVIGLTIPAIFMHTIKPEFLNTKYESLSVIVAVVMFAIYILSLIFSFFTHKDIYAVEQDEEDGEAKWSLKKAITVLVVATVIIAIESEFLVGAVEPMTETLGLSKLFVGIILIPIIGNAAEHSTAIIMAMKNKMDVSVEIAIGSSLQVILFVAPVLIFLSLIFKPMSIIFNAFELVALIVSVLIANRIVNDGESNWLEGVQLLAVYIIIAAMFMIV

SEQ ID NO: 4518 - protein, 223 aa, Oryza sativa Japonica Group
MAPSAANPLYEAFGLYDAASPADVDAFCSCLDAPPHAREAIRSYAEKAHELVVDVAAKLATSLGLDCSFGDWPCQFRINRYNYTPDTVGKTGVQVHTDSGFLTVLQEDDRVGGLEVADPDTGEFAPVDPLPGTFLVNLGDVATAWSNGELHNVRHRVRCVAGVQRVSIALFLLAPKDDVVRAPEAFVSAERPRRFRDFGYDDYRRLRQSTGEHAGEALARLAA

SEQ ID NO: 4519 - protein, 219 aa, Robiginitalea biformata HTCC2501
MSMEIAKRLAELKESLPDGVTLVAVSKTKDDSAIMEAYEAGHRVFGENRVQELTAKYERLPKDIQWHMIGHLQRNKVKYLAPFVSLIQGVDSPRLLREIDKRGRQAGRVIDCLLQVHIAEEDSKFGFDREELEELLAGGSLREMEHVRVRGMMGMATFTDNTAQVRREFASLKALYDRWLEADPRADILSMGMSGDYRIALEEGSNMVRIGSSIFGARD

SEQ ID NO: 4520 - protein, 108 aa, Triticum aestivum
MTLPCHLASFKLGVLFLPKTLQSVPQFSCTDKSRSNLDKLALGKNIKTKLVTLCWKGDEGKDPSAEAVRLPVPYQLPPQLYGPEDVPWSWDRRYTKKDVYGSVWPRHG

SEQ ID NO: 4521 - protein, 482 aa, Pseudomonas fluorescens Pf-5
MSAQPLLNGLYIDGQWLAGSEHLQVINPSTEGVLAQVAGGGPEAVEQALCAASAGLARWSHSSGAERAAVLRRIAAGVAERREQLMHLQSSNNGKPQFEAAMDVDDVIATFEYYAGLAEGLDAAQDANVALPSEAFSARLRREPCGIVGLIVPWNFPMVTTAWKLAPALAAGCSVVLKPSEVTPLPELELAAIIAGSGLPRGVFNLVCGTGLAVGAPLAADPRVAKISFTGSNAVGVQVMQRAAETVKGVSLELGGKSSLLVLADADLDLAVELACGGGFFNAGQMCSATSRVLVADELADEFLLRLKARAEAIRVADPFDPEVEMGALVNQAQYRRVQAHIEEGLNVGAKLVCGGGRPAGLQQGYFIQPTVFTEVPLDSALWREEIFGPVLCVRSFSNEQQAIEMANDSEFGLVASVVGADAAHAEQVANALQAGLVWINAPQVIFPQTAWGGYKQSSIGRELGPWGLQAFQEIKHVIRAR

SEQ ID NO: 4522 - protein, 532 aa, Saccharomyces cerevisiae
MSNDGSKILNYTPVSKIDEIVEISRNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 4523 - protein, 335 aa, Mannheimia succiniciproducens MBEL55E
MKTLDEFIVDRQAEYPNAKGALTGILSSIRLVAKVIHRDINRAGLTNNILGFSGIDNVQGEHQMKLDLFAHNMMKQALMAREEVAGFASEEEENFVAFDTERGRNARYVILTDPLDGSSNIDVNVSVGTIFSIYRRVSPIGSPVTLEDFMQPGNRQVAAGYVVYGSSTMLVYTTGNGVNGFTYDPSLGTFCLSHENMQIPATGKIYSINEGQYLKFPMGVKKYIKYCQEEDAATNRPYTSRYIGSLVADFHRNLLKGGIYIYPHATNYPQGKLRLLYEGNPIAFLAEQAGGIASDGYNRVLDIQPSQLHQRVPLFVGSKQMVEKAQDFMHQFKED

SEQ ID NO: 4524 - protein, 125 aa, Mycobacterium sp. MCS
MSDRIELRGLTVRGNHGVFDHERRDGQDFVIDLTVWLDLAPAAASDDLADTVDYGGLAQRAAGIVAGPPRDLIETVAAEIADDVMKDQRIEAVEVVVHKPEAPIPLTFADVAVVARRTRAREERK

SEQ ID NO: 4525 - protein, 257 aa, Zea mays
  misc_feature (71)..(71): Xaa can be any naturally occurring amino acid
MASRKFFVGGNWKCNGTGEDVKKIVTVLNQAEVPSEDVVEVVVSPPFVFLQQVKGLLRLDFAVAAQNCWVXRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 4526 - protein, 445 aa, Thiomicrospira crunogena XCL-2
MTFASLGLSKPILDAVTQQGYETPSPIQAQAIPAVLEGKDVMAAAQTGTGKTAGFTLPILERLSKGKPAGPNQARALILTPTRELAAQVSDSVETYGKQLSLKSTVVFGGVKINPQMMRLRKGVDILVATPGRLLDLFNQNAIKFDQLEILVLDEADRMLDMGFIHDIKRILKALPKNRQNLLFSATFSNEIRQLAKGLVNNPVEISVTPRNTTATTVTQWIYPVDKGRKAALLTKLIKENDWSQVLIFSRTKHGANRLTKQLEGKGIKAAAIHGNKSQGARTKALASFKDGTVQALVATDIAARGIDIDQLPHVVNFDLPNVAEDYVHRIGRTGRAGAVGEAVSLVSADEVKELAGIENLIQKLLPRKIIDGFEPTNDVPETRLNHRPKKPKKPKKPKAPHTSGKDTSENKPDAHAPKKNPANRNRRTNKPKSSPHSGSPKTSH

SEQ ID NO: 4527 - protein, 357 aa, Physcomitrella patens subsp. patens
MPIAMGPLPSTLGRDRTSEFHAILDRLRKTQGSTLPYTNGAKCSTTNGHADETARLLPQATGALQSEFNKRASQIGLSIHQTSQKLSKLAKLAKRTSMFDDPAVEIQELTSVVKQDITALNAAISDLQKLCDSRNDGANQSKQSSEHSATVVDTLKSRLMNTTKEFKDVLTLRTENLKVHDNRRQLFTASPNKQVNPYARQGPLASAVPSSASSTGASLPPWSNGTGRSNELFSSRRRPTADGLESSQSQGRLQQQQQQLVPVQDSYMQNRAEALQNVESTIVELSSIFTQLASMVAQHGEIAIRIDENMDESLSNVEGAQTQLLKYLDSISSNRWLILKIFMVLIAFLLIFVVFVA

SEQ ID NO: 4528 - protein, 303 aa, Glycine max
  misc_feature (286)..(286): Xaa can be any naturally occurring amino acid
MDQSSGLNLEDLKWDHSFVRELPGDPRRDSFPREVLHACYTQVSPSVQVHNPQLVAFSQPVADLLDLDHKEFQRPDFPLFFSGATPLVGALPYAQCYGGHQFGMWAGQLGDGRAMTLGEILNSNSERWELQLKGAGKTPYSRFADGLAVLRSSVREFLCSEAMHHLGIPTTRALSLVTTGNLVTRDMFYDGNPKEEPGAIVCRVAQSFLRFGSYQIHASRSDEDLGLVRVLADYAIRHHFPHIQNMSKSDSLSFCTGDEDHSVVDLTSDKYAAWVVEIAERTGSLXARWHGVGLTHSVLTTLT

SEQ ID NO: 4529 - protein, 376 aa, Oryza sativa
  misc_feature (122)..(122): Xaa can be any naturally occurring amino acid
HEARCWAGFLETGSCISEGFCTSSRPFRDAGLDFSKQGVAVTQENSLLDNTARIEGWLARFPMFDWVGGRTSEMSAVGLLPAALQGIDIKEMLVGAALMDEETRNTVVKENPAALLALCWYXASEGIGNKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 4530 - protein, 444 aa, Thiomicrospira crunogena XCL-2
MLSKLLTIFILSTSLILTACAKEPAMNPSPSSSDKTDYIVLGMGCFWGAEKRMGEVPGVITVESGYAGGDQKNAGYYDVLGLEKEIRYGKSDLRNHAEVVKVTFDPQKTDLKTVLIKFWESHDPTQGDRQGNDIGTNYRSAIYTHSEAQTAIAKKTETVYQKALDKAGFGKITTEIAPLRNYITAEEYHQDYLKKNPNGYCGLGGTGVKYPAASPDDASAMPEEAPVAKRLLGRDLSAERQLVVFEAEDCAFCKKFKAEVLSTWQSEVPIVTTLNPNVPEGWHLEKALFATPTIVLFEQGKEVSRYTGYNGDKERFWKWLGFRLLTPEQRRIAFEQGTEYAFTGSHLDEKRSGTFVDPITGAALFRSDTKFESGSGWPSFFNPVEGAITEHKDTSHGMTRIEVRSASSGIHLGHVFNDGPPPTHKRYCINGNVLKFVPDEKAEQ

SEQ ID NO: 4531 - protein, 237 aa, Bacillus anthracis str. Ames
MKKYALVTGGSGGIGSAISKQLIQDGYTVYVHYNNSEEKVNELQKEWGEVIPVQANLASSDGAEQLWEQIEHPLDAIIYAAGKSIFGLVTDVTNDELNDMVELQVKSIYKLLSMALPSMIQRRSGNIVLVSSIWGQIGASCEVLYSMVKGAQNSYVKALAKEVSLSGIRVNAVAPGAIETEMLNVFSEEDKNEIAEEIPLGRLGLPEEVAKTVSFLVSPGASYITGQIIGVNGGWHC

SEQ ID NO: 4532 - protein, 187 aa, Clostridium perfringens ATCC 13124
MSLINKKVSDFKVQAYQNGEFKEVTSEDLKGHWSVFVFYPADFTFVCPTELGELADNYESFKEIGCEVYSISTDTHFVHKAWADASDTIGKIKYPMLADPTGKLARDFEVMIEEEGLALRGSFVINPEGEIKAYEIHDNGIGRNAEELLRKVQAAQFVAEHGDQVCPAKWKPGEETLAPSLDLIGKL

SEQ ID NO: 4533 - protein, 234 aa, Nitrosomonas europaea ATCC 19718
MKIILIKAYELESELERRGKTEMLQYVRNLLPDDMKCVYIRQSEALGLGHAVLCAQPAVGDEPFAVLLADDLLEGDPVVIRQMVDVYEYYKCSVLGVQQVPREDTRSYGIVASQPIRDDLEAVQFIVEKPDPEEAPSTMAVVGRYVLTPRIFHHLIRLGKGTGSEIQLTDGIAALMQEEQVLAYRYKGQRYDCGSKIGYLEATLAMARKHPEVGAQFEQLLQSFQHQGNSEERQ

SEQ ID NO: 4534 - protein, 71 aa, Nitrosomonas europaea ATCC 19718
MKIRKAVFPVAGLGTRFLPATKASPKEMLPVVDKPLIQYAVEEAWAAGITEMIFVTGRSKRSIEDHFDKGV

SEQ ID NO: 4535 - protein, 488 aa, Canotia holacantha
  misc_feature (481)..(481): Xaa can be any naturally occurring amino acid
MEVSALEKKNLGRIAQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKSAPAFIQLETKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGFPEQAFYLVGNIDEATTKATNXEMENKLK

SEQ ID NO: 4536 - protein, 412 aa, Cyanophora paradoxa
MAFVVGVPAIAGKAPAAQKNATCSQGKGFASFMGMKAVKNTPKFAYAAEEERSLFTVVDAQTAAGGETVAEATTMKVKVAVNGFGRIGRNFVRCLEGRKQTNLELVAINDTGGAKLSAHLLKYDSILGRFDADVKYVDDGAISVNGKTIKVVSTRDPTTLPWKELGVEIVIESTGVFIDGPGAGKHIAAGAKKVVITAPAKGSDIPTYVVGVNHKDYNPSTDHIVSNASCTTNCLAPFVKVLDEKFKIIKGTMTTTHSYTGDQRLLDASHRDLRRARAAAMNIVPTSTGAAKAVALVLPNLKGKLNGLALRVPTPNVSIVDLVVQVEKKTFADEVNAALREAANTDLKGVLVVSDEPLVSCDFRCTDQSSTIDASLTMVMGDDMVKVIAWYDNEWGYSQRVVDLAEIVAQSM

SEQ ID NO: 4537 - protein, 598 aa, Vibrio fischeri ES114
MSNVIFSQKLYDTAQMVVDGCMGDADPACQTACPMHTDVKQYVRLAGEGNYQEALDLIRGKLFLPQTLGRICAHPCEAACRRNTEYNQPISVAGIKRFVAEKMDKQSNWDLTVANDSGKKIAIVGAGPAGAQAAIELRRSGHQVTIYEKLNVYGGMMRVGIPEYRLPRDVIDFEYGYLDMLGIETKFGIEIGKDISFNELRLSHDAIILAHGAHVGSIIPLPGHKAQGVFSAVEYLKEVSETRDFPRAGKRIMVIGGGDVAMDCARSSWRIGVDEVHQCSLEEMAKLPASQIEIDESLEEGVLFNAGWGPISIEETDGKVTGIVLKKVISIFDENGNFSPSYSDETRTIAVDTVIFATGQVVADITDGALEQTRGGRYVVDKDTLASSVDGVYVAGDACGGNIVVEAMALGHKAALSIERQFAKRPLTENRDFEKEYNYPSRLDIPLPKGTTDTPRLHGQLRDAEERKQDFKQVDLGFSEEQIKQEASRCLQCTCKLCMNECVMMNDFGDCPKTLFSDFINNKTMDPLLAYSCNACDQCTIVCPKDYPMKEMFLSARVDFVNANGGNSPIPGHKAINMHQKLGFSKFFTMAKRTVASK

SEQ ID NO: 4538 - protein, 707 aa, Burkholderia pseudomallei K96243
MIDYTLDDDGIATLSWNLPARSQNVLNGESCEAFFAAAARALQDAAVKGMLVTSAKPDFIAGGDLEWLQASDSAETLFARTCELHRALRALETGGKPVAIAMPGSALGGGLEIALAGHYRVAADNPKARFGLPEVTLGLLPGGGGTQRLPRLVGVQASLPLLLEGKRLKAADALAAGILHAVVPAGEEIAAARAWLLDASRRTATQPWDAKGFRIPGGALTHPSVQQVFMAANALARQKTYGNYPAVASILSCVYEGLLTDLDTGLKTEARYFVKAVLSPEAKAMIRTLFFGMNEANKLAARPAGVPTQRYRKVGVLGAGMMGAGIAYVSAKAGLDVVLIDTGEEAAARGKDYSRKLVDKQVQRGRLAREKADALLAKIVPTTDFARLDGAQLVIEAVFEDRAIKADVTRRSEAVLAPDALFASNTSTLPITGLAQASARPANFIGLHFFSPVDKMPLVEVIVGRDTSEATLARALDYVKTIGMTPIVVNDSRGFYTSRVFSTYVLEGLAMLAEGVAPALIENAGLLAGMPVGPLALTDEVSSELIHKITRQTRADLGDAYVARPGEDVAARMVELGRLGRKAGLGYYDYPASGGKKALWPGLAQEFPLAAEQPDVAALIERLVTVQAVETARCLEERVLTTARDADVGAILGWGFPAFRGGPASYIHGVGVDAFVATCDRLAARHGARFAAPALLREMAAQGRSFY

SEQ ID NO: 4539 - protein, 294 aa, Geobacillus kaustophilus HTA426
MKKVRKAIIPAAGLGTRFLPATKAMPKEMLPIVDKPTIQYIVEEAVASGIEDIIIVTGKGKRAIEDHFDNAFELEQNLIQKGKYDLLEKVKEPSKVDIHYIRQKEPKGLGHAVWCARNFIGDEPFAVLLGDDIVQAETPCLKQLIDQYEQTLSSVIGVKRVPDNETHRYGIIDPIEQHGRRYQVRQFVEKPAPGTAPSNLAIMGRYILTPEIFLFLEKQEAGAGGEIQLTDAIQKLNEIQRVFAYEFEGKRYDVGEKLGFIQTTIEFALQHDELREDLIQFMEKLLNDVKVEEK

SEQ ID NO: 4540 - protein, 304 aa, Helicodiceros muscivorus
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTTGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 4541 - protein, 214 aa, Zea mays
  misc_feature (207)..(207): Xaa can be any naturally occurring amino acid
EELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEXLRDRAPG

SEQ ID NO: 4542 - protein, 147 aa, Arabidopsis thaliana
QTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 4543 - protein, 467 aa, Yersinia pseudotuberculosis IP 32953
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWKSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERVKSSEIPS

SEQ ID NO: 4544 - protein, 189 aa, Pyrococcus horikoshii
  misc_feature (112)..(112): Xaa can be any naturally occurring amino acid
  misc_feature (148)..(148): Xaa can be any naturally occurring amino acid
MMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEXEIFKGLPKRLKVWESHMDEVKELPPKFKILARSETXPIEAMKHEELPIYGVQFHPEVAHTEKGEEILRNFAKLCGEL

SEQ ID NO: 4545 - protein, 148 aa, Arabidopsis thaliana
MEQTFIMIKPDGVQRGLVSVKSSAGLRRRVSLCLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 4546 - protein, 199 aa, Triticum aestivum
HGLEEYEKPECLLPSKLYTYIVPPWPPTVMASWATSVAPFQGLKSTAGLPVSRRSNGASLDSVSNGGRIRCMQVWPIEGIKKFETLSYLPPLSTEALLKQVDYLIRSKWVPCLEFSKVGFIFREHNASPGYYDGRYWTMWKLPMFGCADATQVINEVEEVKKEYPDAYVRIIGFDNMRQVQCVSFIAFKPPGSEESGKA

SEQ ID NO: 4547 - protein, 440 aa, Bordetella petrii
MKITVIGTGYVGLVSGACLADMGNEVLCLDVDAAKIQTLQQGGIPIYEPGLDDLVKRNAQAGRLKFTDDVAASVAFGDVQFIAVGTPPGEDGSADLQHVLAAARNIARHMTTRKVVVDKSTVPVGTADKVRQAMAGVLAERGVDVPFSVASNPEFLKEGAAIKDFMSPDRIIVGADDDYTVDVMRRLYAPFQRTHERLMVMDVRSAELTKYAANAMLATRISFMNEMANLAEALGADVEQVRRGIGADPRIGYHFLYPGVGYGGSCFPKDVQALVQTAAEHGLPMRVVAAAEAANDAQKLRLSQKIVARFGEDLSGRTFALWGLAFKPNTDDMREAPSLTAIAELTRRGALVRAYDPIAMPHSRQILAHNPAVAFADDMYQALDGADALLIATEWKVFRAPDLDRMRALLKTPLVIDGRNLYVPAEIRAQGFEYLGIGRA

SEQ ID NO: 4548 - protein, 525 aa, Zea mays
  misc_feature (126)..(126): Xaa can be any naturally occurring amino acid
  misc_feature (133)..(133): Xaa can be any naturally occurring amino acid
MDVALSTIVFVIAIFIPALLTLVQRSRSRHAGHNPPPPPEPRAIPLVGHLHHLLRKKPLHRCLAHLAERHGDVLGLRFGSSRVAVVSSASVAQQCLVALDTSFGNRPRLPSARILSYEWSTMGHSXAGPYWRXLGGTTSTEFSSVERVQHFADVHEQEARAMARRLCRVAHASGGRALVDVKSRLLEMLMNGLLDMLFRRTTSRSRSSDEKDEAVEVSEEARCFMAMAEETMELTLTVWDFLPPLARWLDVDAVGRRLQRLQANRTEFLQRLIEEHKEMEKSGQVTRRTLVGVMLELQDKDPEAYTDQLIRSLCVSALEAGTLSTGYTIEWVMSLLLNNPHIMKKARDEIDACVGEPKRLLDATDLPKLPYLRCIILETLRLYPVVPLLVPRESSTNCTVNGFNIAKGTMLLVNTFAIHRDPRTWDDPETFLPERFEDGSNQSGKTTMTTDLSFGMGRRRCPAENLGMQLAGIALGTMIQCFNWERVGTELVDMAEGSGLTMAKKVPLEAFCQPRASMVDLLANI

SEQ ID NO: 4549 - protein, 431 aa, Synechococcus sp. WH 5701
MFDSLDLVIDSIVAREVLDSRGTPTVEAEVRLEGGAQGHAIVPSGASTGAHEAHELRDGGSRYAGKGVLQAVANIEEKIAPVLCGLTAIEQVAVDTTMIELDGSDNKSALGANAILAVSLAVARAAADGVGLPLYRYLGGPMATLLPVPLMNVINGGAHAANNLDFQEFMLVPHGAPSFREALRMGTEVFHVLKGLLSDQGLSTAVGDEGGFAPNLESNDAAGALLVAAIEKAGYKPGEEISLALDVASTEFYADGRYAFGGGSYSSAEMVDQLDALVSRYPIVSIEDGLAEDDWEGWALMTERMGSRLQLVGDDLFVTNTSRLQRGIDAGTANSILIKVNQIGSLTETLQAIDLAGRAGYTSVISHRSGETEDTTIADLAVATRAGQIKTGSLSRSERVAKYNRLLRIEDELGSQALYAGAEGRGPQGKL

SEQ ID NO: 4550 - protein, 107 aa, Mannheimia succiniciproducens MBEL55E
MSEVLHATDASFEADVLRSDVPVLVDLWAPWCGPCRMVAPILDDLAAELAGKVKIVKINIDENQGTPAQFGVRSIPTLLMFKDGQLVGTQVGALPKNQLAAFVEKNL

SEQ ID NO: 4551 - protein, 384 aa, Nicotiana tabacum
MGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISGYDQTLFEDERKNRMMETKELFEWVLKQPCFEKTSFMLFLNKFDIFEQKALKVPLNVCEWFKDYQSVSTGKQEIEHAYEFVKKKFEESYFQCTAPDRVDRVFKIYRTTALDQKLVKKTFKLVDETLRRRNLFEAGLL

SEQ ID NO: 4552 - protein, 162 aa, Mycobacterium sp. MCS
MEFEVVIEIPKGSRNKYEVDHETGRLKLDRYLYTSMAYPTDYGFIENSLGEDGDPLDALVLLPESVFPGCIVDARPVAMFQMTDEAGGDDKVLCVPAGDKRWDHIQDLADVPEQVLEEVKHFFVHYKDLEPNKYVKAADWTGREAAEAEVQRSFERFEAEGH

SEQ ID NO: 4553 - protein, 87 aa, Zea mays
  misc_feature (23)..(23): Xaa can be any naturally occurring amino acid
SLQRHGPSRKFFVGGNWKMNGRXQSLGELIGTLNAAKVPADTEVVCAPPTAYIDFARQKLDPKIAVAAQNCYKVTNGAFTGEISPGM

SEQ ID NO: 4554 - protein, 446 aa, Glycine max
SARARSREIDFENPPPWDEQQNQNYKAKFMCSYGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSV

SEQ ID NO: 4555 - protein, 2544 aa, Nitrosomonas europaea ATCC 19718
MGRSINKHATDDSRSESLNTGTQESGTDKSSSSPVAIVGFAFRFPGDVSDETDFWNALKQKRDLVTQIPADRWAVDELQHDKRSEHGRSITFSAGVLSHIEEFDASFFGISPREAAVLDPQQRLLLELTWETMENAGIPPSSMAGSDCAVYVGISGFDYGMCEVDDLAVITSHSMTGNTLSIAANRISYAFDLHGPSLAVDTACSSSLVALHHACNCLRNGEASTALVGGVNLLLHPYPFVGFTKASMLSAKGRCKPFDASGDGYVRSEGAAVLLLKPLEKALADGDDVHAVILSSGVNADGARKTGITIPSSDGQAELMRAVLSRSGLSSKEVDFIEAHGTGTVVGDPVETRAIGMVYGQERTRPLPIGSVKANLGHLEPASGMAGLIKTILALKHRALPPAIHLHTPNPHIDFQALNLELIRKYKPFSRKRKKPLVAGVNSFGFGGANAHVLLKEFVPQDSKADTSSTMESLPPLFLSARTEAALRATAEHYVELLKGKSPQEFYDIAHAAAYRREQMEKRLALHTGKVDSTVDLLDRYAKGDMVSRVFVEDELPQSGGVAFVYSGNGTQWAGMGRALLAESPRFKEILSEIDEIMLPQAGFSLITELEAEDTNSRLDDTRVAQPLLFAIQVGVTTLLREQGIEPSAVTGHSVGEIAAAWASGALDLQQAIHVICVRSQAQGLTRGKGRMAAVGLSVEAIQEIITTLGVDAEVEIAGINSPGNVTLSGPLEDLQQIQSVAESRGIFFRLLDLDYAFHSRQMDAIEEPLIRQLGELAPAYTERATFVSTVTGNEIDGRLLDAGYWWRNVRQPVQFAAAINRIAGLGCRILIEIGPHAILQRYMGECLAAAEVQGRVIPTLRRDDNGLQRITETVLRTQLLAERPSLQTYFSVPGRRVRLPNYPWQRERHWIPWTNEGLHSLDRRRVHPLLGWRIPGVDTLWENTLDPVTLPWLADHKVGGAIVYPGAAYAEMSLAAAREWLGGKHFTVEQLDIISPMVFDGEHARTTHLILNPRDGGFQIKSRQRLSDDEWTLHASGRILEAVNRIPVARIDAPAVSAEHVGHEIHYQRASQLGLDYGPGFQGVSNINIAAERLEATLSCPELQHFDDYLLHPAILDLCFQSLIDFFGEAIDAGQGIALLPVKMGKLNFCGNGKVAFLRARLCRHGTRSALADFELLDNQNNLIASASACRFRAAHLKRHVQQNISNWRIVPWLKPHPLDGMTTAMPPVAGLIEQVRAQFDRVKHDRHTLFKEILPLTEALTLSFAWQAVRQIQQYRPLDWQQIFDGSHATAHARWLANLLITEGLLNKDDAGQWFVTIDADLPSPETVWQTLLNDFPVYLPQLMLMGRVGQQLPALLCGETDALKLLNELKHSPVAEMRYHDDPVYLGMRLALEEIFRNLAGSWPVSRRLRILEITAGSSELPKILTGSLPEDRFDYVLALPDEAMQARQQIEYQEDASIVVARYEPATLKLSADRRLPDAFDVIVLHHALHRTNSPHTALAQIRHLLAAGGILLLAEQHSDWSTNFLEGIDPGWWRQRNKTPDLPVSPLLSPATWQQLLKDAGFTDTETFFEPAAEGLAEGAYLLLARCPARDSAIIPEPVTASWLLVADESSATLARHLSNRLQSSGQQVTITSRIDDDLLQNTDHIVHLPGWNDTPDQAADTVTRLMEDVKLLAARIGKTPQFWLVTRGGTLISGCPAESESSPAQSALWGFGRVVMNEYPQLACTLIDLVCNPATVNLADRLVNELLVPDGSNEIVLSAAARYCLVMQEATNQQIRTTEQSEKKDERFHLDFHVPGQLRNLVWLPDVKRQLGDDEVEVCTRATGLNFRDVMYLMGLLPDEAVENGFAGASLGLEFSGIISRVGARVKGLLPGDAVMGFGSSCFASHVITRADAVAPMPENWSFEAAATVPTVFLTVYYALKQLAALQPGERVLIHGAAGGVGIAAIQLARYLGAEIYATAGSDEKRDFVKLLGADHVFDSRSLAFADDILDATAGEGVDVVLNSLAGEAMRRSIDVLKPFGRFLELGKRDFFENTPVGLRPFKNNISYFGIDADQLLTARPRLAVQLFHEVMALFREQALAPLPYRVFSANRITDAFRVMQQARHIGKIVVSLADARPDIEQPLQPVPAIRFERNSTWLVTGGLSGFGLESARWLAERGVDHLVLAGRRGMDTPGAKEIIETFAVQGVKVIAQACDITHAAAVDTLIERIGKTLPPLKGVLHAAAVFDDQLISSLDQKRISNVMDAKLLGAWHLHQATLGTPLDYFILYSSVTTAIGNPGQANYVAANAGLEGLAAMRRHMGLPATCIAWGPVSDTGYLARNQAVRDSLEQRLGKPPLPAAEALTQLDVALNDETGFVIPADFDWNTLSHLLPSASGNRFAILNRNRRSTSQTTESIDIRTFIIGKTRAEVTEIVRGFVVEEVAQILSISPDRIESGRSLHDHGMDSLMAVELALGLERRFGIQLPVMMLNDAPTIHTVTARIVEKLTNKGDMPEGEQSVSQVTEFIRQHGEELMPEEIDILSEDVRHFAQQGTSLIA

SEQ ID NO: 4556 - protein, 308 aa, Streptococcus suis 89/1591
MAIYQNITQLVGKTPVIKLNNIVPEGAAEVYVKLEAFNPGSSVKDRIALAMIEDAEKAGTIKPGDTIVEPTSGNTGIGLAWVGAAKGYKVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 4557 - protein, 466 aa, Streptococcus suis 89/1591
MDAKLRYKAKKIKIVFFDIDDTLRVKNTGYIPESIQQVFNSLKEKGILTGIASGRTPYGLVPEIKALKPDFFAMINGSYVEDAKGQVVYHQPMPQNIVESVLNWAKEIGIEYGMLGSQKGTLSARTDRISQVIDLIYEGLEINPTFYKENDIYQLLTFEKDGHEVELPEELQAELRSVRWDAISSDIVLKGSSKATGVAKVVEKLGLKPENVLVFGDGLNDIELFDYAGISIAMGHSHPELQKHADYITKKVEEDGIFDALEKLGMVEKEKYFPQLDLENVTGPVAHIKTNHGKLTVKLFPEIAPKTVANFVALSKDGYYDGIIFHRIIKDFMIQGGDPTGTGMGGESIYGTAFEDEFSMEAFNLRGALSMANAGPNTNGSQFFIVQNQNFPYNAKELERGGWPKEVAEAYVKNGGTPHLDQRHTVFGHLVDEESFVVLDAIAAVATDSADRPHEDVVIETIEIED

SEQ ID NO: 4558 - protein, 423 aa, [Brevibacterium] flavum
MENPSLRELDHRNIWHPYAAPGVRNRLVTNTDGVFLTLEDGSTVIDAMSSWWSAIHGHGHPRLKRAAQKQIDTMSHVMFGGLTHEPAIKLTHKLLNLTGNAFDHVFYSDSGSVSVEVAIKMALQASKGQGHPERTKLLTWRSGYHGDTFTAMSVCDPENGMHSLWKGTLPEQIFAPAPPVRGSSPQAISEYLHSMELLIDETVSAIIIEPIVQGAGGMRFHDVALIEGVAALCKKHDRFLIVDEIATGFGRTGELFATLSNGVQPDIMCVGKALTGGFMSFAATVCTDKVAQLIRSPEGGGVLMHGPTFMANPLACEVSHASLEIIETGMWQKQVKKIEAKLIAGLSPLRCIPGVADVRVLGAIGVIEMEQNVNVEEATQAALDHGVWIRPFGRLLYVMPPYITTSEQCAQICRALHAAVKGK

SEQ ID NO: 4559 - protein, 269 aa, Arabidopsis thaliana
MADNDSLDQFLAAAIDAAKKAGQIIRKGFYETKHVEHKGQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 4560 - protein, 491 aa, Burkholderia sp. 383
MTNNTLLSPATVWSEKIYSNGWTRSNFGNTEDVLEKATGKRLGAIGIASSQDVAKAAAIAREAQKAWANVPGPKRGDVLREFSWLVLVHANEIADQIVRETGSIRAKALWEVQVSAREVLEAAALGSQPEGVLVATAEAGRQSIARRIPVGVIGVITPWNSPFILGSRAIGPALAMGNAVILKPDVQTPIAGGVTFARLFEEAGLPAGLFHVLPGGADTGSALVNEPLVDMISFTGSTRVGRQIGSIAGGQLKRVSLELGGNNPYIVLEDADIEAAASAGAWGAFFHQGQICLTAGRHLVHERVAEAYAAALVRKARALVVGDPFDDRVQIGPIINERQAANVDRIVAETRDQGATVLAGGTRNGLFFEPTVIVGVRPGMAAFDEEIFGPVAPITTFSSDDEAVALANGTDYGLVAAVASADLAHAQRIADRLHSGVIHINDQTVLHEVYGPIGGVGASGNGFNHSTLTNADQFSEWQWITTRQQIPAYPF

SEQ ID NO: 4561 - protein, 386 aa, Rickettsiella grylli
MTTFHLPDLGEGLPDAEIREWYVKRNDWINIGEPMVAMETAKAVVDIPAPFGGRVTQLYGQVGDIIKTGDALIDIGEESSKTKKNVEKNQATVVGHLQQRDTILEESLSSHTKQQSGSHLKVIKATPAIRALAKKFKINLNDVKGTGPDGQILVDDIERKIKEKSDQNVSSANVGDPGYEPLRGVRRTMAIVMKQSHHSIVPVTLVDDADIHAWPEKTDITLRLIRAIMTACQREPRLNAWFDESQFALRQHHQIDLGIAMDAPEGLFVPVIKNIAQESAVNLRKTIDKLKAEVKNRTISPDALIGPTFVLSNIGIFAGRYATPIIIPPLVAILAVGRMNEKVVSLQGKISTHKQLPLSLTVDHRVITGGEAARFLSALLIDLQAA

SEQ ID NO: 4562 - protein, 501 aa, Oryza sativa Japonica Group
MASHLDFRYLDEGLGGERGKRKRREAEEAAAADSMDLDADADAPRPSKLRRGALPPTYDGVIAGRVSGRRWKEARTRRASALAASRKPTPLEQRARDKSLKRAYQARVAELKEEIRQSKAAKRKQREEREKRKKENVLRSGTKLQRVTNPKTIQKIAKSKKRKQLKVVPDEFLGGKKSDANRRMQRPRVLHPPDLEDPAETAGTSSAPGPQPEAVFRRRRRQALLRLRARYLDELSRWESLSSDVLAPLPAAPAADLPPRPPSDPVAASPPPGSSSSSSDLTVIDGLLAQAEVTEQLLKRLTEVCDEIDEFCHAHEAALVDAVTDLPVWGDPRELMNSLCSPAELPHKLQIELTENNYYTLLNACSKNEIFQDAIWLTAAQAPIGQSGMPVASCHKLKLHQHLHPISKELMLGHIVLHLMHMPTLCLTSRLMGMLANHLQNVYSNYHGYQAAYGRGGAATDAVSVIQTSGGAATVVVAQAADPPSVLLMVHFTPNPLEELR

SEQ ID NO: 4563 - protein, 645 aa, Ipomoea nil
MEKAFIPFILSLILLFPDLSYGAPRAQQVKLICETELEHNTTAFVPNFVGVMEKISDKMRTQGWGTSVLGSGPDENFGLAQCYGDLSLLDCVLCYAEARTVLPQCFPFNGGRIYLDGCFMRAENYTFFDEYLGPGDTRVCGNSTRKDPSFQQTARRAVMQAVSTAVNNNGSSRSQLSVPGRQNESAYVLADCWNTLNDSACRACLQNASASMLGCLPWSEGRALYTGCFMRYSDTNFLNPIPSNDSSSRVSVAVIVVAAVSSVIVLIVGVVIALYFLKQRRIEKKRKGPNDAEKLVKILHDSSLNFKYSTLEKATGCFDEANKLGQGGFGTVYKGVLPDGREIAVKRLFFNNKHRAADFYNEVNIISSVEHKNLVRLLGCSCSGPESLLVYEYMHNQSLDQFIFDPNKGKALNWERRFEIIIGTAEGLVYLHENSRNRIIHRDIKASNILLDSRLRAKIADFGLARSFQEDKSHISTAIAGTLGYMAPEYLAHGQLSEKADVYSFGVVLLEIVSGRQNNRSKATEYTDSLVNIAWMHFQQGTVNELFDPNLMLHNYHNINVKNEVLRVVHIGLLCTQEASSLRPSMSKALQMLVKKEELPAPTNPPFVDEKTMELNDGWDNQSFPLRGSESASVASVSHSSFYPR

SEQ ID NO: 4564 - protein, 403 aa, Polaromonas sp. JS666
MSASSSGKRRFARIDRLPPYVFNITAELKLAARRRGEDIIDMSMGNPDGATPAHIVAKLTEVAQRPDTHGYSASKGIPRLRRAIAHWYQSRYQVAIDPDTEAIVTIGSKEGLAHLMLATLDRGDTVLVPDPSYPIHIYGAVIAGADIRSVPLTPDTDFFAELEKAIRGSYPKPKMMVLGFPSNPTAQCVELEFFEKVIALARKHDIFVVHDLAYADIVFDGWKAPSIMQVPGAKDIAVEFFTLSKSYNMAGWRVGFMVGNPDLVAALARIKSYHDYGTFTPLQVAAIAALEGDQSCVKEIAAQYQSRRDVLYKGLIEAGWQVDCPKASMYIWARIPEAYRKLGSLEFAKQLLEKARVCVSPGIGFGDHGDDHVRFALIENEARIRQAVRGIKAMFKADGLVRP

SEQ ID NO: 4565 - protein, 393 aa, Methanosarcina barkeri str. Fusaro
MRPSCDPSKFVADVVKEIPPSGIRRFFDLVSGLEDVISLGVGEPDFITPWHIREMCIHSLEKGQTSYTSNYGLPELRDELTRTYYRRYGLDYDPSSEILITTGVSEALDIAVRTVVNPGDEVIIVQPSYVAYLPSVVLAGGKPVIVSTHRDDEFSLTAEALKPAITDKTKAIILNFPNNPTGAIMSKEGLEDIADLVVENDLFVISDEVYECLTYEGKHVPLSSLDGMKERTVMLNGFSKAYAMTGLRLGFAMGSPEIIHSMMMIHQYSMLCAPITAQIGAIEALRHGKDEMERMVREYDRRRHFIVRGFNRIGLECCNPKGAFYAFPYVGNTGLSSSEFAERLLDEKKVVAIPGDAFGEAGEGFLRCAYAASINDIRKALDRMEDFVDRLKQ

SEQ ID NO: 4566 - protein, 302 aa, Saccharomyces cerevisiae
MTYPKRIPINAWSEVHRVARPLIITFDAYNTLYATKLPVMEQYCIVGRKYGIKANPSTLTNNFPHVFKKLKEDYPQYGKYSGIKPEQWWSILIRNVFAPNEIPDEMINEILMRFEGFDSYFVYPDLIKFLKDLKSRHPDVILGIVSNTDPIFYKLLKNIGLFETFSGHIYLSYELNLAKPDRAIFQYALDDIISKQPHLLEKYTREEILQHCFHIGDELKNDLEGAEAAGWTGILLDRNDKYGFLSNSISKPMRDEYKLSIDKIDNNSINTWEANTKQTDTLQLSERKYVVSNLEVLEELFP

SEQ ID NO: 4567 - protein, 357 aa, Thiomicrospira crunogena XCL-2
MTQEVLILPGDGIGPEITAEAVKVLEALQQKDNLDISMTHDLVGGAAYDQHGVPLAEETLEKAKQSDAILLGAVGGYQWESLDISVRPEKGLLALRSNLELFANLRPAYLFPQLADASTLKPEVVAGLDILIVRELTGGIYFGQPRGIRTLDNGERQGYNTYVYSESEIKRIAHVAFDAAMKRNKKLCSVDKANVLEVTEMWREIVDEVAKEYPEVEVQHMYVDNAAMQLVLNPKQFDVMVTGNMFGDILSDEASMLTGSIGMLASASLDANNKGMYEPSHGSAPDIAGQNIANPLATILSAAMMLRYSLNREDLALKIETAVSKVLDQGLRTGDIWSEGLTKVSTSEMGDAVVAAL

SEQ ID NO: 4568 - protein, 329 aa, Mycobacterium sp. MCS
MTWLVTGGAGYIGSHVVRALTEADLPVVVIDDLSTGLEQFVPESVPFVRGTLLDGALVEQTLREHAVAGVIHIAGFKYAGVSVQRPLHTYEQNVSAMVTLLQAMETVGVDKIVFSSSAATFGTPDVDQVDESTPTAPESPYGETKLIGEWLLRDMGRASGLRHTSLRYFNVVGSGSTALFDTSPHNLFPLVFDMLYRGDTPRINGDDYPTPDGTCVRDYVDVGDVALAHVAAARRLTRGEPVEPVYNLGSGAGTSVREIMTAIRTVTGVDFEPQIMPRRPGDPARIVANGDLAARDLDWKMRHSLEDMVASAWAARQAAGAAYPGAGQS

SEQ ID NO: 4569 - protein, 467 aa, Pseudomonas aeruginosa PAO1
MMESYDVIVIGAGPGGYNAAIRAGQLGLKVACVEGRETLGGTCLNVGCMPSKALLHASELYAAASGGEFARLGIRVSPELDLAQMMKQKDESVAALTRGVEFLFRKHKVQWIKGWARLQGEGRVGVALADGGHAQLEARDIVIATGSEPAPLPGVPVDNQRILDSTGALELVEVPRHLVVIGAGVIGLELGSVWRRLGAQVTVLEYLERICPGLDGETARTLQRALTRQGMRFRLGTRVVAARSGEQGVELDLQPAAGGATESLQADYVLVAIGRRPYTEGLGLETVGLASDRRGMLENQGQRSAAPGVWVIGDVTSGPMLAHKAEEEAIVCIERIAGHAAEMNAEVIPSVIYTQPEVASVGLGEEQLQAARREYKVGRFPFSANSRAKINHESEGFIKILSDARSDQVLGVHMIGPGVSEMIGEACVAMEFSASAEDLALTCHPHPTRSEALRQAAMDVHGRAMQN

SEQ ID NO: 4570 - protein, 163 aa, Nitrosomonas europaea ATCC 19718
MKKIRIGQGFDIHPLVVGRDLIIGGVTIPYEKGLLGHSDADVLLHALCDALLGAAALGDIGRHFSDTDARYQGIDSRKLVREVHRLLTEAGYRVVNIDATIIAQVPKMAPHIPGMVTNIAQDLTLPAGDINIKAKTAEKLGVVGRGEGIVAEVVCLIADGDEV

SEQ ID NO: 4571 - protein, 268 aa, Fulvimarina pelagi HTCC2506
MNALAEEGARLLGGSLSSSRSFAGGSLSHLVSIELTDGRSAIVKGGPTPRAEARMLEAIRGSGAPAPEVFAADDTVFVMEIVEGDGSLSRAWASIGAAVRTLHAATGESYGWDCDFAFGAVEIPNGWSNDWPRFWAENRLLNNGPHIPGNLASRIEKLAKGLADRLPAAPGASLLHGDLWSGNVMASGDRITGLIDPACYYGHGEVDLAMLHLFGSPGAAFYAAYGELDPGYEDRRAIYTLWPALVHLRLFGSGYRGLVERLLDQLGV

SEQ ID NO: 4572 - protein, 255 aa, Oceanobacillus iheyensis HTE831
MFKDKVVLITGAAGGIGLEAAKAYAHEGAKLALVDLKNEALEKAASEIETEEILLITANVGKEEDVKNYVDRTKEQYGKIDIFINNAGINGQFKNIIEQTKENFSNVFDVNVMGVFFGMKYVLQVMKLQKSGVVINTASNGGLLGAPGMSAYVASKHAVIGLNKTAALEMAEYGVRVNAVAPSGVNTEMMRSIEKNAMGDKAEEARAQFEASVPMNRYATAGEIANLMLFLSSDKASFISGSYYRIDGGQGATSV

SEQ ID NO: 4573 - protein, 81 aa, Zea mays
  misc_feature (32)..(32): Xaa can be any naturally occurring amino acid
PGRPRVRNPLHHLEDAKKLFWTEEEEAVLREXMAKFTPQNNAQIPWILILEHGRGVFHRTRLPSDLRVKWRSMQRKKWAGY

SEQ ID NO: 4574 - protein, 390 aa, Scherffelia dubia
MATTACSIPTVARSVAGQRRAAKSFNGDASVFAARPARASVAARAVVVVTEAKAKVAINGFGRIGRNFLRCWHGRGASSGLDVVAINDSGGVKQASHLLKYDSTLGTFGADVQIVDDSHISVDGKVITVVSARDPLKLPWKEMGIDIVIEGTGVFLDSEGAGKHITAGAKKVVITAPAKGKDVPTYVIGVNDKDYNPKTDHIVSNASCTTNCLAPFVKVVDEKFGIVKGMMTTTHSYTGDQRLLDASHRDLRRARAAALNIVPTTTGAAKAVALVLPGLKGKLNGFALRVPTPNVSVVDLVVQVEKKTFAEEVNQAFRDAAAGPMKGVLAITDIPLVSVDFRCTDVSTTVDAALTMVMGDDMVKIVAWYDNEWGYSQRVVDLAELVAKKM

SEQ ID NO: 4575 - protein, 320 aa, Oceanobacillus iheyensis HTE831
MKRMDVIGIGETMVSLTPDKYGLIRQTSSFEPRVAGTETNTLIGLSRLGHNTGFISRLGEDELGAMVLKELRGENVDTKLIDLDPYHQTGLFLKEIINESDVHVYYYRQHSAASQMTRELLDESYISSASYLFITGITPAISESCKQTIFTAINMAKNNGVKIVFDPNIRKKLWSESEARQTLIEILKLSDIILPGISEGQFLLDSNDPEEIGKKCVDLGAELVVVKLGENGAYYCTSDHGDYVPSFPVKQVRDPVGAGDAFAAGLLSGLIDELSIEKAVERACITGGYATTYVGDYEGFPDKSRLERLTNLSTSEDVSR

SEQ ID NO: 4576 - protein, 549 aa, Shewanella sp. MR-4
MSFSSLGLSAPIQKAVTEQGYDTPSPIQAQAIPAVLTGKDVMAAAQTGTGKTAGFTLPLLELLSKGNKAKVGQIRALVLTPTRELAAQVSESVETYGKYLPLRSAVVFGGVPINPQIQKLRHGVDVLVATPGRLLDLEQQKAVKFNQLEVLVLDEADRMLDMGFIRDIKKILAMLPAKRQNLMFSATFSDEIRELAKGLVNQPVEISVTPRNAAANTVKQWICPVDKNQKSALLIQLIKQENWQQVLVFSRTKHGANRLAKSLIQAEISAAAIHGNKSQGARTKALADFKSGEVRVLVATDIAARGLDIDQLPQVVNFDLPNVPEDYVHRIGRTGRAGALGQAVSLVSSEETKLLRDIERLINRVLERQEVEGFSPVHALPESTLNAHGKENKIKAVASQRKHRSAGKPSPRAGTGRDGRKTPDSSDGAAQQKNSNPNQGQRNNQGQHKRPQAPKNAEHKNTHSSTEAGRTPKPQDKRPPRGKGPANSEHKAKGQPHSAAQQLSPQARSEKQHSDSRRQGRAQPNANPASGEHKKPSHRPDNRPNRVKS

SEQ ID NO: 4577 - protein, 415 aa, Shewanella sp. MR-4
MTHSASTDTTLPDSHSQIRSQFPTLSQMLGDYPLCYLDTAATSQKPQSVLDAMAQYYLNDNANVHRAAHQLSARATSSYEKVRDELQGFINAKRREEIIFTHGTTESINLVAYGLTPQIAAGDLILIDTAAHHANIVPWQELAKRTGAIIKPIPLDRDGRLDRHAYQALLALKPKVVALCHVSNALGTVNPVVELVQQAKAQGAITLVDGAQAVAHLSLDMAAIDCDFYVFSGHKMYGPTGIGVLYGRFDKLDTLTPLLTGGEMIKRVSFDGTEFGSLPNRLEAGTPPISEVIGLGAAIRFLQQHLTPEVQAHEAELLQYLQHQLRALGDVHLYAAHSDNLGAVAFNLGDEHHQDVGILLDQQGVAVRCGHHCAMPLMQSLNLKGCCRASIGIYTNKADIDRFIAALASVKELLL

SEQ ID NO: 4578 - protein, 411 aa, Zygosaccharomyces rouxii
DQSMTIRIHHQAKPTNLLKSIYATPLNVHKNNSGLTLDLSYITNQVIVCSYPVTRYPKLMYRNSLEDLVTFLNIQHGPESWKLYNFKIEGGRSDYRDEELMELVGAQKTKCIPPNCDGSTLAADLDQFLNRVGWMDHSPPPFLLLQNIIDDIQDQLIKSGSSVAVLHCKMGKGRSGTICIAYLMKYLESPLSESRDIFMNGRFKPGVSRGVTILSQLRWLRYHEMFLYYEPGLRPDILDQLSQSKFKLHTIQLNEPSSILFARPCSACIKIQTFNESRDSVTDLATLETDEELLCRSDEDKTITICFPLELHISDIRLEFGISARSPTVMNNFTALASYAHCWLNLYWETLKCSRIGSKDHYMLSKLLHEQDSGQNFDFVIKWRELDGTGGTSNRGLKLFESLTMKWSLIL

SEQ ID NO: 4579 - protein, 536 aa, Geobacillus kaustophilus HTA426
MAMDYLYHPYPSQRMTVFAKNGVVATSQPLAAQAGLEVLKKGGNAIDAAIAAAACLTVVEPTSNGIGGDAFALVWTNGKLYGLNASGYAPKAISIEALKERGYTEMPKYGFAPVTVPGAPAAWAALAKRFGRLPLAETLAPAIAYAENGYPVSPVLGKYWANAYRVYKEALNGPEFASWFATFAPGGRAPKIGEVWASPDHAATLRSIAETEAESFYRGELAEKIATFSKQYGGFLAADDLAEYEPEWVEPISVSYRGYEVWEIPPNGQGIVALMAINIMNGFDVPSVPDVETHHRQIEAMKLAFADGKAYIADCRYMNCSPDELLSESFAAMRRAQIGEEALTPEPGTPPKGGTVYLAAADGEGNMVSYIQSNYMGFGSGLVVPGTGIALHNRGHNFAFDEGHPNGLAPRKKPYHTIIPGFLTKGGAPVGPFGVMGGFMQPQGHLQVIMNTIDFDLNPQAALDAPRWQWMEGKTVLVEPHFPRHIAEALARKGHDIRLALDSGLFGRGQIIWRDPDTGVLAAGTEPRTDGAVAAW

SEQ ID NO: 4580 - protein, 339 aa, Oryza sativa Japonica Group
MPRPGDGAPRAVTLIPGDGIGPLVTGAVRQVMEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 4581 - protein, 337 aa, Ganoderma lucidum
MPVKVGINGFGRIGRIVLRNALLHGDIEVVAVNDPFISLEYMVYMFKYDSVHGRFKGAVEAKDGKLYVEGKPISVFEEKDPANINWSGVGAEYIVESTGVFTTVDKASAHLKGGAKKVVISAPSADAPMFVCGVNLDKYDSKYQVISNASCTTNCLAPLAKVINDNFGIVEGLMTTVHSTTATQRTVDGPSMKDWRGGRAVASNIIPSSTGAAKAVGKVIPSLNGKLTGMAFRVPTIDVSVVDLVVRLEKEATYDEIKAAVKSAATGNLKGIIDYTEDKVVSTDFTGSDASSIFDAEAGIALNKNFVKLIAWYDNEWGYSRRVCDLLVYAAKQDGAL

SEQ ID NO: 4582 - protein, 1266 aa, Ustilago maydis 521
MRSSPTFQPALDSSHTISQRKACDHGITFAAHYHADDYAVSLASGAACLELWTNLPVSQTTAAASSSQSTVWKAVPLLALKPFVGDDTSYVFATTVNCVQGASTKNFSFTYRIVHPDGMIDWLGSPSNDGQIHLAPLHQPRYGFRELVQPRLNTDLKLSEENESSRDADNSVILASLAVSRNHNQGSVAFSINTDNVESGIVVERTKSTWCTSRRFGSLSKISSDFGSNLIILELSRSASNEVLIILPVFDDAIRPARLVRSSCVGNHVHFEILGDGASQAKVALALGTAADLKQAIAICRSYAATLIRTYVHEPLGLSWSAKHLLDASSSLSLDLVLPSLPYANEELDPTNSSFFSDSTLVDSIQTSLSSASSMCLPSIQEASMKSEEQADASTVNRDRTVQIGIQQQPSRVENGLGFCTWEAMQNAERRPYLSEVIAALEAAEKRLGKGSIVALLIDDGWQDVTRGLDDRGRLNSFDMDPAMLDLEENEEACADARSTGVLARYTSYIRRRFPGISSIGCWMTLAGHWDGIHPDGSIAAGLSAPLRHARCEDPFRRVSRDWFIPATELDLHLFWDRAFHSLRESGVDFVKIDAQAEWEWIADKPDSVGFGRSAPSLTATALGQAAFEAMEGAATRYFGTPGGVIHSMGFTSNLTNTLRTLRTKGMVIRSTDDFFPTIPDAHRHHLAHHSYNSLLLPGHTCDADMLSHCSDSGAISEDIANDLDYTGYHASFRAFTDARLWISDKAHAPQHTALSALVSPTALSNEGTRIPVQATGNLLADCVFGDLIGNGVGPALKLFVRHESTSSATIGVWNLRANHAESFDVLDLTQLFSMQADNGLVSSQLYTYYAVRSFRSGKVCLLTSDKCQEAEVSHSLPVTLASGSWDVLSISPLLTTMVQGVSIAFLGATEHFMAPKAVHAVTIAALDPDKDRKRQGRRRSYQSQSPRSSHQQNRWSRSISTDRSLASMDIDVASKDESSLVESAVDTLMHRSDGGARVLVVSLALINGVFATLHTMIMGMIQTCGQSKRSVGESRNPRAKLVDAMIGMLDKLQTLFVFALLVLASWTSILAHARAESAKKTSWLPFLETTRKEQNNERLDGKALQTVRLQPIDAMATLKRCVISRTMAPLRDCHVSLTKSPLVSPKPSLQPLPETPRSATIRTTAKPDVVVTALVDIAAKISLLVVCSSPDSIKTCKIDRTRYDCASTPWILIEQVHLEHCLGHVGKSAFCVQVDMKAWKGDQDETFLQTLSAPVSVSLFVSAPI

SEQ ID NO: 4583 - protein, 176 aa, Triticum aestivum
  misc_feature (146)..(146): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMXEQGKPCDKPNIVTGANVQVCWEKFARYFEV

SEQ ID NO: 4584 - protein, 149 aa, Zea mays
MEKCSSKIRSIVWLRQTLRRWRSRAASRAAAAAAADAAVPSGHVAVCVGGASRRFVVRAAHLNHPVFRELLRQAEEEYGFPRAGPIALPCDEALFEHVLRHLSAPSKSSSRFVTLDDLQSAGATHCCCVAAAGDSLPLLRGFSADKAVW

SEQ ID NO: 4585 - protein, 256 aa, Rickettsiella grylli
MVHDPCIHFIGTLAPFTFFKKPANLRTFIKYEKPMTQRCIIIGIAGASASGKSLLAHTIVKELGSEQVAVISEDSYYKDNSTLAFEKRLENNYDHPDAFDHDLLIEHLKQLQAGQSAEIPIYNHTLHIREQETRRLGPHNIIVLEGILLFAEINLRELMDICIYMDTPLDVCLSRRIQRDVIERGRDIEAVLRQYQQTVRPMYSQFIEPSKHYADIIVPRGGENRIAIELIKAKIRELLNHFSLKNKEGNHGSVKR

SEQ ID NO: 4586 - protein, 915 aa, Aspergillus oryzae
MSLFSRITCFPPLGQVTCPQRIQQVLSSGEDDTVRFTVVIESSHSLPEQPWEAQIWQNITSPEWGAFPLQQSSSPVVSLLNKHESEYKFYRHVFCGEIPLPSHGGCAQFTVRYRVSQNSDWQWVNQQQNTKDGELVFAAKGPEEENINLAQLSLTSANEGLGKYFDGISNNLEVESRKSEAPGSTLWHISGNVGPAKDSQPGLTNVVLGIPSRTILYFALVRVWTPWLGPRHGRGKFRLTEDAILCSFLRDDGEHVVLLAVSGINNVLTVLGSGDNGEVVIKSHNDNTTASNLQVLASAAANFEVAISAVIYEARKLVRPYSAETTNRIPTPVSPPGDDVVLVEKDAKAQWLSEWYDGLTYCTWNGLGQDLTEEKIFDALDTLKSHGINISNLIIDDNWQTLDNEGDSQFKRRWKQFEANPDAFPRGLKKTVETIRRKHPNIQHIGVWHALLGYWGGISPDGDIAKNFKTKEVRIKDPAAGGPITKAFEKQLLLAIDPDDIQRFYDEFYSYLASAGVDAVKTDAQFFLDLLKDPEDRRKFTRAYQDAWSISSLRYFGTKAISCMSMFPQAIFNSQLPTNKPTIPLRNSDDFFPEVPASHTWHVFCNAHNALLTRYLNVLPDWDMFQTSHPYASFHAAARCVSGGPVHITDEPGNHNISLINEITAPTTQGTTVILRPSLVGRTIDMYHDYNAGQVLRVGTYTGWARTGSGILGLFNVSENRRTSLVSLQEFPGIHDDYDTKYIVRSHTSGIITDLIKPIDRNALVGIVLEDKDWEILTAYPTQAFTLKRKNSSDIREPNPTHATVLGLLGKMTGSAAIVSSDIYVEANGRLRFDISLKALGTLGIYISDLPDWSIEDDFMVTILGYPVPRKTVWKEGDDEKSKVLAVDILTAWREMKLKPGWSNEVIVQAIAFMI

SEQ ID NO: 4587 - protein, 264 aa, Mesorhizobium sp. BNC1
MPRSAIINVMVQAAMKAGRSLARDFGEVQNLQVSLKGPGDYVSQADRRAEEIIHTELSRARPGYSFLMEERGAVEGDDPQHRWLVDPLDGTTNFLHGIPIFSVSIALERQGTLVAGVIYNPAMDELYTAERGGGAFLNDRRMRVAARRDLSDCVIGTGIPHLGRGHHGRALLDLRNVMGESAGIRRLGSAALDLAYVAAGRMDGFWEEALSSWDMAAGILMVREAGGFATDRNGGQDMFGTGSVVAGNELIHRSLLKALQKPVS

SEQ ID NO: 4588 - protein, 124 aa, Vitis vinifera
MANSVGLLAICAAAFLIAASAVTAVDSTADNLSWIPTRSVCKGTVAECLALAGGEDEFGLTSEFAMDSEINRRILATSKYISYGALQRNSVPCSRRGASYYNCQPGAQANPYNRGCSTITRCRS

SEQ ID NO: 4589 - protein, 767 aa, Polaromonas sp. JS666
MATPLSPAEEALRDAAREYHRSPVRGKISITPTKPLSNQRDLSLAYSPGVAYPCLDIEADPSLAAEYTSRGNLVGVITNGTAVLGLGDIGPLAAKPVMEGKGCLFKKFAGIDVFDIELAEHDPDKLIDIIAAMEPTLGGINLEDIKAPECFYIERKLRERMNIPVFHDDQHGTAIISSAAVLNGLELVGKRIEDVRIAVSGAGAAALACLDVMVGLGVRRENVYVCDSKGVIYHGRPGGFDESKNRFAQETALRTLADAVNGADVFLGCSAPGVLTQDMVRTMAPSPIILALANPEPEIRPELAKAVRPDCIIATGRSDYPNQVNNVLCFPYIFRGALDCGATKITEEMKLACVRQIADLTKADISEEVARAYIGQELVFGPDYIIPKPFDSRLILRIAPAVAQAAEDSGVATRPITDMAAYRQELSRFVYSTGMLMQPVFNAARAIPDAHKRVAFAEGEDDRVLRAAQLVLDEGLARPILIGRPAVIETRIAKAGLRLRLGDDVECVNPEDDPRFRHYWETYHRIMGRHGVTPEAAKAAVRRSTTTIAALMVKLGDADAMLCGMVGRYDGHLEHVRDIIGLKEDASGFAALNALMLDKRTLFIADTFVNEDPSAEQLASIALMAVDEVRRFGIPPKVAFLSHSNYGSSNRASARKMRLAHELFARMAPDVESDGELHGDAALSEEVRRASLMESNMSGEANILICPNLDSANILFNVLKMTGGQGVTVGPILLGTAASAHILTTSATVRRVVNMTALAVASAAARR

SEQ ID NO: 4590 - protein, 1567 aa, Oryza sativa
  misc_feature (74)..(74): Xaa can be any naturally occurring amino acid
  misc_feature (114)..(114): Xaa can be any naturally occurring amino acid
  misc_feature (136)..(136): Xaa can be any naturally occurring amino acid
MDVDSRMTTESDSDSDAAAQGGGGGGFGSETSSASPSAPGTPTAMGAGGGAAPIAAAAIAAAASAAVVAGPRPXAPGYTVVNAAMEKKEDGPGCRCGHTLTAVPAVGEEGAPGXAGATADVHCYDVSSNKWSSKCXRLTPVGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVVFVNARLHVSGGALGGGRMVEDSSSVAVLDTAAGVWCDTKSVVTTPRTGRYSADAAGGDASVELTRRCRHAAAAVGDMIYVYGGLRGGVLLDDLLVAEDLAAAETTNAANQAAAIAAASDIQAGREPGRYAYNDEQTGQPATITSPDGAVVLGTPVAAPVNGDMYTDISPENAVIQGQRRMSKGVDYLVEASAAEAEAISATLAAVKARQVNGEAEHSPDREQSPDATPSVKQNASLIKPDYALSNNSTPPPGVRLHHRAVVVAAETGGALGGMVRQLSIDQFENEGRRVIYGTPESATAARKLLDRQMSINSVPKKVIASLLKPRGWKPPVRRQFFLDCNEIADLCDSAERIFSSEPSVLQLKAPIKIFGDLHGQFGDLMRLFDEYGAPSTAGDIAYIDYLFLGDYVDRGQHSLETITLLLALKVEYPLNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGTANNAGAILVLGRDLVVVPKLIHPLPPAITSPETSPEHHLEDTWMQILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 4591 - protein, 444 aa, Gibberella zeae PH-1
MASSTAEFWSKADSYVMTTGVPFSPVIISKALGTRLYDTNGKQILDFTSGQMSSLLGHSHPEVVEVVKHYVSELDHLLSNMITHPVVNLAERLAKFLPSPLQKSFFLNTGSESTEAAIKIAKCYTGKFEIVAFSASYHGLTQGSGSATYSAGRSRGGPTMPGSLAFPAPYGYRSPFRKADGSWDWETEMDFGWSLIDRQSVGSLAAFIMEPILSTGGILDLPTGYLKRMQDECRKREMLIIMDEAQTGVGRTGKMFAFEHEEGVVPDILALSKTLGCGLPLASVSTTSEIERGCKEAGFLWLTTHLNDPLTAAVGDKVLEIVERDNICQKASERGQQLRAGLEKLQQKYWCIGDLRGRGLLQGIEIIADPKTKAPGADLGQAISDKAMELGLSCNVVNLPGMGGVFRLAPAVTVTAEEIEQGLEILDKSFGAVLELRGQMTAAA

SEQ ID NO: 4592 - protein, 221 aa, Triticum aestivum
VNYRTSLYKKAGWYRSGIPGISSTHASGAEVSDIAIAVREAADAIMLSGETAHGKYPLKAVKVMHTVALRTESSLYDPAKAPSLVARPKALLNDDFCKSQLSKMFGSHATMMANTLRTPIIVFTRVGSMAVLLSHYRPSSTVYAFTNEVRVKQRLALYQGVVPILMEFSDDAEETFSRAITSLLDAKYMNEGDYVTLVQSGSQSIWREESTHHIQVRKVQC

SEQ ID NO: 4593 - protein, 444 aa, Synechococcus sp. RS9916
MTRSPSARPLPTTGAITGVGEAIAFFRNADFAQQRFERLGDVFETKLIGQRLVFIRGDAAISDLLGQAEAVEGWWPESVRRLLGSRSLANRNGAAHKARRRVVGQLFSSAALQRYSPRIVEQVNALAQDLLNSTHTPIPLAERMRRFAFSVIASTVLGLDDNDRDALFGDFEIWTRALFSVPLAIPGTAFAKALAARERLLIRLKEVLAKADGSRGGLDLMTGGLDEAGLPLSDDDLVEQLLLLLFAGYETTASSLSCLMRELLLQPTVDQWLREETNALAWPPHDAEAAMAYDSQRAPRLNAVVQEVMRMTPPVGGFFRRTTGAVTLAGVEVPAGSVIQVALAASNRHGAGDLDAFRPSRHLEPGNGGPTLMPFGGGERVCLGKALAELEIRLMVVGLLQQVDLELTPDQDVSLQLIPSPTPRDGLRVRATADHERHPSLKTD

SEQ ID NO: 4594 - protein, 160 aa, Glycine max
MEAALCSALALSPNQVFNAANPGDKNVPLKYSKDRSVVMTVAATGILGKGGGLLERPTIETTSPGRESEFDLRKSRKTSPPYRVLLHNDNFNKREYVVQVLMKVIPGMTIDNAVNIMQEAHYNGLAVVIVCAQVDAEDHCMQLRGNGLLSSIEPADGGGC

SEQ ID NO: 4595 - protein, 187 aa, Coccidioides immitis RS
MDSHMNNLLKWSIENSVPAQPDDPEQVKQERSLDRLDTQALQRLLSNAPSDADLMKAAMEVVSDDFATLENKLIAFDNFEQLIENLDNANNMGVLGLWTPLVEALSDAEPQMRKMAAWCIGTAVQNNEMAQNKLLDFKAVPKLLSLAKTDPDTTVRRKAIYALSSAMNAADMDRIDAIMNKLKEIPA

SEQ ID NO: 4596 - protein, 947 aa, Saccharum officinarum
MAASVSGATICLQKPGSKGRRARDATSFARRSVAAPRSPHAAKASVIRSDAGAGRGQHCSPMRAVVDAAPIATKKRVFYFGKGKSEGDKSMKELLGGKGANLAEMSSIGLSVPPGFTVSTEACKQNQDAGSILPAGHWREILDGLQFVEEYMGATLGDPQRPLLLSERSGSRGVQAGMMDTVLNLGLNDEVAAGLAAKSGERFDYDTFRRFHDMYGNVVMDIPRSLIEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFPINAQGEDVVAGIRTPEDLDAMKDVMPQAYEELVENCNILESHYKEMQDMEFTVQENRLWMLQCRTGKQTGTGAVKIAVDMVSEGLAERRQAIKMVEPGHLDQLLHPQFENPAAYKDQVIATGLPASPGAAVGQIVSTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPSLSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGLPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 4597 - protein, 566 aa, Brassica napus
  misc_feature (235)..(235): Xaa can be any naturally occurring amino acid
MSQSIQFSTPSRTPHLLPLPHSRFHRPLTSLSFRQFPLKYTSIRASSSPEERSVVATAVSTDTAAIDVDTVTEAELKENGFRSTRRTKLICTIGPATCGFEQLEALAEGGMNVARLNMCHGTREWHRDVIRSVRKLNEEKGFAVAIMMDTEGSEIHMGDLGGGESSAKSEDGEVWTFTVRAFDSSRPARTISVSYDGFAEDVRVGDELLVDGGMVRFGVIEKIGPDVKCLCTDPXGLLLPRANLTFWRDGSLVRERNAMLPTISSKDWLDIDFGIAEGVDFIAVSFVKSAEVINHLKSYLAARSCGGDIGVSRPTRPIDSLTNLEEIILASDGAMVARGDLGAQIPLEQVPAAQQRIVKVCRELNKPVIVASQLLESMIEYPTPTRAEVADVSEAVRQRSDALMLSGESAMGQFPDKALTVLRSVSLRIERWWREEKRYEATPLQAISSASSDKISEEICNSASKMANNLGVDAVFVYTKNGHMASLVSRCRPDCPIFAFTNTTSVRRRLNLQWGLIPFRLSFSEDMESNLNKTFSLLKSRGMIKSGDLVIAVSDMLQSIQVMNVP

SEQ ID NO: 4598 - protein, 427 aa, Glycine max
MRRCLSSCFVARGKDKDAQGKRAQPQTHTVKKVHVSTDDNGLSNSGSHSPPRETKPIGLYGYVQERHGHSLYTWKQAFLKLESGYLLCYSTGVSGSPCKMLPLHICMVRPLKRSGFRVICATQFSLTFRAKDVAEMREWVAEIQAGIAEALTAQSAPAACTGRDTLSALRSKHTANRYCADCGAPDPTWVSTSLGSLICIECSGVHRSLGSHISKVRSFELDHWDPKDVKTDGIGNSEVNTLYEASIPKHCTKPDINSDRETRENWIMDKYVHKRFTKKTLHTNNTRRPSTPNITLSVVPKSGSTSNLPDVSSLPLSNATSTAAGAPSLSLTLSPKESLSPSPHLAHDFTSKLPPSLQGGVVRPRTPDCLPTSHIGSNVFNKKMPYGAATAVDLSARRGSVGSFLYAPNNTRTSARRSSMFQNQRVM

SEQ ID NO: 4599 - protein, 210 aa, Synechococcus elongatus PCC 7942
MPKPGMAIPLLQIDAFTQQPYRGNPAAVCLLTEPLPDTQLQAIAAEMNLSETAFLLTDQTAWQLRWFTPACEVDLCGHATLAAAQALQEWGRAQRGQTLRFHTRSGLLQAKLSDRGIELDFPLQPPQGLETSLDLAAGIGAPVVASRTSELGYWLLELASVEQVRTLQPDQAAIAQWPCQAVVVTAAAQAGDDCDSSRASLRHALAFPRI

SEQ ID NO: 4600 - protein, 681 aa, Aspergillus oryzae
MAKIKKKGTSGQAKNYITRTQAVRKLQISLPDFRRLCIFKGIYPREPRNKKKAAKNSTASTTFYYTKDIQYLLHEPLLRKFRDQKALSKKIARSLGRGEVSDAARLEKNHAPQLTLDHIIKERYPTFIDALRDLDDALSLLFLFANLPSTAHVPPKTIALCQRLCHEFQHYLIVTNSLRKSFLSIKGIYYQATIQGQDIMWLVPYRFVQRVNGDVDYRIMATFVDFYTTLLGFVNFRLYSTLGLRYPPKFDTRSDENGAELAAFTLEGRAVGETTKAIEGTKQTSSTANKEVSQDVQAKVDKVIKSAGLDQTKDDQAVQATEESTEEIDKFEPAAPEADTLLQPDISGDTAGALFAPFTFYISREAPKAPLEFILRSFGCKRIGWDAVLGDGAFTHDETDTRITHQIVDRPALPESSLPAVPAASENGAGAVQKVKPGTRIPGRTYIQPQWIWDCINEGKLLRPDLYAPGATLPPHLSPWVKPTRGAYDPRASLAEQEEEGEAEIAAEEEEEDSDEEMEEATDGKKVDAKAEDSAEEENEDEDDSVDGGMDVAGTDDDEDESEEEMEDEFGGFEEEAASESEDEEESARTQHQKELEAEAAGLPFSSSSAGGDSTKKKSSQAKKVASKKRKEEEELERQKMMMSRKKRKLLEKMMYSNKKQSEEAAKLRSKRRKLEKGAEK

SEQ ID NO: 4601 - protein, 127 aa, Streptomyces virginiae
MAKLSQDDLLAQFEEMTLIELSEFVKAFEEKFDVTAAAAVAVAGPAGVGAAPEAAEEQDEFDVILTGAGDKKIQVIKVVRELTSLGLKEAKDLVDGAPKPVLEKVAKEAADKAAESLKAAGAAVEVK

SEQ ID NO: 4602 - protein, 498 aa, Aspergillus oryzae
MGHTVPPLKDQSLFIEKAYVNGEWVGAQSGETFEVHDPASGKLIGTCPEFNAADTEKAIQAATEAFPKFRTTLARERARMLRRWYQLMIDNAEDLATLITWENGKPLADAKGEVNYAAAFFEWFSEEAPRIYGDTIPSSVAGNRVMTLKQPVGVCSLITPWNFPAAMITRKAGPALAAGCTVVVKTPGETPFTANALAELAHRAGIPKGVFNIVTSLKNTPEVGEALTTHPEVRKVSFTGSTNVGKLLMKQSSSTVKKVSWELGGNAPFIVFDDVEDLDAAVAGAVASKFRSSGQTCVCANRIYVQRGIYDEFVKRFVEKVKGFKVGAGFEEGVTHGPVIHGRAIEKIDEHVRDAESKGAKVAVGGRKLSDLGPNFYDMTVLTDMNKDMLVASEETFGPVAGLFPFETEKEVVDLANRAEVGLAGYFFSGNVKRIFRVAEALEVGMVGVNTGLISDVASPFGGVKQSGFGREGSKYGIDEFLTIKSVTFGGMGEPLQS

SEQ ID NO: 4603 - protein, 322 aa, Rauvolfia serpentina
SLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 4604 - protein, 363 aa, Catharanthus roseus
MAFSSSTSLLLLLISSLLISAHFNNVHIVAQTTRPPTVSGLSYTFHNSRCPDLKSIVRNRLREVFQNDVEQAAGLLRLHFHDCFVQGCDSSVLLVGSASGPGEQAAPPNLTLRQQAFRIIDDLRRRVHSRCGRIVSCSDILALAARDSVFLTGGPDYDIPLGRRDGLNFATRADTIANLPPPTSNTSALLTSLATKNFNATDVVALSGGHTIGIGHCPSFDERIYPNIDPTMDQTFARNLRITCPTPDSNNRTFLDIRSPNVFDNRYYVDLMNRQGLFTSDQDLYTDRRTRGIVTDFAINQTLFFEKFVYAMIKMSQLNVLTGNQGEIRSNCSLRNAAAMGRSSSSLLGSVVEEAAEIGLSMF

SEQ ID NO: 4605 - protein, 567 aa, Aspergillus oryzae
MSAESSTNGIATPVSSKYSNLALTEYSTVPTPDSENDDGKQLGSPPNWGIPDAFLLPNGYPDYLRLILTSRVYEVINETPLHHAVNLSNRLECRVLLKREDLLPVFSFKLRGAYNKMAHLNQEQSWKGVIACSAGNHAQGVAFSARHLKIPATIVMPSGTPAIKHLNVARLGGSVILHGDDFDAAKAEAHRLEKQHGLTSIPPFDDPYVIAGQGTIGMEILRQANLQKLEAVFCAVGGGGLIAGIGVYLKRIAPHVKIIGVEAHDANAMAQSLDSGSRVLLKDVGLFADGAAVKAVGEEPYRLAREVIDEVIQVSTDETCAAIKDAFEDTRSIIEPAGALALAGLKKYVSLYPDPNPKRELVAITSGANMDFDRLRFVAERAALGERKEALLSVNIPEQPGSFAKLVEVILPHAVTAFSYRYARDESADVFMGISLSASTGQKDLAKIMEELDKGGMKAKDLSDDELAKRHVRFLVGGRCDVKDERLFMFEFPERPGALAKFLTTLRPSQNLSLFHYRNYGGDVGKVLAGIQCPPSEKDQLEAFLRDLGYPFSEHTDSSTYHTFLRS

SEQ ID NO: 4606 - protein, 429 aa, Nostoc sp. PCC 7120
MVDIYIIDLFVIGLLLLVVTLGSGWISRLPLSFALIYLLVGIILGPYGFGLIQLRRDDVFNADLLERITEFVVIISVFSCGLKIIHPLRRRVWDITARLIGFLMPISIFAIAVVAKLFLGMNWGEAILLGAILAPTDPVLASEVQLTDINDKDELRFGLTSEGGLNDALAFPFVYFGLFAIKDDNWNTWFKQWVAVDLIWAIAAALIMGFVVAKAIVWIDQKVQKRRSADALMEDFIALSAILLTYSLTEVVNGYGFLAVFIAGLVFQDTYRNPEKPLAQLEFIERLEKLLEVGTILLLGSILLWQPIINYGYQSLIIIIFLFLIIRPIGAWISTIGKRPLASHRRRLHPGTRWLLGWFGIRGVGSLYYLAYAFGHGLKDAVAEEIAWITYTTVVVSVVIHGISATPLMSWYERNIANEQKTSLPETLN

SEQ ID NO: 4607 - protein, 362 aa, Polaromonas sp. JS666
MKTYKIACIPGDGIGKEVVPAGQTVLEALAATQNKFKFEFTSFDWGGDYFRQHGVMMPEDGLDALRDKDAILFGSAGDPHIPDHITLWGLRLKICQGFDQYANVRPTRILPGIDGPLKRCKPEDLNWVIVRENSEGEYSGVGGRAHQGHPIEVATDVSMMTRAGVERIMRFAFKLAQLRPRKLLTVITKSNAQRHAMVMWDEIALQISKEFPDVKWDKELVDASTARMINRPASLDTIVATNLHADILSDLAAALAGSLGIAPTGNIDPERRYPSMFEPIHGSAFDIMGKGLANPVGTFWSCVMMLEHLGEPEAARVLMDAVEAITADPALHTGDLGGKATMAQVTEAVCALFAAAPVRQAA

SEQ ID NO: 4608 - protein, 358 aa, Arabidopsis thaliana; identical to SEQ ID NO: 841

SEQ ID NO: 4609 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGGDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 4610 - protein, 253 aa, Thiomicrospira crunogena XCL-2
MRQLFVAGNWKMHGDKASIKTLVTGLNAKADSVGDVLVAVCPPAIYLDYTKNCLMAGEIALGGQNMAIEPVQGAYTGETSASMLKDVGCQYVILGHSERRAIYGETDQDIAAKVKTALDSGLTPILCVGETLEERESGQLESVISQQLDAVISEVGIDQFADVVIAYEPVWAIGTGKTASAQQAQDVHAFIRGQLAKLNPSVAEKVIIQYGGSVKPNNASELFSQPDIDGGLIGGASLNADDFIAICQAAGEQ

SEQ ID NO: 4611 - protein, 804 aa, Zea mays
MASQGEPSSSDPKGKKDYSTAILERKKSPNRLVVDEATNDDNSVVALHPDTMERLQLFRGDTVLIKGKKRKDTVCIVLADETCEEPKVRMNKIVRKNLRVRLGDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPDKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLHALAKYTQGFSGADITEICQRACKYAIRENIEKDIERERRRKDNPEAMEEDEVDDIAEIMAAHFEESMKYARRSVSDADIRKYQAFAQTLQQSRGFGSEFRFSDQPTAAAGAADPFASAADDDDLYS

SEQ ID NO: 4612 - protein, 128 aa, Zea mays
YAGRVLSFWSLLASVRAWYYFASLGFGGPAWPAALYASVMYGAVFGLLSMAAGLAVAAPAMFVTWAPVLVVFAFGGRPRRSFFAGGRRPPRDIGGLALRVFLRGGNAVAAFWAPPSFAALLLGPRDPP

SEQ ID NO: 4613 - protein, 460 aa, Thermotoga maritima
MGSDKIHHHHHHMSLKFDFSNLFEPNISGGLTDEDVKSVEEKVTSAVRNFVENTPDFAKLDRSWIDSVKSLEDWIINFDTVVVLGIGGSGLGNLALHYSLRPLNWNEMTREERNGYARVFVVDNVDPDLMSSVLDRIDPKTTLFNVISKSGSTAEVMATYSIARGILEAYGLDPREHMLITTDPEKGFLRKLVKEEGFRSLEVPPGVGGRFSVLTPVGLLSAMAEGIDIDELHEGAKDAFEKSMKENILENPAAMIALTHYLYLNKGKSISVMMAYSNRMIYLVDWYRQLWAESLGKRYNLKGEEVFTGQTPVKALGATDQHSQIQLYNEGPNDKVITFLRVENFDREIVIPETGRAELSYLARKKLSELLLAEQTGTEEALRENNRPNMRVTFDGLTPYNVGQFFAYYEAATAFMGYLLEINPFDQPGVELGKKITFALMGREGYTYEIKERSKKVIIE

SEQ ID NO: 4614 - protein, 112 aa, Oryza sativa
MSGILAWAADVVGGAGAANDDEADDARAVASAAMTPEQRLRAADLDAKAASLRRSIHDLRLRVPPPHVAQRLPHLHAHSLASSAALALQLNAHSSTKEQVNRRFFFFLLPSY

SEQ ID NO: 4615 - protein, 333 aa, Flaveria linearis
MRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGEARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQAFTGKERALDLVPKKIHDRSPIFLGSYDDVKEIKALYAAEEKA

SEQ ID NO: 4616 - protein, 473 aa, Geobacillus kaustophilus HTA426
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDAFRLVGRIEEVVEKAKAMGVEV

SEQ ID NO: 4617 - protein, 425 aa, Robiginitalea biformata HTCC2501
MSVIEKRQSDKAIALEAQYGAHNYHPLPVVLSRGEGVYVWDVDGQKYYDFLSAYSAVNQGHCHPKIIGALTEQAQKLTLTSRAFYNDRLGEYEKYLCEFFGYDKVLPMNTGAEAVETAIKLGRKWGYEKKGIPDGRAKVIVCLNNFHGRTITIISASNDPVATEHFGPFTPGIVPIPYNDLEALEAAMGPDVAAFLVEPIQGEAGVNVPDADYLQKAHAICKEHNVLLMADEVQTGIARTGRLLASCGNCDCPEKNCSGTPDVKPDVLILGKAISGGVLPVSAVLANDPVMEVIRPGNHGSTFGGNPLACAVATAALEVVAEERLAEKADALGRLFREKMQEIIDDTDLVRLVRGKGLLNAIVIDDSEDSSTAWEICLALKENGLLAKPTHGNIIRFAPPLVMTEEELLDCLSIIRKTLLEYQQS

SEQ ID NO: 4618 - protein, 322 aa, Rauvolfia serpentina
  misc_feature (43)..(43): Xaa can be any naturally occurring amino acid
  misc_feature (94)..(94): Xaa can be any naturally occurring amino acid
  misc_feature (158)..(158): Xaa can be any naturally occurring amino acid
  misc_feature (168)..(168): Xaa can be any naturally occurring amino acid
  misc_feature (181)..(181): Xaa can be any naturally occurring amino acid
  misc_feature (254)..(254): Xaa can be any naturally occurring amino acid
SLALSSPILKEILIEAPSYAPNSFTFDSTNKGFYTSVQDGRVXKYEGPNSGFVDFAYASPYWNKAFCENSTDAEKRPLCGRTYDISYNLQNNQXYIVDCYYHLSVVGSEGGHATQLATSVDGVPFKWLYAVTVDQRTGIVYFTDVSTLYDDRGVQQIXDTSDKTGRLXKYDPSTKETTLLXKELHVPGGAEVSADSSFVLVAEFLSHQIVKYWLEGPKKGTAEVLVKIPNPGNIKRNADGHFWVSSSEELDGNXHGRVDPKGIKFDEFGNILEVIPLPPPFAGEHFEQIQEHDGLLYIGTLFHGSVGILVYDKKGNSFVSSH

SEQ ID NO: 4619 - protein, 154 aa, Zea mays
MSAANQLAALFSNMYATGLLDDQFQQLQMLQNASTPDFVSEVVTLFCQDGERIIGELAKLLEKPNVDFDRVDAFVHQLKGSSASIGAQKVKNTCIQFRESCKQKSKDGCSVRSMAVPPASEQDGGVELHVGMMRASFKFQNILNKLLNWLLGSL

SEQ ID NO: 4620 - protein, 181 aa, Ustilago maydis 521
MGMSISKLLSGLFGKKEMRILMVGLDAAGKTTILYKLKLGEIVTTIPTIGFNVETVEYKNISFTVWDVGGQDKIRPLWRHYFQNTHGIIFVVDSNDRERVSEAREELQRMLNEDELRDALLLVFANKQDLPNAMNAAEITDKLGLHSLRQRQWFIQATCATSGDGLYEGLEWLSTNLKRRA

SEQ ID NO: 4621 - protein, 327 aa, Mesorhizobium sp. BNC1
MSRHWTIAVLGAGAWGTALALTMQRAGHGARLWARDQNLVREINNARSNSRYLPGVKIDPAVLATDDMAAALEGADCVLAAIPAQSLRSVLAVAGTALKAHIPVVLCAKGIERETGQLMSEAARQALPENPLAALSGPSFAADLARGLPTAVTVAAQDGALAADLAKKLSAPNLRCYSSDDLMGVELGGALKNVLAIAAGATSGAGLGASAVAAITTRGFVELRRIGAAFGARAETLMGLSGLGDLILTCNSPQSRNFAYGAALGRGERLDNLPLAEGVFTASIAARMVSERGLEAPIIETVNGMLNGGLTVHAAMQALLARPLKSE

SEQ ID NO: 4622 - protein, 200 aa, Pseudomonas fluorescens Pf-5
MSVLVGKQAPDFTVPAVLGNGEIVDSFTLSSAIKGKYGLVFFYPLDFTFVCPSELIALDHRMADFKARNVEVIAVSIDSHFTHNAWRNTPINAGGIGQVQYIMAADMKHEIAKAYDVESEGGVAFRGAFLIDDKGVVRSQIVNDLPLGRNMEELIRLVDALQFHEEHGEVCPANWKKGDKGMTASPEGVAAYLSENAGKL

SEQ ID NO: 4623 - protein, 407 aa, Rheum australe
MDGVAQISDTDMAEAAPPPSDPSQPQPAAPDPSQHQPLPQQPQQINIPATLSHGGRFIQYNIFGNIFEVTAKYKPPIMPIGKGAYGIVCSALNSETSEHVAIKKIANAFDNKVDAKRTLREIKLLRHMDHENVVAIRDIIPPPLRDSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTTAIDVWSVGCIFMELMDRKPLFPGRDHVHQLRLLMELIGTPSEAELGFLNENAKRYIRQLPQYTRQSIPGKFPHVHPLAIDLVEKMLTFDPRQRITVEDALAHPYLNSLHDISDEPVCMTPFSFDFEQHALSEEQMRELIYREALAFNPEYQQG

SEQ ID NO: 4624 - protein, 225 aa, Mesorhizobium sp. BNC1
MNEAAQNLSKVRDRMVQAVREAGRASKDVALVAVSKTFAADEILPVIEAGQRVFGENRVQEAQGKWPGLKEAFPDIELHLIGPLQSNKAKEAVALFDVIETVDREKIAAALAAEMEKQGRRLRLYVQVNTGLEPQKAGIDPRETAAFVARCREVHGLEIEGLMCIPPLDENPGPHFALLEKLAREAGVEKLSMGMSGDFETAIAFGATSIRVGSAIFGSRAYSAG

SEQ ID NO: 4625 - protein, 422 aa, Sulfolobus tokodaii str. 7
MNSAVQETLTSNLYDQQVKKLYHVGGILGLTEDVLQVLSTPERVIQVKIEIKGADGKVKTFVGWRSQHNSALGPYKGGVRYHPDVTQDEVIALSMMMTWKNSLLQLPYGGGKGGIRVDPSKLTKEELEALSRRYVDALYKYIGSDIDIPAPDVNTNPQIMAWYLDEYIKITGKADFAVFTGKPIELGGLPARIYSTGLGVATIAKASAKKFLGGIEGATVIIQGFGNVGTYTAKFLQEMGAKIIGVSDSKGGVIDPNGIDVQKIIEIKESTGSVINYPSGKKVTNDELLISECDILIPAALENVINKFNAPKVKAKLIVEGANGPLTADADAIMKERGIPVVPDILANAGGVVGSYVEWANNKMGEIMSEEEARKLIIQRMENAFEGVYQKYNKLGDQDLRTAAMAISIERVVNAMKARGML

SEQ ID NO: 4626 - protein, 306 aa, Pseudomonas fluorescens Pf-5
MSARHFLSLMDCTPEELVSVIRRGIELKDLRNRGVLFEPLKNRVLGMIFEKSSTRTRLSFEAGMIQLGGQAIFLSPRDTQLGRGEPIGDCAIVMSRMLDAVMIRTFAHSTLTEFAANSRVPVINGLSDDLHPCQLLADMQTFLEHRGSIQGKTVAWIGDGNNMCNSYIEAAIQFDFQLRIACPEGYEPNADFVAQAGERVTIVRDPREAVRGAHLVSTDVWTSMGQEEETAKRLQLFAPFQVNRALLDLAAEDVLFMHCLPAHRGEEISLDLLDDPRSVAWDQAENRLHAQKALLEFLVEPAYHHA

SEQ ID NO: 4627 - protein, 115 aa, Zea mays
RKGEAIDRGAAAPPASEEWRIRSEARGLNPAAGRDAGPRRASSSVPSNGSCPCPEHSDVPMAQFIVNLNASMPPSERFIVHMLDPTNMFVQPHVAHMIRSKIGEFRDQNSYEKPQ

SEQ ID NO: 4628 - protein, 530 aa, Gluconobacter oxydans 621H
MLTPNALGGMVTSPHHLASQAGLDVLREGGTAIEAVVAAASTLAVVYPHMTGLGGDAFWLICYPDGRTVAIDACGALAMGAEHALYAEAGHTTIPWRGGLAANTVAGTVSGWETALELSSEIRDPLPLDRLLRDAIHYAEHGRVVSESEGALLAQKQPELMSDPTLAHICFPEGKPWTAGSIRKSPELAQTLRMLNRDGLRSFYNGPLARSLAADLAAAGSPVRSLDLLAHRAEVKEPLHVQTSDGFLYNTAPPTQGVASLLILALSDHLSRADGPESFAHVHGLVEATKQAFLYRNRHTDGSEHSEALARELLADPARLEAMASRISMTHAMPWTEKTQWGDTTWMGAIDRNGVAVSMIQSLYFEFGSGVMLPQSGLFWQNRGSSFRLAHSGWNILRPGAKPFHTLNPAAARLRDGRTMVYGTMGGEGQPQTQAAIFSRHVRYGVPLQEAICRPRWLLGRTWGNESLSLKVEPGFSPDVMSRLEAAGHTVEALPEQSIIMGHAGALIRHENGRLEGATDPRSDGAVAAW

SEQ ID NO: 4629 - protein, 605 aa, Oryza sativa Indica Group
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEHAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCEQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 4630 - protein, 382 aa, Streptomyces coelicolor A3(2)
MIATPPASRIAELRRRSRRPALAPAPPGAVSLAMGEPDFPTPPTVVQAAVSALREGHTHYADQRGLRELRAALAARLPERPGGAWDADDVLVTHGATAALAAVVLATVGPGDRVVVPEPAYSLYADLVVLAGGTVDFVPLAPDLHWDLDALAAALPGAAMMIFSNPSNPTGIVHRREELEALGKLLDGTDVLVVSDEAYHRLAYPGHEPVSALEIESLRGRTVYVQTFSKTYAMTGWRVGYLTGPREVLDAAAQVHRTWNGSLNTAVQHAALAALDLPDGVVGAMADRYRQRRDLVVGRLSGVPGLHLVPPEGAFYGFLRYDADRPSEMVARELAACQVLVRAGAEYGPSGEGHLRISFAASEDDLWVGLERIVRYFAEARS

SEQ ID NO: 4631 - protein, 317 aa, Salmonella enterica subsp. arizonae serovar 62:z4,z23:--
MIKLAPAGLKDNIEMRKVYAGFVARQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDTVMFADILRQLMDLDGFYWLRTIRKQAPSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQKEYGLTAAAIVEAAKSML

SEQ ID NO: 4632 - protein, 372 aa, Triticum aestivum
MSPGASCSGVPVPPRPAGTHTFLLPAAPPFVSKFTINRRDPRTASSCFGKAITPKRCFVVAGGLTWVDGVEEELMELQKTQEQSSGKLKKRPPLRRGKVYPQLPVPEHIPRPSYVGANIPQELPAVRQIHNAEGIAGMRAACKLAARVLDFAGTLVKPSVTTNEIDRAVHHMIVEAGAYPSPLGYGGFPKSICTSVNECVCHGLPDSTQLQNGDIINIDVNVFLNGYHGGTSRTFVCGEADESIKHFLKAAEECSEKGISVCRDGVNYRKIGKKISKLAYFYGYHVVERFVGHGIGTMLHSEPLILHHANENSGRMVEGQTFTIEPILTMDKAECVTWENGWTTVTADGSWAAQFEHTVLVTRTGVEILTKL

SEQ ID NO: 4633 - protein, 516 aa, Oryza sativa Indica Group
MGLPGRRNPLLSARRAAASLRRSRRLPVYVAAVFFVASVLLMFRDEILYLTTARSPSSSLPTTGGSAGGAGLARREELVSVNKPVLLGHGGKPEKHHSVTERHRPKVSAKRRPNKKAAKAARKKFMASPAVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVLPTRHDQFTVIRRPTGKTWEEYDEVGRIEAYRRVLDTWATWVNDNVDPARTSVFFMSVSPLHISSEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAAAAAGYVA

SEQ ID NO: 4634 - protein, 709 aa, Salmonella enterica subsp. arizonae serovar 62:z4,z23:--
MLIPTGTSVGLTSVSLGVIRAMERKGVRLSVFKPIAQPRAGGDAPDQTTTIVRANSTLPAAEPLKMSHVESLLSSNQKDVLMEEIIANYHANTKDAEVVLVEGLVPTRKHQFAQSLNYEIAKTLNAEIVFVMSQGTDTPEQLNERIELTRSSFGGAKNTNITGVIVNKLNAPVDEQGRTRPDLSEIFDDSSKAQVIKIDPAKLQESSPLPVLGAVPWSFDLIATRAIDMARHLNATIINEGDIKTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWVESLTATSERSRRLSPPAFRYQLTELARKAGKRVVLPEGDEPRTVKAAAICAERGIATCVLLGNPDEINRVAASQGVELGAGIEIVDPEVVRESYVARLVELRKSKGMTEPVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQASQQQQ

SEQ ID NO: 4635 - protein, 304 aa, Triticum aestivum
MDKYEKLEKVGEGTYGKVYKARVAATGQLVALKKTRLEMDEEGIPPTALREISLLRLLSASLYVVRLLSVEQVTKPCGKTVLYLVFEFLDTDLKKFVDGFRKGPSPRPLPTQVVKSFLYQLCKGTAHCHGHGVLHRDLKPQNLLIDKEKGVLKIADLGLSRAFTVPMKSYTHEIVTLWYRAPEVLLGATHYSTGVDIWSIGCIFAEMVRRQALFPGDSELQQLLHIFRLLGTPNEEKWPGVCALRDWHDYPQWKPQHLSRAVPTLEPEGLDLLAKMLQFDPANRISAKAAMDHPYFDSLDKSQF

SEQ ID NO: 4636 - protein, 540 aa, Streptococcus suis 89/1591
MLTVSDVSLRFSDRKLFDDVNIKFTAGNTYGLIGANGAGKSTFLKILAGDIEPSTGHISLGPDERLSVLRQNHFDYEDERVIDVVIMGNEQLYSIMKEKDAIYMKEDFSDEDGVRAAELEGEFAELGGWEAESEASQLLQNLNISEDLHYQNMSELTNGEKVKVLLAKALFGKPDVLLLDEPTNGLDIQSINWLEDFLIDFENTVIVVSHDRHFLNKVCTHMADLDFGKIKIFVGNYDFWKQSSELAAKLQADRNAKAEEKIKELQEFVARFSANASKSKQATSRKKMLDKIELEEIIPSSRKYPFINFKSEREIGNDLLTVENLKVVIDGETILDNISFILRPGDKTALIGQNDIQTTALIRALMGDIEYEGTIKWGVTTSQSYLPKDNTRDFDTNESILDWLRQFASKEEDDNTFLRGFLGRMLFSGDEVNKPVNVLSGGEKVRVMLSKLMLLKSNVLVLDDPTNHLDLESISSLNDGLKAFKESIIFASHDHEFIQTLANHIIVISKNGVIDRIDETYDEFLENAEVQAKVQELWKA

SEQ ID NO: 4637 - protein, 497 aa, Oryza sativa Indica Group
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSRLRIAMGVMYCLNYMQQLNPPVLLRDLSTSCIYLTEDNAAKVSDISFWGDKKEDEKSEASDEHSTVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 4638 - protein, 159 aa, Streptococcus suis 89/1591
MKIKLITVGKLKEKYLKEGIAEYSKRLGRFTKLDMIELPDEKTPDKASQAENEQILKKEADRIMSKIGERDFVIALAIEGKQFPSEEFSQKLSDIAVNGYSDITFIIGGSLGLDSCIKKRANLLMSFGQLTLPHQLMKLVLIEQIYRAFMIQQGSPYHK

SEQ ID NO: 4639 - protein, 282 aa, Legionella pneumophila str. Lens
MNVVIITGAASGIGHALSQVCLGNGKTIVMVDKNQDKLHTEAQSLMTKFSPEHVICFDCDVTKPSEVERLAEYSCKQLGQVDWIFNNAGIIGNLLPAWELQENDINQVMQVNLHGMLNMIRSFMPYLFKQNFRSHIINMASLYALCTGSQMAAYSMSKHAVLALSESLYFDLKRLKKPVDVSVVFPSFTDTSLLASSGKLNHSPIHNQLNNLLAHSRPALEVAEHIVREVEHKRFYILPDKEVKGYCEDRTKAILLQENPHHNSVEQLMCSLLKRQSSEANL

SEQ ID NO: 4640 - protein, 271 aa, Pseudomonas fluorescens Pf-5
MLVASYSRRRDMQLEFHQVDAFSERPFAGNPAMVYRLESWLDDRLMQQIAAEHNLAETAFVVREAQGWRIRWFTPVTEVPLCGHATLATAYVLFEVYGQTAQRIDFLSQSGPLSVTREEGLLWLDFPLRSPSSQAGQEAVAQALGVEVVELLGANELLAVLESEQAVRECRPDMTALAKLPWPGVIVTARGEQHDFVSRYFAPAIGIDEDPVTGSTHCCLAPYWAQRLDKPQLSAYQCSARGGALFCRLEGERVKIGGHARLIASGQLHLP

SEQ ID NO: 4641 - protein, 551 aa, Anabaena variabilis ATCC 29413
MFDSIDAALSDLKAGRAIVVVDDENRENEGDLICAAQFATPDMINFMAVEARGLICLAMTGDRLDELDLPLMVTNITDPNQTAFTVSVDASPHLGVSTGISAEDRARTIQITLNPATKPSDLRRPGHIFPLRAKAGGVLKRAGHTEAAVDLSRLAGLYPAGVICEIQNPDGSMARLQQLIEYAKHHDLKIISIADLISYRLQHDRLVYREVITKLPSQFGQFDIYAYRHTLDNTEHVAIVKGNPENFRDEPVMVRMHSECLTGDALGSLRCDCRMQLQAALKMIETAGQGVVVYLRQEGRGIGLINKLKAYSLQDMGLDTVEANERLGFPADLRDYGMGAQMLMDLGVKKIRLITNNPRKIAGVKGYGLEVVDRVPLLIEANDYNSYYLATKAKKLGHMLLQTYLVTVAIHWQDDPQLVTKRYERLEKLRHLVRSYDLLLQEEARPLAIALFDKPSLIVHLGFDQEKVASCDWYSQSGHPYLQAILPILDNLATLPYVQKLEFLISSGSDPLSNLQVQLDRQTISPDKLPSSVGSDLETQKIYSFSKEVEE

SEQ ID NO: 4642 - protein, 66 aa, Lotus corniculatus
GTYGEAEATAIEKFAEAFRTVDFPPGSSVFYRQSTDGKLGLSFSLDDTIPEKEAVVRENKALSEAV

SEQ ID NO: 4643 - protein, 362 aa, Zea mays
MSTATATLAAARSPAVALLSLRRRAPAAAPIRFPGLRVGSGCRHIAMASAAHARAPTDPLPKGADLFFRAVISNMEKVYLSRNPTAKTILELVRSYDGDHICYDHFAFRTFGVNGYGINSLSDFFTDFGYLPREELRFPAKKLRALWFSPPTNDGYSGTGTYGPLPRIFISELLVDELTTQSQEIIHKYIKTSGNGNNHAAIASTSGELTWEKPIYSDFQILSRESEYAAWTLVNGYALNHATIATHRLESDIRSINKFNKFVEDNGFKLNSEGGILKVSPDGLLQQSSTVADSSLFTFADGITESIPRSYIEFAERLLLPQFKDLQDEEVKEYHRRDGFEVGNADKIFESTSKDQLTRRSA

SEQ ID NO: 4644 - protein, 429 aa, Anabaena variabilis ATCC 29413
MSNIVDTAIEAIVAREILDSRGRPTIEAEVHLLSGAVGLAQVPSGASTGTFEAHELRDKDKSRYGGKGVLKAVHNVNEVLAPKLIDLDAINQELIDRTMIALDGSGNKSNLGANAILAVSLAAARAGAASLGIPLYRYLGGPLANLLPVPLMNVINGGAHAANNVDFQEFMIVPVGATSFREALRWGAEVFATLSEVLHDKGLLTGVGDEGGFAPNLESNQVALELLVAAIEKAGYKPGEQVALALDVAASEFYKEGQYVYDGRPHAPTEFIDYLGQLVDQYPIVSIEDGLHEEDWQNWQLLTQKVGSRVQLVGDDLFVTNATRLQKGIQEKAGNAILIKLNQIGSLTETLETIDLGTRNGFRSVISHRSGETEDTTIADLAVATRAGQIKTGSLCRSERVAKYNRLLRIEDELGDRAVYAGAVGLGPK

SEQ ID NO: 4645 - protein, 388 aa, Nostoc sp. PCC 7120
MKLAARVSQVTPSITLAIAAKAKAMKAEGIDVCSFSAGEPDFDTPAHIKAAAAKALDEGKTKYGAAAGEPKLREAIARKLQKDNHLDYKPENVIVTNGGKHSLYNLIVALIDPGDEVIIPAPYWLSYPEMVTLVGGKSVIVPTDASTGYKITPEQLRKAITPKTKLFVLNSPSNPTGMVYTPEEIKALAQVVVDADIYVVSDEIYEKILYDGAQHISIGSLGKEIFNRTLISNGFAKAYSMTGWRLGYLAGPVDIIKAASSIQGHSTSNVCTFAQYGAIAALEDSQDCVEEMRQAFAKRRQVMLDRLNAIPGLSTAKPDGAFYLFPDISKTGLKSLEFCDALIEEHKVAVIPGIAFGADDNIRLSYATDLATIEKGLDRLEKFVRSRI

SEQ ID NO: 4646 - protein, 519 aa, Mesorhizobium sp. BNC1
MAKAATPKRAPARAAAIPAAATPAAKPAKRASTRSAAARSPIAAATASGKIGSVRQVIGAVVDVQFQENLPAILNALETDNQGNRLVLEVAQHLGENTVRCIAMDSTDGLVRGQEVRDTGAPISVPVGPEMLGRIINVIGEPVDEAGPITATEFRGIHQPAPEYVEQSTEAQILVTGIKVLDLLAPYARGGKIGLFGGAGVGKTVLIQELINNVAKAHGGYSVFAGVGERTREGNDLYHEFIESGVNKKGGGEGSKAALVYGQMNEPPGARARVGLTGLTVAEYFRDQGQDVLFFVDNIFRFTQAGSEVSALLGRIPSAVGYQPTLATDMGALQERITTTTKGSITSVQAIYVPADDLTDPAPATSFAHLDATTVLSRAISEKGIYPAVDPLDSTSRMLDPQIVGEEHYQVARAVQQTLQRYKSLQDIIAILGMDELSEEDKLTVARARKIERFLSQPFFVAEVFTGSPGKLVDLQDTIKGFKGLVEGEYDHLPEAAFYMVGTIEDAIEKAERLAAEAA

SEQ ID NO: 4647 - protein, 230 aa, Neorickettsia sennetsu str. Miyayama
MEKDFVNEIFSSVSQKYDLMNDIMSGGIHRLWKRNLVKSIGLLPNQRVLDMAAGTGDITLRLLKTHIPVEIILCDKNHEMLEIAKDRLLDEGYVNLKVVSADAAQLPFEDCSFDHYVVAFGVRNFSNIERSLTEAYRVLKPGGRFSCLEFSKVKNKCMNSLYNLYSHTFIPWVGEKITKNRQAYTYLIESIQDFPDAETFCEIIRSAGFGRTKYRRETFGVAAIHTATKL

SEQ ID NO: 4648 - protein, 512 aa, Pseudomonas fluorescens Pf-5
MPTSTLPARPLSEVYDIAVIGGGINGVGIAADAAGRGLSVFLCEKDDLASHTSSASSKLIHGGLRYLEHYEFRLVREALAEREVLLAKAPHIVKPMRFVLPHRPHLRPAWMIRAGLFLYDHLGKREKLAGSRSLKFGADSALKAEITKGFEYSDCWVDDARLVVLNAMAAREHGAHVHTQTRCISARRSKGLWQLELERADGSLFSISAKALVNAAGPWVAKFIKDDLKLESPYGIRLIQGSHLIVPKLYEGEHAHILQNEDQRIVFTIPYLNQFTLIGTTDREYTGDPAKVAITEGETDYLLQVVNAHFKKQLSRSDILHSYSGVRPLCNDESDNPSAVTRDYTLALSGHGEEAPLLSVFGGKLTTYRKLAESAMAQLAPYFKQAKPSWTAQATLPGGENMSTPQALAEAIRKKFDWVPSQIAQRWATSYGSRTWRLLEGVHSLSDLGEHLGVGLYTREVDYLCSEEWAVKAQDILWRRSKLGLFTTEAQQQQLQDYLQKVEHNRGKIKAA

SEQ ID NO: 4649 - protein, 363 aa, Chlorobium tepidum TLS
MSLRCGIVGLPNVGKSTLFNAITAKQAEAANYPFCTIEPNVGTVLVPDPRLSELARVVKTPVIVPAVLEIVDIAGLVRGASKGEGLGNQFLSHIREVDAIIHVVRCFEDPNIIHVEGKIDPAGDIATIETELMLADLDSMEKRIDKLRKGARKEKDQQALVDLAEKIVAGLGEGVPVRSILENDEERAMAKQFFLITAKPVLFAANVAETDLPDGNEHTATVAKIAAENGSKMLIISAKAEADIAELPEEERPDFLESLGLEMSGLDRLIMAAYNLLGLHNYFTAGVKEVHAWTIRKGAAAPEAAAAIHSDFEKGFIRAEVMAYEDLITLGSEQKVKEAGKMRSEGKEYVVKDGDVITFRFNV

SEQ ID NO: 4650 - protein, 606 aa, Streptomyces coelicolor A3(2)
MTDMAGRPPSPPDAPAHTTRPTLRGSFGMCASTHWLATATAQSVLERGGNAFDAAVAGAFVLHVAEPHLNGPGGDLVAVLATAADPSPRVLAGQGPAPRGATIEHFRAEGLDHVPGAGALAAAVPGAVDSWLWLLAEFGTWELADVLAYAIAYAERGVPVVPQLARVLATVEELFRTHWPTSYALWMPEGRVPAPYATLVNPAYARTLRRLGTAPSGGTRTARIEAARRAWRTGFVAQAVAEFAAVPHRHSSGGDHAGVITAADFTDFHPSLEPAVTARFRGTTVAKAGPWSQGPVLLQALTILDHFDDARLDPSTAEGVHTLTEALKLALADREAYYGHLDPAAADALLRRLLSPRYGKERARLIRPLASTAFRPGHIGVTPYTPPLVTRGSAQQADGVGEPTVQQTGETRGDTCHLDVVDRWGNIVSATPSGGWLQSSPAVPELGFALGTRLQMTWLDPAAPSRLAPGRRPRTTLTPTLLLRDGNPVAALGTPGGDQQDQWQLIYLVRTLALGMDPQEAIDAPAFHTTAVPSSFWPRTWTPGGLVIEERAGGAVVEELRARGHAVTVSGPWSQGRLSVVTRDPDSGVLRAAANPRGAQGYAAGR

SEQ ID NO: 4651 - protein, 430 aa, Mycobacterium smegmatis str. MC2 155
MTTELSADSRITALTAPLSAADIDEAARRISGVVTESPLQYCERLSEATGANVYLKREDLQAVRSYKVRGAFNLMAQLSAEELAAGVVCSSAGNHAQGFAMACRTMKTHGRVYVPAKTPKQKRDRIRYHGREFIELIAVGATYDLAAAAALEDVARTGATLVPPYDDLRTMAGQGTIAAELLDQLDTEPDLVIVPVGGGGCIAGITTYLAARTDNTSVLGVEPAGAASMIAALAAGEPVTLADVDQFVDGAAVARAGQKPFEALAAAGDMVSLTTVDEGAVCTAMLDLYQNEGIIAEPAGALSVAALLEADIEPGSTVVCLISGGNNDVSRYNEVLERSLVHLGLKHYFLVDFPQEPGALRRFLDEVLGPGDDITLFEYVKRNNRETGEALVGVELSSAADLEGLLARMGQSDIHVELLEPGSPTYRYLT

SEQ ID NO: 4652 - protein, 404 aa, Salmonella enterica subsp. arizonae serovar 62:z4,z23:--
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYEDAEHHSIAALAPDLLTITFNGLSKTYRVAGFRQGWMVLNGPKKHAKGYIEGLDMLASMRLCANVPAQHAIQTALGGYQSISEFILPGGRLYEQRNRAWELINDIPGVSCVKPRGALYMFPKIDAKRFNIHDDQKMVLDFLLQEKVLLVQGTAFNWPWPDHFRIVTLPREDDLEMAINRFGRFLSGYHQ

SEQ ID NO: 4653 - protein, 233 aa, Oryza sativa
  misc_feature (114)..(114): Xaa can be any naturally occurring amino acid
  misc_feature (181)..(181): Xaa can be any naturally occurring amino acid
MSVPVRRRPFSDIGNVISTHTTRDEKKPASAHTIWPSPRVDEKHRANAQYPVDYVKDIIDHFRKAELKNRPSSNYMNRVQSDVNDKMRTILVDWLVDVHLKFKLQPETLGGIEXFLDKRLVSRQKLQLVGVVAMLLAAKYEEIFPPDVKDFIYIAANTYSREDILRMERLMFQTLDFNLTXTLQVFLKRGLQVTDCDTKTAQLAHYLAELSLLDYKMLAYLPSLIAASCIYSA

SEQ ID NO: 4654 - protein, 302 aa, Methanosarcina barkeri str. Fusaro
MKKDVLSITDLSKEEIYELLESAMDLKEKRKAGEPTEYLKNKSLGMIFEKASTRTRVSFEVAMTDFGGHSLYLNSRDIQIGRGETIEDTARTLSGYLHGIMARVMSHETVEKLAKYSTIPVINALSDREHPCQILGDFMTIMEYKDKFEDLKFAWVGDGNNVCNSALLGSAIVGMEFAVACPKGYEPKPEFLEKAKSLGGKFTVTDDPKVAVKDADIIYTDVWVSMGDEAEQEKRLKEFATFQVNTELLGVAKPDVIVMHCLPARRGLEITDEVMDGPNSVIFEEAENRLHAQKALILKLMK

SEQ ID NO: 4655 - protein, 470 aa, Mycobacterium sp. MCS
MLVATRIVIIGGGPAGYEAALVAAGPETHVTVIDSDGVGGACVLYDCVPSKTFIASTGVRTELRRATGLGFDISISDAKVSLPQIHNRVKTLARSQSADIGSQLLREGVTVIGGRGELVDDVPGLAQHRVRVRTHDGKTGVLKADVVLIATGASPRVLPNAEPDGERILTWRQLYDLTELPEHLVIVGSGVTGAEFCNAYTELGVTVTVVASRDQILPHEDSDAAAVLEEVFAERGVTLVKNARAESVTRTENGVKVQMADGRCVEGSHALMTVGSVPNTEGLGLERVGIELARGGYIPVDRVSRTPAAGIYAAGDCTGLLPLASVAAMQGRIAMYHALGEGVAPIRLRTVASATFTRPEIAAVGIPQTAIDDGSVPARTLMLPLNTNARAKMSLLRHGFVKIFCRPATGVVIGGVVVAPIASELILPIALAVQNRISVTDLAQTLSVYPSLSGSIVEAARRLMAHDDLD

SEQ ID NO: 4656 - protein, 480 aa, Glycine max
  misc_feature (375)..(375): Xaa can be any naturally occurring amino acid
MESDLGKLFIGGISWDTDEERLKEYFGKYGEVIETVIMRDRVTGRARGFGFVVFGDPSVAERVIMDKHIIDGRTVEAKKAVPRDDQQNINRQSGSAHVSPGPGRTKKIFVGGLPSTITESDFKTYFDQFGTITDVVVMYDHNTQRPRGFGFITYDSEEAVDRVLYKTFHELNGKMVEVKRAVPKELSPGPSRSPLIGYNYGLTRASNYLNSFAQGYNMSPIGGYGIRMDGRFSPLTSGRSGFTPLGNTGYGMGVNMDSGLSPNFGGTSNYGSNVGYGRIFSPFYSGNSGRYTTPIGYSGGNGRSDSLMNSPSRNVWGNGGLNNANNPISPSPFLGSGSGAFGVSIGNSGTGWGPSLPAQGRGDASGYGTGNNVYXHSPDSSFGLGGGGYGRNNSTSVTPSSSFNVSTGGYEGSYGDLYPWRGGSVYNNSAWRSSASDMARAGSFGYGLGGIASDDPVKSSEGYIGNYNVTSRQPNRGIAT

SEQ ID NO: 4657 - protein, 488 aa, Fagus grandifolia
PGVSTLEKKNLGRIAQIIGPVLDVAFPPGKMPNIYNALVVKGRDTAGQQMNVTCEVQQLLGNNRVRAVAMSATDGLTRGMGVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLVETIRGFQLILSGELDGLPEQAFYLVGNIDEATAKATNLEMESKLK

SEQ ID NO: 4658 - protein, 579 aa, Mycobacterium sp. MCS
MSDPIAGNGQTLLGPDQRAEAWRRLGSEQFDVVVIGGGVVGAGAALDAATRGLKVALVEARDFASGTSSRSSKMFHGGLRYLEQLEFGLVREALHERELSLTTLAPHLVKPLPFLFPLTNRWWERPYVAAGIFLYDQLGGAKSVPAQRHLTKSGALRLAPGLKRSSLIGGIRYFDTVVDDARHTMMVARTAAHYGAVVRTSTQVVNLLREGDRVIGVAVRDSEDGSVTDVHGHVVVNATGVWTDEIQALSRQRGRFRVRASKGVHIVVPRDRIVSEVAIILRTEKSVLFVIPWGTHWIIGTTDTDWNLDLAHPAATKADIDYILDHVNTVLATPLTHDDIDGVYAGLRPLLAGESEETSKLSREHAVASPAPGLVAIAGGKYTTYRVMGEDAIDAAAEFVPARVAPSITEKVPLMGADGYFALINQTQSVGAHYGLHPYRVRHLLDRYGSLITEVLAFADGRPELLTPITAAPVYLKVEAAYAAAAEGALHLEDILARRMRISIEYPHRGVDCAREVAEVVAPILGWSAEDVSREVDTYCARVDAEVRSQQQPDDESADALRAAAPEARAEILEPVPLR

SEQ ID NO: 4659 - protein, 192 aa, Legionella pneumophila str. Lens
MLLIIDNYDSFTYNLVQYFESLNQKVEVFKNDEIQIDTIRQSAPQYLVISPGPNSPDESGISIEVIKEFHKHIPILGICLGHQCIAQAFGGKIIPAPEIMHGKTSEITHHYQGLFTGIPNHFQATRYHSLAVDIMSLPNCFSIDAWAEDTIMAISHRQFPLFGLQFHPEAILSQFGLQILENFLRYETQISI

SEQ ID NO: 4660 - protein, 451 aa, Streptococcus suis 89/1591
MKVIKFGGSSLASAEQLEKVFNIVQSDSERRFVVVSAPGKRNAEDTKVTDALIKYYKEYVNGKDVTASQEWIINRYQAMVDELGFTANSMKKIADSIISLASLPIDDNEFLYDAFLAAGEDNNAKLIAEYFTHRGLPARYVHPKKAGIIVSSEPGNARILPSSYDKIEELRDTDEVLIIPGFFGVTVDNQICTFSRGGSDITGSIIAAGVKADLYENFTDVDGIFAAHPGIIKNPHSIKELTYREMRELAYAGFSVLHDEALLPAYRGRIPLVIKNTNNPTHPGTRIVHKHTEQTVPVVGIAADDGFVSINLSKYLMNREVGFGRKVLQILEDLNIRWEHMPTGIDDLSIVVRERELTPIKEEEILRQLNTKMEVDKAEIEHGLSIIMIVGENMKSHVGVTATATTALSKQNVNLAMISQGASEVSVMFVVKTEEKKRALHALYEAFFNEQ

SEQ ID NO: 4661 - protein, 338 aa, Streptomyces avermitilis MA-4680
MSEGNGNSAYGRKAFKRSRSHFTDRITADGRDGRPVEAGRYRLIASRACPWASRALVSRRLLGLEDALSLGVVDPVQDDRSWRFTLDPDGRDPVLGIRYLSEAYDARQPEYPGGVSVPAIVDVPSGKLVTNDYQQLTLDLATEWKALHRQGAPDLYPAGLRDEIDEVMADIYEDVNNGVYRAGFATGQKEYEAACAGVFHRLELLGQRLADRRHLVGDSITEADIRLFTTLVRFDAVYHGHFKCNRWKLTEHPVLWAYARDLYQTPGFGDTVDFDHIKRHYYQVHTGINPTGIVPLGPDLAGWLTPHHRERLGGRPFGDGTPPGPVREDEEIPAQGRP

SEQ ID NO: 4662 - protein, 241 aa, Prochlorococcus marinus str. MIT 9515
MRKSVIAGNWKMHMTCAETKNYLEEFIPLIKDLPNDRKIVIAPPFTAISTFSSYSNFDYLDIASQNIHWEDQGAFTAEISPKMLIEHNVKYAIVGHSEPRKYFSESDEQINKRAVFAQSSGLTPIVCVGETLEQRERGEANRVITRQVEQGLENTDPSNLIIAYEPIWAIGTGKTCEASDANKICALIRELIGFDDVIIQYGGSVKPNNIDEIMSMSDINGVLVGGSSLDPISFSRIANYE

SEQ ID NO: 4663 - protein, 540 aa, Oryza sativa Japonica Group
MSGGSGDSSPSSGRASFSSLSGLKDLELSSESGCLSIVVLGASGDLAKKKTFPALFHLFQQGFLQSGEVHIFGYARSNISDDGLRERIRGYLKGASDEHISQFLQLIKYVSGSYNSGEGFASLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKFLSAIVLLLPMVSKTLFLFHPDKGKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 4664 - protein, 230 aa, Triticum aestivum
SEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHVDAMVSAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 4665 - protein, 612 aa, Oryza sativa
  misc_feature (209)..(209): Xaa can be any naturally occurring amino acid
  misc_feature (440)..(440): Xaa can be any naturally occurring amino acid
  misc_feature (446)..(446): Xaa can be any naturally occurring amino acid
  misc_feature (456)..(456): Xaa can be any naturally occurring amino acid
  misc_feature (494)..(494): Xaa can be any naturally occurring amino acid
MSRRHARPLLPLLRRHLHRSATVHRSPAPAPPDGIPSSSSAPPDPAAARWPSSWSPAAPPLHSFAASHLREAVSPIAAAILALPGVDPDPLPALVEHNFPTLLAVSPLASLELLSLLRPNPQLGLAVFSSRRTLSPPATLPEFVLAISLAGRARDPAAAARLFAEASTAYCPDQALYKALMSSYMHSGSRRTAASRPFHTLERDPRCGXPPNADSYNILIALFGRSLLVDHMEATLLSLDASGHPRTIGTYNAIIAGYLTAWMWEKMESVFDEMVSGHVAPDKTTYLLMLRGYAHAGMIYKMELAYERARQHVGQVDMVHIRAMICAYCKFKHVDRIQKIEELLQKLGPDDYRPWLAVLLIRAYAQEGLVERMEQWIAEALERNTIVTTVQVMRSIITSYFQCDAVDKLAHFIRQAEEAGWKLCRSLYHCKMVMYGKQHXLPEMHXGVLDEMEFFXVFDRTKKTFWIMYKAYVNSGRMADANTILCMMGKHGFXGFPRGGTGADVEEASDGIGGGDVSGVRDSPVLGVDSSEVAAPYLRQCRRSQRQRRWRLVEGEVMGMALTWAAGKTALTAPNQIGSRGACMDGGAQCDTRRKCPAKKRRRLGGEDHTDI

SEQ ID NO: 4666 - protein, 454 aa, Salmonella enterica subsp. enterica serovar Typhi str. CT18
MTMSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWVFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGLIFIFATYFLQLYFPDISRFKDPDASQPEIMLYVAGKTFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAGIGLIYLACVTKSFRNPVPQYEDVA

SEQ ID NO: 4667 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMKGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 4668 - protein, 203 aa, Oryza sativa Japonica Group
MDHHQHHEQQQQRMVEMRMGMAMGEAYVGGGEVVAREAAAQALGAVVQLHFDKTLEKKRAADAQKQELWRLFLAFFLFLAILLSAVAQSPPSRLQCRHLWAPAGLLSLAHLAFYAAVAHHLRCLNGFRYQRRCHKLTLALAADRLRMLKSGGDVVAAADVEVPYQEPPESYLAKFKRSWAIHFAFLITTFAFSVAAAVAILCF

SEQ ID NO: 4669 - protein, 493 aa, Rickettsiella grylli
MLIPVILSGGNGSRLWPVSRETYPKPFIRINDEPHSLIQKTYQRTLNIPHIEKIITVTNFEYYYHTKKELTDLGYDPASNTFNFILEPFSRNTAAAIIFSAFFTNEVIHPDATLLVLPADHIILNQDKFNACVEKAKKLAEKELLTLFGIIPYKPETAYGYIQYSKTDEILSAYKVIQFYEKPTYKNAQSFIEEGNYLWNSGILCFRVKTFLETVKKYIPAFYLKSLACWNHSVKKNVTRHNKLSLDEPSFTVLENISIDYALLEKADNITVIPSDFGWSDVGSWDVLNTFVKLEENNNRILGDVFLKETYNTNIYSQHSNRVIGLLGIKNLTIVDTPDALLICQQSHIQNVKQLVEELKRNDHPAYRYHQTVYRPWGHYTVLDEGPHYKLKRLLVYPGASLSVQMHRYRSEYWVVVSGVATIKNDQKQLILYPNESTFIPLGCKHCLSNLEKHDLIVIEVQTGSYLGEDDIIRFKDNYERKTVTDDEANIDS

SEQ ID NO: 4670 - protein, 1532 aa, Arabidopsis thaliana
  misc_feature (357)..(357): Xaa can be any naturally occurring amino acid
MEADTKTDSRTLKVNDLLKDARLDYDSLRKLVDDTVSSIKEAIDGIPEKFQVTSELAPSFVEDIGADKEVEFSFKKPNGFNLCGSYSICGMAKPDTSVDLLVHLPKECFYEKDYMNHRYHAKRCLYLCVIEKHLLSSSSIEKVVWSTLHNEARKPVLVVFPAKKLDQFPGFSIRLIPSATSLFSVAKLSISRNNVRSVTADGVPEPTPTYNSSILEDMFLEENSEFLKKTFSEWKELSDALILLKIWARQRSSIYVHDCLNGFLISVILSYLATHSKINKALSALDIFRVTLDFIATSKLWERGLYLPPQSEIRVSKEYDYALKMQFRELFPVVICDSSTFVNLAFRMTSVGFLEHXLQDEASLTLKCMEKLRDGGFEEIFMTKIDYPVKYDHCIRIEWLLKGKTAVSLSGFCLDKECWRLYEQKVHSLLLEGLGDRAKSIRVVWRNTNQDWHVESGLSVLDREPLFIGISVSSTEKAYRTVDIGPDAENKIEALRFRKFWGEKSDLRRFKDGRISESTVWETQQWTKHLIMKQIVEYILKRHLSLTSDDIVQLVDQLDFSLNYGGKDPISLSGNLVQAYEVLSKCLREIEGIPLKVSSVQSLDSALRFTSVFPPEPHPVACEKIDSRRLQKLIPSCIPAMEVMIQLEGSGNWPMDDLAVEKTKSAFLLKIAESLQNVKGIPCTATEDNVDVFIGGYAFRLRILHERGLSLVKREIGVDPVKHVSSTDKMLFIRSQHASMINGLQGRFPVYAPVARLAKRWVSAHLFSGCLAEEAIELLVAYLFLTPLPLGVPSSRINGFLRFLRLLADYEWMFYPLIVDINNDFGRNDEKEINDNFMSSRKGYEEDKQNISSAMFLAAPYDKASEAWTSTSPNLLEQKRLVAYARSSANVLSKMVLQEHNDSVQWECLFRTPLNNYDAVILLHRDKLPYPRRLLFPSELNQGKHVARGKASRLFNPFMSPGDLKRSHEELKNKLMEEFGTLKPWYDHIGGDAIGLTWNKHNSKKRERDEEEEEEEESNPMEMLKAVGEMGKGMMSDYKVEMINDGMQEFFVEFSGPKDSIYEGGVWKIRVELPDAYPYKSPSVGFITKIYHPNVDEMSGSVCLDVINQTWSPMFDLVNVFETFLPQLLLYPNPSDPLNGEAAALMMRDRPTYEQRVKEYCEKYAKPRADTEEMSSDDEMSEDEYASDGDDEDDVAIAVVFFFRLLSKPLPKTLIRHIRVLASRRITMQRRLVRLKKEYIYRKSLEGDERKVYEQKRLIREALQEGKPIPTELRNVEAKLRQEIDLEDQNTAANGYHLIMLLLVPRSHIDDEYANATEADPKILLTTSRNPSAPLIRFTKELKFVFPNSQRINRGSQVISEIIETARSHDFTDVILVHEHRGVPDGLIISHLPFGPTAYFGLLNVVTRHDISDKKSIGKMPEQYPHLIFNNFTTQMGQRVGNILKHIFPAPKLDAKRIVTFSNQSDYISFRNHVYDKGEGGPKSIELKEIGPRFELRLYQVKLGTVEQNEAEIEWVIRPYMNTSKKRKFIGE

SEQ ID NO: 4671 - protein, 177 aa, Chlorobium tepidum TLS
MPIKSRIRTVPDYPKKGIMFRDITTLIKDPVGFRLVIDNMTQHYLSNGVDFDAIVGIESRGFILGGALAYTLGKGFVPVRKPGKLPADVVQLEYELEYGTDKIEMHTDALVQGQRVLLVDDLLATGGTALAAAGLVEKLGGVVASMAFIVNLPDIGGEKKIREKGYNIYFLTEFEGD

SEQ ID NO: 4672 - protein, 332 aa, Polaromonas sp. JS666
MNTVTEKKPRLTTSAMIASIASEGQRTRAAPFGKALVELAAQRPDIVGMTADLAKYTDLHLFAQACPERFFQMGMAEQLLMGAAGGMAKEGFVPFVTTYAVFATRRAYDFMHQVIAEENLNVKIVCALPGLTTGYGPSHQATEDLAVMRAMPGMTVIDPCDAHEIEQAVPAIAAHAGPVYMRLLRGQVPMVLDEYGYRFELGKAKMIREGRDVLFISTGLMTMRALEAAQALQRDQVDAAVLHVPTLKPLDAATILREAARAGRLVVVAENHSTIGGLGEAVAGELMRAGVHPAFRQIALPDAFLDAGALPTLHDRYGISTEAVVASVKSWL

SEQ ID NO: 4673 - protein, 487 aa, Gluconobacter oxydans 621H
MSETLTPSAGAANNVVGRVTQVRGPVVDVQFEGDLPFILNALHVQNGDHTLVLEVAQEIGERQVRCIAMDTTDGLVRGTEVRDTGKQIMVPVGPATLGRILNVVGEPIDERGPISSELRFPIHRPAPSFEEQAAASEILVTGIKVVDLLCPYLKGGKIGLFGGAGVGKTVIIQELINNIAKAHGGVSVFAGVGERTREGNDLYFEMQDAGVIKIAEDGSTEGSKVALVYGQMNEPPGARSRVALTGLSLAEYFRDEEGQDVLFFVDNIFRFTQAGSEVSALLGRIPSAVGYQPTLATEMGALQERITSTKKGSITSVQAVYVPADDLTDPAPAATFAHLDATTVLNRSIAEMGIYPAVDPLDSTSRSLDPKIVGEEHYQVARQVQQTLQTYKGLQDIIAILGMDELSEDDKKIVGRARRIQRFLSQPFHVAEVFTGAPGKLVSLEDTIRSFKAVVAGEYDHLPEGAFYMVGDIDEAIAKAEKMKQEA

SEQ ID NO: 4674 - protein, 178 aa, Mesorhizobium sp. BNC1
MRIDAISIGNNPPEDVNVIIEVPVGGQPIKYEMDKEAGTLFVDRFLYTPMTYPGNYGFVPHTLSDDGDPIDVLVCNTRQLIPGCVINVRPIGVLVMEDNSGQDEKVIAVPSPHLTRRYEDVHSHTDLPEITLQQIQHFFEHYKDLEPGKWVKIGDWMDAAAARRLISEAIERAKASAK

SEQ ID NO: 4675 - protein, 414 aa, Glycine max
MWRTTLDSSTMRALRLRSFLFSSSSSSSSSCCSLINIFCPSSSSSSFTTLTTIISHSFLPFPPTTRVLFTDSRRFGSPVPRRFGSPVPRCVSSLPTLDWNDAVSCSEVEVDANAADGGDDGAVDQDTKPSIAVRAFFFSTSVDLKSLVEQNKANFVPPSSRMTNYVVLKFGDICVSKGPGTFLSGRNGCYMVVFQYGSIVLFNVPEHEVDAYLKIVKKHASGLLPEMRKDEYEVREKPALSTWMQGGLDYIMLQYLNIDGIRTIGSVLGQSIALDYYGRQVDGMVAEFTDINREMEATGKFKMQRKKLFQLVGKANSNLADVILKLGLFERSDIAWKDAKYAQIWEYLRDEFELTQRFASLDFKLKFVEHNIRFLQEILQNRKSDFLEWLIIALIGAEILLSLYDIVHRSAMKF

SEQ ID NO: 4676 - protein, 348 aa, Oryza sativa Indica Group
MARYLLRPPTAAAAAAAAASSHRRNGTTSPRGPVLGLRALASRAGKARPVMAVASEQPAARGKCPKVAAPTTGPIPAAELLGVIQDAARAGAERGQVENWIEILAILQVNMEITVIMEAVNKPRNIHYKGVADLVTDTDKLSESVILEVVRKTFPDHLILGEEGGLIGDALSEYLWCIDPLGLATLFSLRFTTFSVSIGVLFRGKPAASTVVEQSLLVTGFGYEHDDAWVTNINLFKEYTDISRGVRRLGSAAADMSHVALGITEAYWEYRLKPWDMAAGVLIVEEAGGMVSRMDGGEFTVFDRSVLVSNGVVHDQLLDRIGPATEDLKKKGIDFSLWFKPDKYPTDF

SEQ ID NO: 4677 - protein, 466 aa, Arabidopsis thaliana
MDVPRPAFKCFDDDGRLKRSGTVWTASAHIITAVIGSGVLSLAWAIGQLGWIAGPTVMLLFSFVTYYSSTLLSDCYRTGDPVSGKRNYTYMDAVRSILGGFRFKICGLIQYLNLFGITVGYTIAASISMMAIKRSNCFHESGGKNPCHMSSNPYMIMFGVTEILLSQIKDFDQIWWLSIVAAIMSFTYSAIGLALGIIQVAANGVVKGSLTGISIGAVTQTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQLAARFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVYKPFKTTY

SEQ ID NO: 4678 - protein, 131 aa, Catharanthus roseus
RLHFHDCFVESCDASLLLDSTRRVLSEKETDRSFGMRNFRYLEDIKEALERECPGVVSCADILVLSARDGIVSLGGPFIPLKTGRRDGRRSRAEILEQHLPDHNESLTVVLERFGSIGINTPGLVAFPGGH

SEQ ID NO: 4679 - protein, 103 aa, Glycine max
MSTVTRAYLDQRLAAANRCSREAAMAGAKAAAVAAVAAAVPTLASVRMLPWARAHLNPTGQALIISTVAGMAYFIVADKTILSMARKHSFEDAPDHLKNTSFN

SEQ ID NO: 4680 - protein, 244 aa, Zea mays
  misc_feature (172)..(172): Xaa can be any naturally occurring amino acid
  misc_feature (198)..(198): Xaa can be any naturally occurring amino acid
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYXGVFVKWCMGEKDDGSDSIAVQLADEXHWNDLVIIIAVVSSKQKETSSTSGMRDSVETSPLLQYRAHGTVFSF

SEQ ID NO: 4681 - protein, 454 aa, Mycoplasma hyopneumoniae 232
MQKYDVIIIGGGPGGHSLAAILGKNGKKVALFEQEFLGGTCVNWGCIPTKTILKSAKIKSYFDNAEKFGLNSVAKFNFKQIFQRAKNNSLKLQGSILETLKNSGVDFYNKKAKVISNHTVLAENEEFFFEKLVIATGSKPRKIKIEGAERANLITSDDFFKGKIEFDELTIIGGGAISLEFAVFYASFGAKITIIEGNERVFANFDNSIAEAANFVLDRNKVKIFTKTKVKKYENGQLLLEKEGKIFAHTTKNILLAIGRQPQNEAFSGLKIDLDNRGFLKINKFMQTSVPDIYAIGDITGQMMLSSTAYKHADIVAKHILFGSSDEEFSAELIPWAIYSIPEIASVGKTEKQLLNLDVDFQKAKIFAKNLPRAHANGEIEAGFIELFFHSKTFEILGCNIFLEEASLLVNQVALALSQKLTIFDLQKMAYTHPSLSEAFYYLCRNITFSNLKK

SEQ ID NO: 4682 - protein, 213 aa, Glycine max
SFSFQLSELKVDKQSVGGCGGIIGRKKGAVAIRINYKGIRMVFISCHLSAHARNVEERNSQCRHISHSLFSKFWNPYSRPSHITIWLGDLNYRLQGIDTYPARSLIEQNLHRRLHGKDQLLQEAGRGQIFNGFCEGTLNFKPTYKYNKGSSNYDTSHKIRVPAWTDRILFRIEDENKMEATLHSYESMDEIYGSDHKPVKAHLCLRLRQIPTN

SEQ ID NO: 4683 - protein, 679 aa, Oryza sativa
MAQVVAAAGTAAAVAAVGRPLGGGGSGADALRPAARLSFAPRWCGGSAGAARARRESAVTSVISRAPRLDAEVLPVSADDDADVKEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKSYTEYDVLMLECFFAVYASSGGIGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQVRKVQSAQATGGSFAMTMRVAFAFQFLAIGAPETGVAELACPRFSFPSGTTRHMRARCAGGRALRADGEKDSCRFAN

SEQ ID NO: 4684 - protein, 290 aa, Triticum aestivum
MEGKEEDVRLGANRYSERQPIGTAAQGGGDDKDYKEPPPAPLFEPGELKSWSFYRAGIAEFIATFLFLYVTVLTVMGVSKSPSKCATVGIQGIAWSFGGMIFALVYCTAGISGGHINPAVTFGLFLARKLSLTRAVFYIIMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNKDHAWNDHWIFWVGPFVGAALAAVYHQVIIRAIPFNKSRS

SEQ ID NO: 4685 - protein, 259 aa, Triticum aestivum
MPAAVMRCPFLLGRHPAAALRHSSSSRMRRVRRAAGSGGQGRSPAYGGLLLDAGGTLLQLAQPVAETYATLGRPYGVMKSQKYIMEGFKRAFSAPWPKTLRYQGDGRPFWKIVVAEATDCTNNNYFEEVYQYYAHGDAWRLPDGAYRTLRDLKDAGVKLAVVSNFDTRLRKLLKDLNVSDMFDAIVVSSEVGYEKPAPEIFKIALEQIGVEARNAVHVGDDETADKAGANAIGLECWLWGEDVKEFSEIQHRIVAKRSR

SEQ ID NO: 4686 - protein, 338 aa, Xylella fastidiosa Temecula1
MSVALSIDLSKKKTILCFGEALIDMLAQPLVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRVEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGEVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 4687 - protein, 1367 aa, Ustilago maydis 521
MAPVRRLARASSSASVSSSPANLPTPTLSGPQLQSTSNAEPRISVHQTPTAAPRVLQHPSTSPSKPHGSNSFDAPIILSDTETDNGTAGIVQHTGSSDDDMTAPHRTAGVDNGKAQRLSLLFPAITDNHQDESRSSTTLDRSYATSLNSEVNLISDGSLSSLSSIDSDSDVTDDSDNKSIAAAISSLRSTPRQTHNKTPALLSKRGTEATPEATASSSSSSSTPSRRSARIVSSGSSIQKALQRRDDLDAKLLASPLRRKPDSPEAPPPPRRAVGRPRKSVQPVPAQSSAARLSTSPAVLPSSVQNLASPSSTRRSARLSLPFPMAPNSEYPASKDASQSPRREAELGPRPELRPGKHSRKFAEASDKSKPVITLQPFSDSVTFSASVGSAISNGPVGNSPAVTSDAQSIPTLPVERSRGRPRKSQPGLPTFPQTPAALTAEREQPALVTRLRKRNLSTAGMTAKSESLAVDEQQEDSDFPPRKRGRPARSSTSATDRTAGEPLSTASGQTLHGRTPLRIDVIDLLDDDLSELSDASDMSLNSSQPHQSASQSIQSGESHRQRPPQASTLPSKKLKRASKQNKDGKIYHYTGLYAGEADAVASTSSLYPDASQSTLLPYPIHFGAKLLTEERDFCLPYPIHQTMDQLRDRVNAKRKPPRYQQINKNKYVTRAKLQGEVPLCNCKPGSGCGHDCINRMLMFICDPKTCPSASNCTNISLGRRPHVKTAVAYYGRRGFGLKTLEAIKRDDFIDEYRGEVINLSEAAKRVTEEYKATGNYYLLDYDSAAGELLDGGRKGNITRFANHSCDPNCRIEKFIICGTDEALSAEFQIGLFANRDIAAGEELTYNYGWAAFQPRDITGAPTAQVPTEQCLCGAANCSGILGGKKAPVSKSAADAVAANTRKKTGKGRGKRKSKGKVSKSTQSSRIHLTSMAPLLSASRLSAAAIPSSALSSVEAARNLRKREDAQTRRNAISKITIKRRERSGRSAGDASSSTSASVTDSSVEPVTETWTKQISVPGGKNGQQIPRSRAAKAVHATKSRQAPRDPISSFSQVIDLTGEHATPSPIEAISPKEASSTSTSVQFTGPTDADQAALGGDVLSSSASRVFPQLPLPKRINIKKPGGGFGAMAARGTKDRRWLTAEAPSSDNDDSSSIRCDSAEYPSDILKEDDEAQLQDSSGKVPGKKRRGRHKLQLSAEEMARRAVERRARNAFLARKRRASKRGIVVMDPSHHPLKKISIQCTAAPENTYIPDLPSSLVTLGMTIADARRARNAFLARVRRAIKRGFPKDAAIKMAAKPLPGDPERDTPVMKAQRAYMEQLEREAADEVTDSSQNGHGSSGSVSASNSSVAAEDDDWEDEPRWAAAL

SEQ ID NO: 4688 - protein, 450 aa, Xylella fastidiosa Temecula1
MRVAIFGTGYVGLVTGTCLAEVGHEVLCVDINQEKVDGLNCGVIPIYEPGLEPMVKANHATGRLRFTTDSVAAIAHGEITFIAVGTPPDEDGAADLQYVLAVARTIGQCIDRPTIVVNKSTVPVGTADQVRAAIQHEMDVRGVDFKFEVVSNPEFLKEGDAVADCMRPDRIVIGARSRDAVVRMRRLYAPFNRNHDRIVEMDVRSAELTKYAANAMLATKISFMNEVANIAEHVGADIEYVRKGIGSDPRIGWHFIYPGVGYGGSCFPKDVKALARTAQQYGVDPKLLNAVEDVNHAQKGHLFELMLRHYGCSGESTMLAGKTFAVWGLAFKPNTDDMREAPSCRLLVQLWKAGAQVRAYDPESMQEARRIFGERDDLVFCETAYAALQCADALIVVTEWKQFRSPDFFVIRDALKDAVIFDGRNLYDPQEIEEAGLAYYGIGRGRSLHA

SEQ ID NO: 4689 - protein, 262 aa, Neorickettsia sennetsu str. Miyayama
MVTDIKIHSEKDFESMRKAGHLAAEVLDYITDYVKPGVTTDELNKLCHEFIVAAGAIPAPLHYKGFPKSICTSKNNVVCHGIPDAVPLRDGDILNIDVTVILNGWHGDTSRMYFVGTPSIKAVRLCKATYEAMMAGIAVVKPGVPFNAIGHAISTHTSQYEYSIVHQYCGHGIGQTFHAPPNVVHYASDENSDLIMLPGMFFTIEPMINAGRANVILDRRDGWTVRTKDLSLSAQFEHTIGVTQTGYEIFTLSPAGLHTPNF

SEQ ID NO: 4690 - protein, 904 aa, Oryza sativa Japonica Group
MAPALKAARGDEGVDTKVVDAVQAYVPQRCVVSLRDVGTEMTPGGSKEPSRANTPRVVAPAATARVVARGTASPGQCDGGSRDSAVAGGVVDLRAARKRADQGHDEVAGTITAVSPATAWGDAERAKYMARYRREEMRIQAWENRERRKAELQMRTAEEKAERMRLRAQARTAGKLATAQAEAKARRARAEAELALGRPGGGAKGFVRGAIHGCGEPRGVQGLRGGEGAGARRGVSRRSKEHYHHRHPSRHRDSERRRDGGRSGGRELSNGYSHRRDSPRPPPRRRPSEGRTEDREPGEVSGGSGSERSGERPMKTGEPRENGVTRVSKEEAKMSPSKKRKQSPVIWDRNGSKRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEEAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQRMKEQGNNGDRGLFG

SEQ ID NO: 4691 - protein, 470 aa, Pennisetum glaucum
MAVFSRTCLDSRFQVKKKQFFRNFMTITLFGAVGTMISFFTISLGAIAIFSRMNIGTLDVGDFLAIGAIFSATDSVCTLQVLNQDETPLLYSLVFGEGVVNDATSVVLFNALQNFDLNHIDVAVVLKFLGNFFYLFVSSTLLGVFAGLLSAYIIKKLYIGRHSTDREVALMMLMAYLSYMLAELLDLSGILTVFFCGIVMSHYTWHNVTESSRVTTKHAFAFATVSFIAETFLFLYVGMDALDIEKWEFASDSPGKSIGISSILLGLVLAGRAAFVFPLSFLSNLTKKTALEKITWRQQIVIWWAGLMRGAVSIALAYNKFTRSGHTQLHGNAIMITSTITVVLFSTMVFGMMTKPLIRFLLPASSNTVTSEPSSPKSLHSPVLTSMQGSDLEVATANIVRPSSLRMLLSKPTHTVHYYWRKFDDALMRPMFGGRGFVPFYPDHPPTRSMRTVTGKKPKIGHQEMKTCFW

SEQ ID NO: 4692 - protein, 445 aa, Vibrio vulnificus YJ016
MCGHLYRRTIIVCLRKRSMSFASQGFAPEVVKALEECGYEKLTPIQQKAIPVARRGHDIFATAQTGTGKTAAFSLPLIQQLLESGKSASRKTARALIFAPTRELAEQIADNIKAYTKYTNLSVAAIFGGRKMSSQERMLENGVDILVATPGRLEEHIESGNVSVANIEFLVFDEADRILDMGFINAVRKIMLDVETNPQIMMFSATTSSQLNELSKDILRKPKRIAVERENTTAHTVAHVLYPVDQERKTELLSELIGRKNWQQVLVFVNYKETANDIVKELKLDGIKANVCHGDKAQSARRRALEEFKEGKVRVMVATDVAARGLDIEDLPHVVNYDMPFLAEDYVHRIGRTGRAGKQGHAVSFVNREEELTVVQVENLIQQRIRRIELAGYEPKSREAYIDKLNSKPSFKNRQGRRNNANEPTDQAAAERRLAMMKRIKARRN

SEQ ID NO: 4693 - protein, 314 aa, Saccharomyces cerevisiae YJM789
MEQLCKRYVHTPAAFIQSIVANTKRTTLATQLSVEKAKKKVPKTALKKKLNSRPKERLPNWLKLNDVFNIHYEKPSNSDINKVNRFFNKAKVEFEWCAASFDDIPENPFLNKKSHKDILKDHGECGTTLIDTLPEVIFLGGTNVGKSSILNNITTSHVSRDLGSLARVSKTTGFTKTLNCYNVGNRLRMIDSPGYGFNSSKEQGKVTLQYLLERKQLVRCFLLLAGDKEINNTDNMIIQYIHEHGVPFEVVFTKMDKVKDLNKFKKKVMSSGLMDLPTLPRLVLTNSLTSSTSPKRFGIDLLRYVIFQSCGLIL

SEQ ID NO: 4694 - protein, 307 aa, marine gamma proteobacterium HTCC2143
MPLNPTLAAVLAQMAEAGAPELHQMSPADGRAMYLAMNADNTREPVTQVRDEMANGVPVRIYHPSPEETLPCLVYFHGGGWVIGDLETHDSICRKLANSASCVVVAVDYRLAPEHIYPAPMDDCYTALNWVVTQAAELGVNAHKIAVGGDSAGGNLSTVMALRARDENGPQICHQLLVYPVTDATFDTVSYSENGEGYMLSKATMEWFWHHYIGNDNDVLSPYISPLRAENLTNLPPATIITAEFDPLRDEGEAYAARLVAAGNTVTVKRFDGVVHGFFSMSDVLEEAQEAINLAAIELTAAFTAVN

SEQ ID NO: 4695 - protein, 592 aa, Medicago sativa
MNHLPRIFGYRNKSTTEMNSKKKKQPKLQRRNAVKNFNYDAQPSSSSPESSESASSSASILCTRSMDFHDRKSFRVEGVDGEFDIICRSLGLNGPEDFSIPAAAWEAMKFRSSSDVLPRLNVSEFDETKTSGEIDQVGVVDCDDRVLVRDSPAESSGGEVNVSIRDSPAKSSGCCTGGEIRVPVRGFDETSNCSTGSGGIKGIRPPMLKPPPGVRVSVVDDTCSTWDILRDFAPEGEGKEREEQEEEEEKVDEVEEKEEVGELELKVEEEENGDIIGEFSRSCSFTTSQEDDSSSTTTDTRSNSISPNVRLKPVITPGSWQKGELLGRGSFGTVYEGISEDGFFFAVKQVSLLDQGSQGKQSVVQLEHEIALLSQFEHENIVRYIGTEMDESNLYIFIEFVTKGSLLSLYRRYKLRDSQVSAYTRQILHGLKYLHDRNIVHRDIKCANILVDANGSVKVADFGLAKAIKLNDVKSCQGTAFWMAPEVVRGKVKGYGLPADIWSLGCTVLEMLTGKIPYSPMECISAMFRIGKGELPPVPDTLSRDARDFILQCLKVNPDDRPTAAQLLDHKFVQRSFSQSSGSASPHIPRRG

SEQ ID NO: 4696 - protein, 326 aa, Acinetobacter sp. ADP1
MLQSLDPQLASFFAMLENQGAPAFDIGTLNDPNINEMRNWYLNFGPHVAGQFIELQDVEDLWIQVDDGSLRLRLYKTQRQHSESCETLIYFHGGGWCIGSIETHDLLCRHLVNDLDVNVISVDYRLAPEYPYPQAAHDAIHATQWIFEHASALGIHPDHLYVAGDSAGGNLAAITALTFKEQTYRTSLAGQILIYPCIDLTVIHDNKYPSFEKQKLTPPLSAEQMSKMIQIYLKNEDFAYQWLASPLLAQSHQHLPSTLIITAEFDPLHDQGCVYFEKLKSSLVNTEYHEIKGVVHGFFEMYGVLNKTKETINIIRAWLKNNTKSK

SEQ ID NO: 4697 - protein, 189 aa, Saccharomyces cerevisiae YJM789
MGKAKKTRKFGLVKRTLNTKKDQRLKKNQENIKTKDDPELTRNIPQVSSALFFQYNEAIKPPYQVLIDTNFINFSIQKKVDIVRGMMDCLLAKCNPLITDCVMAELEKLGPKYRIALKLARDPRIKRLSCSHKGTYADDCLVHRVLQHKCYIVATNDAGLKQRIRKIPGIPLMSVGGHAYVIEKLPDVF

SEQ ID NO: 4698 - protein, 275 aa, Pseudomonas putida
MRLEGEVALVTGGGAGLGRAIVDRYVAEGARVAVLDKSAAGLEALRKLHGDAIVGVEGDVRSLDSHREAVARCVEAFGKLDCLVGNAGVWDYLTQLVDIPDDLISEAFEEMFEVNVKGYILAAKAALPALYQSKGSAIFTLSNAGFYPGGGGVLYTAGKHAVIGLIKQLAHEWGPRIRVNGIAPGGILGSDLRGLKSLDLQDKSISTFPLDDMLKSVLPTGRAATAEEYAGAYVFFATRGDTVPLTGSVLNFDGGMGVRGLFEASLGAQLDKHFG

SEQ ID NO: 4699 - protein, 371 aa, Acinetobacter sp. ADP1
MTKFTEITAAVTECKGADFELKQLKIREPQNDEVLVKIVATGMCHTDLIVRDQYYPVPLPAVLGHEGSGIIEAIGPNVKDLAVGDHVVLSYGFCGSCEQCSSGQPAYCQDFFGRNFSGGDPDGHSAVCSHDHHKIHDHFFAQSSFATYAISRENNAVKVSKDVPLELLGPLGCGIQTGAGAAINALKVAPASSFVTWGAGAVGLSALLAAKVCGATTIIAVDIVESRLALAKELGATHVINSKTQDPVEAIKEITGGGVKFALESTGRPEILKQGIDALGILGSIAVVGAPPLGTTAAFDVNDLLLGGKSIIGVVEGSGVPKKFIPALVSLYQQGKFPFDKLVKFYDFKDINQAAIDSHKGITLKPILKIG

SEQ ID NO: 4700 - protein, 506 aa, Acinetobacter sp. ADP1
MVLNNRKNEIIEKARTGRYEVYMTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 4701 - protein, 236 aa, Vitis vinifera
MHLGSFNTLMLQDFMCILVELRFALLWLCTLGALYCGVTFYSFMVLVSIRDIYLVKTTYVIKEVTLVFLTRTLYASLEPQSLGFGRCFEFLTGDNAIRVYITYECFVGYIEAIREIEQQLPTGTDEVGFDDIVVACGSGATIAGLSLGSSLSKLNTKVHAFSVCDDPDYFYDYVQDLLDGLQAGVRSHDIVDIQNAKGLGYAINTTEELNFLKEVAVSTGVVLDPVYRLDITFFNP

SEQ ID NO: 4702 - protein, 515 aa, Oryza sativa Indica Group
MAQQLSAPFRAAAAAGSRASAAAADPAKGIALPSIPPVLPLPHLLPHPPSGIFRARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYRNVQQTIGNLPQLQNLQNFDSIQRLVESNSRELCRLLPRGKVSGYSPSIKSAAAAIEEKPKFYIIFVNGAETKATKPPSFLKLNLIGQGRLDEIARVAACRTTGVRRRTTGVRQGAY

SEQ ID NO: 4703 - protein, 187 aa, Gluconobacter oxydans 621H
MVRINSPLKPFSTDAFRNGEFLTVTDSDVRGKWSVFFFYPADFTFVCPTELEDLADNQAAFDKLGVEIYSVSTDKHFTHKAWHDTSPAIGKIKYTMLGDPTGTIARNFDVLIEEAGLADRGTFLIDPEGKIQYIEITAGGVGRSAAELLDKIQAAQYVATHPGEVCPAKWKEGGETLKPSLDLVGKI

SEQ ID NO: 4704 - protein, 470 aa, Chlorobium tepidum TLS
MMIMPVILSGGSGTRLWPLSRAMYPKQLLPLFGEKTMLQDTVLRVGSIEGVGPVICVCNDEHRFLVAEQLRQIGVAEQAIILEPFGRNTAPAAAIAALVIAATHPGALMLLLPADHVILDRQGFVASIESARSAAESGSLVTFGIVPSTPETRYGYIRAVAGSTGVTRPVAEFVEKPSLERAEGYVVSGDYFWNSGMFLFRPEIYLAELEASSPEILDACRKSLENARRDLDFLRLDPEAFAACPANSIDYAVMEKTSNAVVVPMQAGWRDVGAWSALWEAQERDAEGNIKRGDVLTHGVRNSYIHATSRLVAAVGLEEHVIVETADAVLVASKERVQEVKAIVEQLKLQKREEPLIHRRVYRPWGSYETVDEGERFKVKRITVKPGAALSLQMHSRRAEHWIVVTGRALVTVGKKQVPLEANQSIYIPVEELHRLENPGDEPLELIEVQSGGYLGEDDIVRFEDHYGRL

SEQ ID NO: 4705 - protein, 513 aa, Magnaporthe grisea 70-15
MATSSGNTASGATNDQIMAALKQMQEEQTRLLSMLSQGERQGLLSSTGTAGSGLDSSESDLTASPGLTGTSSAVPADEAAERDSTSPSTSGTKSNFTSRIVLTTYPKQIGINPLPMKWGAPDAVQRGPVVVQRGPSTIRRRNAIGAHGGGYSIYYALALASQELKADHRPDFTNTEPAAEIGPFPQWGDPKKIVAMDPWGHIAPFLFKDVINKENVDIRPTIAITKAHMKLPELEESVRSGRLVPDGKVCINAQGELAVTKFAVEPVWYLPGVAERFGLDEGTLRRSLFEHTGGSYPELITRGDIKVFLPPIGGLTVYCFGDPAKMSDPNSRLALRIHDECNGSDVFGSDICTCRPYLIFGIEEAVKEAQNGGSGVVIYFRKEGRALGEVTKYLVYNARKRGEDRASDYFKRTENVAGVKDMRFQALMPDILHWLGITKIDRMLSMSNMKHDAIVGQGIPIHERVELPESWIPADSRVEIDAKITAGYFTTGHRMTESELASVQGRLWEDVDH

SEQ ID NO: 4706 - protein, 243 aa, Magnaporthe grisea 70-15
MPAAKPPSQGVGPVYQAEHQKPTATVSTDVTRFANVTVLPQTPQLIALLTIIRDKATERGDFIFYSNRIIRLLVEEGLNHLPTVEHTVTTPVGRPYAGLMFQGKICGVSIMRAGEAMEQGLRDCCRSVRIGKILIQRDEETATPKLFYDKLPEDIASRWVLLLDPMFATGGSAIMAVEVLKGRGVPEERILFLNLIASPEGIENFATKFPKLRVVTAFVDQGLDEKNYIIPGLGDFGDRFYTM

SEQ ID NO: 4707 - protein, 324 aa, Oryza sativa Japonica Group
GGGRPVGRERGAEMAKHFVLNTGAKIPSVGLGTWQSDPGVVGNAVYAAVKAGYRHIDCASAYNNEKEVGLALKKLFEEGVVKREDLFITSKLWCDHHAPEDVPEALDATLNDLQLEYLDLYLIHWPFRTKKGSSIGKPESYLPPDIPSTWAAMEKLYDSGKSRAIGVSNFSSKKLGDLLAAARVPPAVDQVECHPGWQQMKLHNFCQSTGIHLSAYSPLGSPGSTFMNGNVLKEPIIISIAEKLGKTPAQVALRWNIQMGHSVLPKSVSEERIKQNLDVYDWSIPEDLLAKFSEIKQVRLLRGNFIVNPQSVYKTHEELWDREI

SEQ ID NO: 4708 - protein, 671 aa, Solibacter usitatus Ellin6076
MPFITNEPRPSGSPTRTSSAVTLPDGRGSFQLRVPDATDYWVEMVKCRHACPVHTDACGYVNAIAEGRPEDAYRIARATNPFTSICGRVCGAPCEANCRRGDLDAPVAIRALKRFVNEQFGPETGDYRLHREAGDSRMLPPNRGDYERVAIVGAGVAGLTVAHDLAQIGYKVTVFEAHSEPGGMLMVGVPVFRLPRDLVRHEIQAILSLGVELRCNVRLGRDFTIASLRQDGYKAIFLGMGLQKGRKLPLPGADLEGVYDGMDFLRAFNEGRSLPLGRRVIVIGGGNVAYDVARSALRPDNDHMAYDVARAALRLSGDKEVHVVCLESREEMPADAIEIHEGEEEGIVLHNRRGPRAVIEENGKAAGLRVTHCTSVFDAEGRFNPQFDESHVEDIAADSVIFAIGQTSDLSFLTPEDGVDTARGLIKVNPETYQTTAPDIFACGDIAHGARLFIDAIASAQIAARSMHDFLRGTRTDVVLRKHWKPASYNMAEGWNRFDRENPPVIDSERRAASLEIIECVYSENDARRQAARCLRCNVNTVFDTKICIACNGCVDVCPENLIRLVGLSKLISDDHWLETAAANFGVEPDDLRALPPEELDTFGGVMMKDETTCIRCAMCASRCPTHAILMKHFVFHRECVTVPTVNTKLLPGGAANPGCSRLPAGSRSAT

SEQ ID NO: 4709 - protein, 529 aa, Mycobacterium sp. MCS
MTTTSATTMASDAASPAAQVLPTADELRGRVRTAFESIGATAYLGAPGGGGLPASTPITGEVLFTVEESSPAQTEAAIEAAADAFGQWRTTPPPVRGALVARLGELLVEHKAALASLVTVEAGKITSEALGEVQEMIDICQFAVGLSRQLYGRTIASERPGHRLMETWHPLGVVGVITAFNFPVAVWSWNTAVALVCGDTVVWKPSELTPLTAIACQALLQRAAADVGAPSAVGQLVLGGRDVGETLVDDPRVALLSATGSVRMGQQVGPRVAQRFGRALLELGGNNAAIVTPSADLDLAVRAIVFSAAGTAGQRCTTLRRLIVHRSVADDLVERIVAAYRQLPVGDPAADGTLIGPLIHETAYRDMVAALETARADGGEVTGGERRIFEGDSGDMSFYVTPAVVRMPSQTAVVHAETFAPILYVLTYDDLDEAIALNNAVPQGLSSAIFTLDVREAERFMAADGSDCGIANVNIGTSGAEIGGAFGGEKQTGGGRESGSDAWKAYMRRATNTVNYSAELPLAQGVHFG

SEQ ID NO: 4710 - protein, 181 aa, Photorhabdus luminescens subsp. laumondii TTO1
MSETLRSYLDIQPKVGQNVMLDSSSVIIGDVRLADDVSIWPLVVIRGDVNYVSIGARTNIQDGSILHVTHKTTDNPDGFPLIVGDDVTIGHKVILHGCTIGNQVLIGMGSILLDGSVIEDNVIIGAGSLVAPGKILESGYLYIGSPARQARKLKPEELKGLCYSASHYVSLKNNYLQEGNM

SEQ ID NO: 4711 - protein, 456 aa, Gibberella zeae PH-1
MFSRLASFANPAAKSASASGRTMLQVRYLSEKAVAGSKGRAMPFSAVRATAPAASLPATLTIRDGPVFQGKAFGANANISGEAVFTTSLVGYPESMTDPSYRGQILVFTQPLIGNYGVPSAARDEFNLLKYFESPHVQCAGIVVSDVAVNYSHWTAVESLGEWCAREGVPAISGVDTRAIVTHLREQGSSLARISIGEEYDADEDEGFVDPGQINLVKRVTTKAPFVVESPGASLHVALIDCGVKENILRSLVSRGASVTVFPYDYPIHKVSQHFDGVFISNGPGDPTHCQATVHNLARLMETSNIPIMGICLGHQLLALAVGARTIKLKYGNRAHNIPALDLTTGLCHITSQNHGYAIDASTLPSDFKEYFVNLNDGSNEGMLHKTRPIFSTQFHPEAKGGPMDSSYLFDKYLQNVQLAKSNQVVFKDNRPTPLMLDIMSRERVGVEPTPLAASA

SEQ ID NO: 4712 - protein, 115 aa, Prochlorococcus marinus str. MIT 9515
MKSWSCIENCGACCRFDLAERKNISSVLSRKDIDLINSMTRKDGWCKYFDKSKKACMIYESRPHFCRVSEFSKSFKAYLKKGDKFLIECCNQHISSIYGRKSKQMKAFKTAISTK

SEQ ID NO: 4713 - protein, 417 aa, Vibrio sp. Ex25
MQTTIAITAGSMVLSLLILIAGQNNWFHLTEIATETVTRINFEDFLLKGILGFLLFAGGLGIKLPNLKDQKWEITVLALGATLFSTFFIGFALYGFCQLIGIQFDLVYCLLFGALISPTDPIAVLAIVKKLDAPKRISTQIEGESLFNDGFGLVIFVTLFTIAFGTEAPTVGSVTLLFIQEAIGGITYGFVLGLLFHYLISATDDHSMELLLTIGVPTAGYAFAEYIHVSGPLAMVVSGIMIGNWTRFIGFSKESEDHLDHFWELVDEFLNGVLFLLIGMSMLLFEFHKEDWIMMAISVPLVLAARYLSVFLSYIGFKRYRKYNPWSVRILTWGGLRGGLALAMALSIPSGIWVIQDKLIDVKEIILVMTYSVVVFSILIQGSTITPMIEKAKDEEKKMEENNQAITTPEHTEPVDS

SEQ ID NO: 4714 - protein, 411 aa, Bartonella vinsonii subsp. berkhoffii
MTTEIRVPTLGESVTEATVGKWFKKLGEAVAIDEPLVELETDKVTVEVPSPVAGKLFEIIAKEGDTVEVNALLGAVEAGAASVAKSPSSSETSVSAAPSELEQSSSSNTMPPAPSAAKLMAENNIAKSDILGSGKRGQILKEDVLNVLAQGVKTSPPAVSASSSTPVSVSSSAVAPVQEMREERVRMTKLRQTIARRLKDAQNTAAMLTTFNEVDMSAVMGLRKRYKDLFEKKHGVKLGFMGFFTKAVCHALKELPAVNAEIDGTDIIYKNYVNAGIAVGTDKGLVVPVVRDADQMSLAEIEKEIGRLGRLARDGKLAVSDMQGGTFTITNGGVYGSLMSTPILNAPQSGILGMHAIKERAMVVDGQIAIRPMMYLALSYDHRIVDGQEAVTFLVRVKESLEDPERLVLDL

SEQ ID NO: 4715 - protein, 472 aa, Acinetobacter calcoaceticus
MTTKILPVIMAGGSGTRLWPLSRTQYPKQFLKLSPDGYTLLQATLFALKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSAMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 4716 - protein, 370 aa, Mesorhizobium sp. BNC1
MLHAREPSILKKPVGDDSLSISDITSEAARLPSFDGHENIWCGRDEDRGLTAIVAIHNTKLGPALGGTRLWPHESFEAALTDALRLSRGMTYKSAVAGLPLGGGKAVIIADPKTGKTPALLTAYAEMLVRLEGQFITAEDVGMTLEDADFLREHAPNVVGTSAGGSGNPSPFTAEGVFLGIKAALKHRNGTERLSGIRVAVQGLGSVGWSLCEKLYREGAALIVTDLDPGQVEKAKRAFEAETVAPGEIVTVSADVFAPCALGGAITARNVPHIKFGIIAGSANNQLAKHEDARLLMERGILYAPDYVINAGGLINVAAELSPEGYDPEAVMAKLAKIPLTLTEIFQRAEQQKRPTNDIAAEMAMERIRR

SEQ ID NO: 4717 - protein, 492 aa, marine gamma proteobacterium HTCC2143
MTDPFDIVIFGGTGDLALRKLIPALYRAFLAAQLPDGTRVIASCRSQDDIDNYLDTAALALQQHLTPEEFSVAAWEQFKAYLNPVMLDISVLDDNWTSLKGVMDIAPDKVRVFYLATPPDIFGVTCRYLNEMTLITAKSRLVVEKPLGYDAVSANAINTEIAQYFKEDNIYRIDHYLGKETVQNLMALRFTNIIFEQLWNAKSIDHVQISISETVGLEGRAGFYNDAGALRDMVQNHLLQLLCLVAMESPNKVDAKSIQAEKIKVLEALRPIRGEDVALHTVRGQYVAGSYLGELVPGYLEELNSSNSTTETFVAIRAYIDNWRWARTPFYLRTGKRMKSRGAEIVIQFKDVPHRVYEDSAGPLEPNRLVIRLQPEELIQMTVMSKNLENMDMQLKPATLNLNFSDTYTQFRSDAYKRLILDAAAANTSLFIHRDEVSSAWQWIDPIAEAWQEGKAIPHLYRAGTWGPEESDELLAQSGHRWFNSGEKESKS

SEQ ID NO: 4718 - protein, 450 aa, Vibrio sp. Ex25
MSAFNVAKFGGTSVANFEAMSRCATIIENNPNTRLVVSSACSGVTNLLVELANGVQDQTHRTELLQNLANIHDAILTQLEDSTKTAAEVYGILDTVTSLAEAASIQASAKLTDHLVACGELMSTHILTQLMCERGIQAVRFDIRDVLRTDDNFGRAEPNIEAISTLAQDKLIPLCQQSVVVTQGFIGSDEAGNTTTLGRGGSDYSAALIAESVKAAGLEIWTDVPGIYTTDPRIAPKASPIPEISFSEASEMANFGAKILHPSTLVPALRHDIPVFVGSSKEPEKGGTWIRHQVESSPLFRALALRCNQTMVTLRSANMFHAYGFLAKVFEILAKHKISVDLITTSEISVSLTLDQTDTSGGAPQLPQAVREELEELCKVEVEHDLCLVALIGNNMSESKGYAKQVFGTLEDFNLRMICYGASPHNLCFLLHESVSKQAIQKLHTELFEK

SEQ ID NO: 4719 - protein, 359 aa, Ustilago maydis 521
MSCKTYKIAVIPGDGIGQEVMPCGLQALRAASARFKFDLSITAFDFASCDYYDKHGKMMPDNWIELLTPFDAIYFGAVGDPARHPDHVTLWGSLLQMRRHFDQYVNLRPCRLVKGVPSPLASPGEIDFWIVRENTEGEYSEVGGKIFEGTERETVIQETIMTRVGVDRILEYAFKLAKTTKRKRLTSATKSNGIKITMPYWDDRFKLMSTAYPEVATEQFHIDILTAHFVAKPSHFDVVVGSNLHGDILSDLGPAVTGTIGIAPSGNINPEGKFPSLFEPVHGSAPDIMGRGIANPVGMIWAGQMMLLHLGEKEAAETMIKAIDFVLGQSDQSMLTPDMKGRGTTKKLGDAIAEAIASV

SEQ ID NO: 4720 - protein, 342 aa, marine gamma proteobacterium HTCC2143
MTIRVAINGYGRIGRNILRALYESDYRQSIRLVAINDLGDTAFNAHLTQYDSVHGRFPGSVAVQDDKLIINGDEIITVSERDPSQLPWAELAIDVVYECTGFFTSRDKAYGHIEAGAKKVIISAPAADVDATVVYGVNENILTPDCQIISNASCTTNCLAPVAKVLNDGVGIELGSMTTIHAFTNDQSLHDVYHSDIYRARAAGQSMIPTKTGAAQAVGLVLPELAGKLDGMAVRVPTANVSLVDFTFLASRDTTVEEINQLIDTAAATMMPGVLEYNEQPLVSIDFNHQPASSTFDATQTRVNGRMVKVMAWYDNEWGFSNRMLDNTLALMSAQHNTSKAA

SEQ ID NO: 4721 - protein, 373 aa, Vibrio sp. Ex25
MSIQSFIPPHRILMGPGPSDIYPQVLQALSRPTVGHLDPLFIGMMDELKQLLKYAFQTDNEFTIAVSAPGSAGMETCFVNLIEKGDKVIVCRNGVFGERMRENVVRAGGEVVIVDDEWGTPVSIDKVEQALEQHPDTKILAFVHAETSTGAVSDAQALGKLAKQHNALSIVDAVTSLGGVPLKVDEWQLDAVYSGSQKCLSCVPGLSPVTFSPAAIEKIQARTTPVQSWFLDQSLVLGYWSGEGKRSYHHTAPVNSLYALHEALLILKNEGLENAWARHQLMHEKLKNGLQKLGFEFVVDEAHRLPQLNAIYVPEGIDEAKVRAHLLETYNLEIGAGLGALAGKAWRIGLMGYGARPENVALCLKALEESLTE

SEQ ID NO: 4722 - protein, 340 aa, Gluconobacter oxydans 621H
MTKTIPATLIAGDGIGPEIMQSVTTVMDALGAPFLWDHQSAGVGAFDQHGTALPEATLDSIRRTGLVLKGPLTTPVGKGFRSINVTLRQAFDLYANVRPTQTIVPGGRYENVDLVVIRENIEGLYAAMEYYMAVDGDPEAVAYGAGFNTRTECNRIVRFAFEYAVKNNRKKVTLVHKANILKILSGLFLHEGRKVAAEYEGRVALEERIVDACAMELVIRPENYDVIVTTNLFGDILSDLTAGLVGGLGMAPGANIGEKMGIFEAVHGSAPDIAGQGIANPLALMMAGSMMLAHVGRQDLSQRLDGAMKQILQVEGLRTRDLGGKATTQDVTQALLRAIQ

SEQ ID NO: 4723 - protein, 169 aa, Anabaena variabilis ATCC 29413
MDLSRIPAQPKPGVINILIEIAGGSQNKYEFDKDLEAFALDRVLYSSVKYPYDYGFVPNTLADDGDPLDGMVIIDEPTFPGCVIAARPIGFLEMIDGGDRDEKILAVPDKDPRYAHVKSLNDVAPHRLDEIAEFFRSYKNLEKKVTQILGWQDVDQVKALVDKSIKAYK

SEQ ID NO: 4724 - protein, 290 aa, Vibrio sp. Ex25
MIKKCLFPAAGYGTRFLPATKSMPKEMMPVVNKPLIEYGVEEAIQAGMNGMCIVTGRGKHSIMDHFDKNYELEHQISGTNKEELLVDIREIIESANFTYIRQREMKGLGHAILTGRELVGDEPFAVVLADDLCVNEEEGVLAQMVALFKQFRCSIVAVQEVPEDETHKYGVISGEMIKDDIYRVDDMVEKPEKGTAPSNLAIIGRYILTPDIFELIENTEPGKGGEIQITDALLKQAKAGCVLAYKFKGKRFDCGSVEGYIEATNYCFENLYLKDEKASELGKHATQKAV

SEQ ID NO: 4725 - protein, 172 aa, Zea mays
  misc_feature (32)..(32): Xaa can be any naturally occurring amino acid
  misc_feature (90)..(90): Xaa can be any naturally occurring amino acid
MAGPAVLNERILSSMSQKHVAAHPWHDLEIGXEIPRGSKVKYELDKASGLIKVDRVLYSSVVYPHNYGFIPRTLCEDNDPLDVLILMQVXNGEKDDKIIAVCADDPEFRHYTDITDLPPHRLQEIRRFFEDYKKNENKEVAVNEFLPAKDAINAIKYSMDLYGSYVIESLRK

SEQ ID NO: 4726 - protein, 154 aa, Zea mays
  misc_feature (110)..(110): Xaa can be any naturally occurring amino acid
  misc_feature (131)..(131): Xaa can be any naturally occurring amino acid
MPLLRVLCTDVGGDQMAYALLQRALSVVSSSTYYNSSTLVLTMWLAMACLLRDQHEQWKHKYGNSCRSVKIFLCQLPRKNGLYSAQPPKHDGSEKPLCPGAPVWPQCGTXKGDKICYNLQKKKGTGLKKHXTRHWRYGAKKKNSPPKKKNSRAL

SEQ ID NO: 4727 - protein, 839 aa, Ustilago maydis 521
MSSAGPSTDHGDKAFSNVITSTCTPGPSPVSTPGAMSALPVPMSGGPHHHTPAMPSNSMSIAGTSQEQNTPGSFGPSSMNASSDMGSVMTEDEEDLEDYGKGGYHPVHVGDTFSEGRYLIVRKLGWGHFSTVWLAKDNKMKRHVALKVVKSAPHYTETALDEIKLLQRLVSANPNHPGRRHCVSLLDHFRHKGPNGSHVCMVFEVLGENLLGLIKRYQHRGVPPHIVKQIAKQVLLGLDYMHQECGIIHTDLKPENVLICIEDVEAVVEAELRSNPAAVPTKLVGVPPSQGRGGTQTPRRDGIFITGSQPLPSPSSSLGSSPMFDKWAFGMSKIDKPSVSDSENGFRSGPGSEAAGSKGGSLATSKEREKSTEAIGHGISQLSTQGSSSLPADSFGSRMSKGAPQQKGPSLLSLGAPRVPQQASESTATAPKAEPSDSPSPMSMDSPSPPNHQEPTPMDQEMHQPAVSAGDPNTLPPPPPYDPSSLERITVKIADLGNACWVDHHFTNDIQTRQYRCPEVILGAKWGPSADMWSASCMFFELLTGDYLFDPAAGTKYNKDDDHVAQIIELLGDFPKSLAFAGKYSADIFNRRGELRHIHKLRFWPLISVLQEKYLMPYNDANELSSFLLPMLRLHPEKRAGARELLDHTWIDGIVVQGEIEQAMRQAGIDVEALTASSPSGRTLPPGLTPSEADALKPVGSVSSSPATMSLNMQGLEDAKRRAAQHQAELAAATAGGVNGTAASNQSSAASSALPTPSHSGSRDPVHALQAESLERSVSSDGAGESHMTVKGAGDDSGIRQVSTPKLSAQQQTPQGNSANRPGSPSPQGLPRPVATTVQ

SEQ ID NO: 4728 - protein, 464 aa, Oryza sativa Indica Group
MLRACGGASPAAAAAVPALVRARLAKQASSAAHAAATATASASSSLSALGEVAAGRKGLARVVLKKGKTQIFRDGSPMVYSGAVDRIIGRPPPKTGDVVLVADGAEKPIGWGLYNSVSMFCVRLMQLEEEAKRDPTCALNMERLLEARILSAVDLRRSLGLPSVHTNAYRLINSEGDRLSGLIVDIFADVAVVASSAAWVEKYRHEIQFLVNKVSDVNHIKWRSSTDILKEEGLDVSEQKDPELSSHCGTVEVMENDVLYLVSLEGQKTGFYADQRENRHFISTLSKDQRVLDLCCYSGGFALNAAKGGANNVIGIDSSASALDLASKNIILNKLDTQRISFVKEDATAFMKGAISRNEVWDLVILDPPKLAPRKKVLQSASGMYRSLNALAMQVVKPGGLLMTCSCSGAMTQSGLFLRTIQGAASMTGRKVTVLRQAGAACDHPVDPAYPEGRYLSNYLLRVT

SEQ ID NO: 4729 - protein, 334 aa, Oryza sativa Indica Group
MAAWRRPGGTPGSPNSKFTQQELPACKPILTPKWVISVFVLVGVIFVPIGLVSLKASRKVVEIVDRYDDACVPANTTDKLAYIQNPTISKNCRRTLKVPKDMDAPIFVYYQLDNFYQNHRRYVKSRSDAQLRDPKKANDTSTCDPEGTANGMAIVPCGLIAWSIFNDTYGFVRNSKNLPVDKKDISWKSDREHKFGRDVFPKNFQNGSLIGGKTLDPNKSLSEQEDLIVWMRTAALPTFRKLYGRIHTDLKKGDTITVTLENNYNTYSFSGKKKLVLSTSTWLGGKNDFLGLAYLSVGGLCFFLAFAFTLLYLIKPRKMGDNNYLSWNRNPAGR

SEQ ID NO: 4730 - protein, 555 aa, Oryza sativa Indica Group
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIVSTEVAPFGGVKQSGLGREGSKYGMDEYLELKYICMGNLN

SEQ ID NO: 4731 - protein, 489 aa, Pseudomonas aeruginosa PAO1
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWIIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVTATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 4732 - protein, 426 aa, Rhodopirellula baltica SH 1
MTLKMIGCSHHDAAVEIREQLSFTENEINRTFELFGQRFADAELVLLSTCNRVELYGAGSNPASLQSDDLIDLVADCLNQSRDFVANHMIIREGREAVEHLFLVAASLDSMVVGEAQILSQVKQSYDLANDADRTGPITHGVFQAANRTAKRVQTETSIHRRRLSVPSVAIGEVVPEVFNRLQGKRVVLCGAGEMAEETLRYLKNGGANNLCVVNRSLDRAQKLADEFGADAESMDSLHDQIVQADLLIGTTSAEEPIVDASTFAALNAKRGGRIMLVLDLAVPRDFDPVIGDEPGVYLYQIDDLQAACNRNRREREKQWPKAKKIIDEEVDGFFQSLQQRATGPVIRRLRERADKVKAEELQRLFGKLNGSTDTAMQKEIEKSFDRLTNKLLHPPMASLRDDAADGHSRGLLEALRHLFNLGEDS

SEQ ID NO: 4733 - protein, 275 aa, Xanthomonas campestris pv. campestris str. 8004
MPSFKSFLLHRVSPVCLCVAAGWGTAAMAQTVLPDATPVHAHETTPHDGHEWGYTGPEGAEHWAELAKENALCGNGQQNSPIDLKDAIDATLGKLQLDYSAVPLVVRNTGHSIQLDLHAGGTMRVGGKQYDALQLHFHHPSEHLLNGRRFPMEAHIVHQGPDGTLGVLAIFFETGKANPAFQRVLDAMPNDKNQTRQVADALVRASDFLPPATQRSFYRYEGSLTTPPCSETVDWVVLSQPVQVSREQINAFERVYPFNARPLQPLDRRFLLKSH

SEQ ID NO: 4734 - protein, 390 aa, Glycine max
MGRLAESKLVQELVLYAASAALSCLVLFVGLRQLDPNREASKKAFQHKKEIAKRLGRPLVQTNPYEDVIACDVINPDNIDVEFNSIGGLETIKLALFELVILPLKRPDLFSHGKLLGPQKGVLLYGPPGTGKTMLAKAIAKESGAVFINVRISNLMSKWFGDAQKLVAAVFSLAYKLQPAIIFIDEVDSFLGQRRTTDHEALLNMKTEFMALWDGFTTDQNAQVMVLAATNRPSELDEAILRRLPQAFEIGIPDQRERADILKVILKGERVEENIDFDHIAYLCEGYTGSDLFDLCKKAAYFPIRELLDEEKKGRSFSAPRPLSQLDLEKVLATSRKTTVAAFEYNGLSADALRWSGQGEQDDYQVQAAINELKFVVSHMINRQPDAKDL

SEQ ID NO: 4735 - protein, 245 aa, Synechococcus sp. RS9916
MAIVGIFTALVLAIAAFFVVPAGEVGVITTLGKVSDAPRLPGLNIKTPFVQSVHYFNVRTQVRPEEFSSLTKDLQVIEATATVKYAVKPLQAPRVYNTISTGNEGIYARIIQPSLLKSLKSVFSKYELVEIATDWNTISSIVEQSVAKELEKFDYVEVKGLDLTGLKIAEEYRSAIEQKQIAEQRLLKAETEVKIAEQEAIKFETLNKGLNEKVLYKLFLDKWDGQTQVVPGLSGGATPPVIVGR

SEQ ID NO: 4736 - protein, 135 aa, Zea mays
  misc_feature (14)..(14): Xaa can be any naturally occurring amino acid
  misc_feature (41)..(41): Xaa can be any naturally occurring amino acid
FATPSPQIIHALHXSLTQILTKPLSERFQGHIEVSNKVKKXAVTDLGLKVVATKPEDQAHAMTAIYLPDGIGAADVLPKLAAKGVVFAGGIHKAIAPKYIRFGHMGVSALDPSRNHIEKALSALKDSLFEVGYKA

SEQ ID NO: 4737 - protein, 194 aa, Prochlorococcus marinus str. MIT 9515
MSLRVGQEAPNFTATAVYDQEFKEITLSSYKGKWVVLFFYPLDFTFVCPTEITAFSDEYEKFSALNTEILGVSVDSKHCHLAWIQTPRNEGGIGDINYPLVSDLKREICQEYNVLNDDGEADRGLFLINPQGIVMHTTVNKAPVGRNVDETLRILQGYQYVAANPDEVCPANWTPGEKTMLEDPKGSKEYFSAL

SEQ ID NO: 4738 - protein, 456 aa, Zea mays
RSGQPVPRPRIAAAAPSWRRRLPLAPAARHLRPPWLCRLVAPAGAARDKVRRHTISVFVGDESGMINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTMEVAGDPGKIAAVQRNLWKFGIKEICRTGKIALRRERIGATARFWRFSAASYPDLIEALPKNPLTSVNRTVNGSFVQPSNAGGDVYPVESYESLSVNHVLDAHWGVLDDDDATGLCSHTLSILVNDCPGVLNIVTGVFARRGYNIQSLAVGPAEKEGISRITTVVPGTVESIEKLVQQLYKLIDVHEVHDITHSPFAERELMLIKVSVNTAARKEILDIAEIFRAKPVDVSDHTVTLQLTGDLDKMVALQRLLEPYGICEVARTGRVALVRESKVDSKYLRGYSLPL

SEQ ID NO: 4739 - protein, 477 aa, Yersinia pestis KIM
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 4740 - protein, 112 aa, Zea mays
MKDGTSSGGGAFAAGSDPRQPSTAKPYAPPKLSPQDLPIDYAGFLAVAFGVLGVMLRYKVCSWIAIIFCAQSLANMKNFENDLKQLSMAFMFAVMGLVTNYFGPARPGSTKR

SEQ ID NO: 4741 - protein, 707 aa, Elaeis guineensis
MALSTFSFPSQMPSLLCPHWLGGADLHSHQHQYRLLKTRKRPCVCASLSEHGEYHSQRPPTPLLDTINYPIHMKNLSIKELKQLGDELRSDIIFHVSKTGGHLGSSLGVVELTVALHHVFNAPQDKILWDVGHQSYPHKILTGRRDKMPTLRQTNGLSGFTKRSESEYDSFGAGHSSTSISAALGMAVGRDLKGRKNNVIAVIGDGAMTAGQAYEAMNNAGYLDSDMIVILNDNKQVSLPTANLDGPIPPVGALSSALSRLQSSRPLRELREVAKGVTKQIGGSMHKLAAKVDEYARGMISGSGSTLFEELGLYYIGPVDGHNMDDLVTILKEVKSTKTTGPVFIHVVTEKGRGYPYAERAADKYHGVAKFDPSTGKQFKSRSKTQSYTNYFAEALISEAEVDKDIVAIHAAMGGGTGLNYFLRRFPTRCFDVGIAEQHAVTFAAGLACEGLKPFCAIYSSFLQRAYDQVVHDVDLQKLPVRFAMDRAGLVGADGPTHCGSFDVTYMACLPNMVVMTPSDEAELFHMVATAAAIDDRPSCFRYPRGNGVGVPLPAGNKGVPLEVGKGRILIEGERVALLGYGAAVQGCLAAASLLEEHSLKVTVADARFCKPLDHALIRSLARSHELLITVEEGSIGGFGSHVAQFMALDGLLDGKLKWRPLVLPDRYIDHGSPADQLAEAGLTPSHVAATVFNMLGQAREALEIMS

SEQ ID NO: 4742 - protein, 355 aa, Ustilago maydis 521
MPQYPSAAPGQKTFKLNTGAEIPVIGLGTWQSAPGEVAKAVESAIKAGYRHIVSMLTSLLTLTLGYVALHPLYIPFLAKDAAWIYGNENEVGQGIKASGVPRSELFVTTKIWCTYHRQPEACLDESLQRLGLDYVDLLLVHWPVPLVKRGDEKIPLNEDGSRAIDRDWSPEQTWELMEKLPATGKTKAIGVSNWSIAFLDKLLAKAKIVPAANQVELHPFLPQHELVKYCHDKGILPQAYSPLGSSGGPVLQDERVQSIAKAHKADPAQVVISWAAQRGVVALPKSVTPSRIETNGKLIVLSDEEMLELNELHKQEGKAVRLVKPNSDICSPPSETCLAPLNVADEALSYLRNSD

SEQ ID NO: 4743 - protein, 478 aa, Mesorhizobium sp. BNC1
MKRSRKVKILATLGPASSDEEIIVRLHEAGADAFRINMSHTDHPTMRELVARIRSVETQVSRPIGILADLQGPKLRVGTFADKSATLSIGQEFTLDDNPAPGDATRVHLPHPEILQAVQPGHRLLIDDGRLQLAALKTDGRSIVARVIAGNKISDRKGVSLPDTELPLGALTEKDRRDLDAVLQTGVDWIALSFIQRPQDLAEVRKIARGRAALMAKIEKPQAVKRLPEIIELSDGLMVARGDLGVEMPLEAVPGIQKQITRACRRAGKPVVVATQMLESMITAPVPTRAEVSDVATAVFEGADAVMLSAESAAGQYPVEAVAMMNAIAIQVERDPVFNDVINAQRTEPEATGADAISLASREIAETLKLAAIITYTASGTTGLRAARERPKVPIIALSPVVETTRRLSLVWGTHCVVSEDATDLDDMVDRACRIAYEEQFAKPGDRVIITAGVPLRTPGVTNMLRIAYIGSDGLSGL

SEQ ID NO: 4744 - protein, 342 aa, Zea mays
  misc_feature (99)..(99): Xaa can be any naturally occurring amino acid
  misc_feature (109)..(109): Xaa can be any naturally occurring amino acid
  misc_feature (122)..(122): Xaa can be any naturally occurring amino acid
  misc_feature (127)..(127): Xaa can be any naturally occurring amino acid
  misc_feature (133)..(134): Xaa can be any naturally occurring amino acid
MPLGDGAEAADFVLPDELLAALPRDPYEQLDLARRITALAVSGRVSGLEREAGRLRAEAAGKDRENAELRERVVLLDTALQETNARLRAALEDNIKLSXERDSLAQTSXKLARDLQKLESFXRHLMXSLRDDXXSPQETVDITTCDQSVATKASSSGDGGSGSHPTTNIFSESLDAGSTNRDGTASRPPIQKYAPSSHITPWLTPKATPKIMSTSASPRQISTTATPKLMSGATSPTKSRMEAHMSMTPWYPSSKQSSAASSPPRGGSNPGRTPRVDGKEFFRQARSRLSYEQFGAFLANIKELNAHKQSREETLKKAEEIFGPENKDLYLSFRGLLNRSMP

SEQ ID NO: 4745 - protein, 220 aa, Oryza sativa Indica Group
MLRACGGASPAAAAAAAVPALVRARLAKQASSAAHAAATATASASSSLSALGEVAAGRKADFQKHICFVETNCMRSEVLCRDVPNHCSIELIGRDPTCALNMERLLEARILSAVDLRRSLGLPSVHTNAYRLINSEGDRLSGLIVDIFADVAVVASSAAWVEKYRHEIQFLVNKVSDVNHIKWRSSTDILKEEGLDVSEQKDPESSSHCGTVEVNQLSNC

SEQ ID NO: 4746 - protein, 267 aa, Acinetobacter sp. ADP1
MPVFHFKDTLTAQDVALNYATFGQADRPALIFSNSLGTNLSMWQQQIAYFQDKYFVICYDTRGHGASSTPVGPYRIDQLGTDVIALLDHLQIPQATFCGISMGGLTGQWLAIHFPERFNQVIVANTAAKIGEAQAWQARAQLVREQGLTPIAQTAATRWFTPGFIEDSPEIVEKLSHDLAQGSAEGYASCCEALAEADVRPQLQRISIPVLVIAGAQDPVTTVADGQFLCEHIVHSTLEVLEASHISNVEQPQAFNHAVEAVMKRFN

SEQ ID NO: 4747 - protein, 447 aa, Acinetobacter sp. ADP1
MVTRSTIMDTNSFRAEHAAALDAETRKLTDKRSQVLGESYRLFYRNPVHLVKGQGQYLWDAAGHKYLDVYNNVASIGHCHPAVIEAVNEQMKMLNTHTRYLHENILNYTEELLKTTPSEIDRAMYMCTGSEANDLAIRIAREYSGGTGIIVSQEAYHGTSELTSGCSPALGSGQALAATTRLVPAPDAYRIAADDLGDWFAAQIQQQIDDMNANGIKFAGFLADSIFSSDGVMPNPVGFLKKAVDVIHANGGIFIADEVQPGFARTGDSFWGFGRHGVVPDIITTGKPMGNGIPVSGLLAKSDVLAAFSDNIPYFNTFGGNPVSMAAAQAVLKVIHDEDLQAHSKYVGAKLQAELSKLMDIHECVGDVRGAGLFIGFELVKDRDSKSPDKALALNLIEELRNTHRVLTSVAGPYGNVLKLRPPLAFQEHDIDWLVSALDQSIRKLKD

SEQ ID NO: 4748 - protein, 247 aa, Nicotiana tabacum
MAKIAVGSSREAIQPDCIQALIVEFICTFLFVFAGVGSAMAANKLNGDPLVSLFFVAMAHALVVAVTISAGFRISGGHLNPAVTLGLCMGGHITVFRSILYWIDQLLASVAACALLNYLTAGLETPVHTLANGVSYGQGIIMEVILTFSLLFTVYTTIVDPKKGILEGMGPLLTGLVVGANIMAGGPFSGASMNPARSFGPAFVSGIWTDHWVYWVGPLIGGGLAGFICENFFIVRTHVPLPSDESF

SEQ ID NO: 4749 - protein, 269 aa, Zea mays
MAAPMSAIDSAWQLLIANFTEFQLATVVTFLLHETVFFLSGLPSLLFERFGLFAKYKIQKKSNTSAYQNRCVLRLILYHVCVNLPVMIFSYPAFVEIMGLRSSLPLPHWSVVVSQVLFYFVLEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKDYRKAKTIEEKEGKNL

SEQ ID NO: 4750 - protein, 496 aa, Ralstonia metallidurans CH34
MQDQSDQTRALWVDGVSVFTPARTFDSVNPATGEVNWQVAFATAEHVAAAVASAKRAVNDPAWRKMLPHVRAGILMRIADAMTARADEFARLQMLENGKVWSECRAQALSAASTFRFYASACETLGSEVTPSRGNYLSMTAYEPYGVVAAITPWNSPLTMEAQKVAPALAAGNAVILKPSEVTPSGALLLAQVAFEAGLPKGLLNVVTGDGRETGTALVEHPDVRMVSFTGGTATGRSIAGIAAQRLIPVALELGGKSPHIIFEDANIDAAINGVVDGIFEGSGQSCVAGSRLFVQRSIYDKAVGLLVERARALRVGLPDVAGSQLGPLAGFAHRDRVERFVSIAREEGGQILAGGRRPPEAALQAGAFFEPTVIGGLSNSATAVQQEIFGPVLCVLPFGDEDDLIAQANDSAFGLASGIWTANYQRAWRVARALETGLVWINTYKQLSIATPFGGFKDSGIGREKGVNGVRLYQQSKGIYWSMDEKNFPSDGALA

SEQ ID NO: 4751 - protein, 225 aa, Gluconobacter oxydans 621H
MTDRPSIIVAPSLLAADFSRLGEEIASIARAPWLHLDVMDGHFVPNISFGPPLIAALRRHTDAKFDVHLMIDPVDPYLEATAKAGADHITVHVENAPHLHRSLQTIRALGCRPGVAICPATPAVALSEVMDLVDIILVMTVNPGFGGQSFLDSQLSKIRTLAEMIRESGRDIILAVDGGIDPSTAPRVVEAGATMLVAGSAIFGKEDRDAAIRALEGPFVEQITG

SEQ ID NO: 4752 - protein, 131 aa, Picea sitchensis
MAGRGKSAEGKKSVSRSSKAGLQFPVGRIARFLKVGKYAERVGGGAPVYLAAVLEYLAAEVLELAGNAARDNKKTRIVPRHIQLAVRNDEELSKLLGAVTIANGGVLPNIHNILLPKKGGASTKGAAAEES

SEQ ID NO: 4753 - protein, 462 aa, Zea mays
MDAVWFTVSFLAIAAIATKIIAKRRATTSAPRSTIPAPPVVEGRSLTTFLVGPDVLNHFYNGPESDINHGNMLDFMVPMFGKEVGYGVDFATRYEQIRFYSDPLKRPSKLRIHVDPIVQEVEGYFAKWGEEGTVDLKHEFSQLLMLISSRCLLGKEVREKMFDEMHALFHELKSGMRLSSVLFPYAPTPTNRRRDRARAKLLKIFSEVVRSRRRRGEEEKEKEEDVLQSLIDSRYKDGRATTEEEVTGMIILLVFGGMDTSTLASTWTGARLLSTPAAMAAAVEEQRRILTDHGHGDRVGYSEFMQMTTLHWSIKEALRMHPPSAVFFRKARRSFGVRTRDGREYEVPGGHTVASPVLFNSHLPSVYKDPDVYDPTRFGPGREEDRAGGKFTYEAFSCGRHSCVGEAYAYLQIKVMLSHLLRNFQLELVSPFPQTDWGKLVPEPKGKVMVRYKRQRLLSVPS

SEQ ID NO: 4754 - protein, 449 aa, Escherichia coli O157:H7 EDL933
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDVAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 4755 - protein, 517 aa, Coccidioides immitis RS
MVHLAAVRKNSEVLPLRMVKRVDTIPLEEPQEHDFFSSVYGSRFAAEDLPTHEMPEKEMPREVAYRMIKDELSLDGNPMLNLASFVTTYMEEEAERLMAESFSKNFIDYEEYPQSAEIQNRCVNMIARLFNAPASDESDHAMGTSCVGSSEAIMLGTLAMKKRWQNKRKAEGKDYSRPNIIMSSAVQVCWEKAARYFDVEEKFVYCTSERYVIDPEEAISMVDENTIGICAILGTTYTGQYEDIKALNDIMIEKGIDCPIHVDAASGGFVAPFVNPNLEWDFRLEKVVSINVSGHKYGLVYPGVGWVVWRSPEYLPKELVFNINYLGANQASFTLNFSKGASQVIGQYYQMIRLGKRGYRSIMVNLTRTADYLASALRQLGFIIMSDGKGHGLPLVAFRLNPDDENVMYDEFALAHQLRERGWVVPAYTMAPHSEKLKLMRIVVREDFSKSRCDNLVNDIKLALQQLSDMDKRTLEKFQQHIRRHVTNSGSATHNHPQYQDEDHSLQGKTGKTHAIC

SEQ ID NO: 4756 - protein, 549 aa, Escherichia coli O157:H7 EDL933
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 4757 - protein, 166 aa, Photorhabdus luminescens subsp. laumondii TTO1
MAHIEKQAGELQEKLIAVNRVSKTVKGGRIFSFTALTVVGDGNGRVGFGYGKAREVPAAIQKAMEKARRNMKTVALNSGTLYHPVKGAHTGSRVFMQPAHEGTGIIAGGAMRAVLEVAGVRNVLAKTYGSTNPINVVRATLDALDSMKSPEMVAAKRGKSVEEILG

SEQ ID NO: 4758 - protein, 556 aa, Mycobacterium sp. MCS
MPEPGRIASTPMTSVTDPSAPSGAHEIDIHTTAGKLADLRKRTEEAQHPVGEAAVEKVHAKGKLTARERILALLDEDSFVELDALAKHRSTNFGLQANRPPGDGVVTGYGTIDGREVCIFSQDATVFGGSLGEVYGEKIVKVQELAIKTGRPLIGINDGAGARIQEGVVSLGLYSRIFHNNIKASGVIPQISLIMGAAAGGHVYSPALTDFVIMVDKTSQMFITGPDVIKTVTGEEVTMEELGGGHTHMAKSGLAHYVASGEQDAFDYVRDLLSYLPPNNYADPPRYPSPQPAGPIEETLTDEDLELDTLIPDSPNQPYDMHEVITRILDDDEFLEIQEGYASNIIVGFGRIDGRPVGIVANQPTQFAGCLDINASEKAARFVRTCDCFNIPIVMLVDVPGFLPGTEQEYNGIIRRGAKLLYAYGEATVAKITVITRKAYGGAYCVMGSKDMGCDVNVAWPTAQIAVMGASGAVGFVYRQQLKEAAKDGQDVDALRLELQQEYEDTLVNPYIAAERGYVDAVIPPSHTRGYIGTALRLLERKIAQTPPKKHGNIPL

SEQ ID NO: 4759 - protein, 306 aa, Zea mays
VLIWDVEAQPNRHAVLGASESRPDLILTGHKENAEFALAMCPAEPYVLSGGKDKSVVLWSIQDHISALGDSSSSPGASGSKQSIKTANEKESPKVDPRGIFHGHDSTVEDVQFCPSSAQEFCSVGDDACLILWDARTGTAPAVKVEKAHSGDVHCVDWNPLDVNYILTGYDGIKAQFSIIVETNSISISSLYVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEDEVLAELENFKAHLASCAPKN

SEQ ID NO: 4760 - protein, 517 aa, Gibberella moniliformis
MSVPTYMGVSGKSLAILQIAAIVAPSFVLFGYNQAGIGGLLSEEDWVKTFPEIDTVNSTGADKSSKSTLQGFVVATFVIGALIGSLSCSYTGDKFGRRNVIFAAAICSLIGEILEASSFGLAQFIVGRVIIGLGIGQLSSIVPVWQSETSAAVNRGRQVVLTGLFICLGYVLESWINLGFFEFHHGPVTWRPPIAIAIAFSLILIASIYFFPESPRWLVLKNRSEEARHAVAALRGLPIDSTEVLAEVAGIEHSLEETSDNAARLGDMLKMGEDKLLYRFILCILLQFYQQMSGSNLVSVYANVLFQKNLGMSAETAKILTGGALTWKFLASFIAFFTIDRFGRRAVFMISGAGMSACMIALAITTSFGSENKPAMIAAGCFIYLYNTFVPIGFLGANFLYCTEVAPIRLRMAMSSISTGNHWLWNFIVVMVTPVALESIGWQYYIVYAVIAACVPISVFLFFPETMGRNLEEIELIFKESPSVFSTVKFAKTRPRNTPQQFLASKEKADHLEQSED

SEQ ID NO: 4761 - protein, 204 aa, Zea mays
MAEQEPTAEQLAQIAAENEEDEHSVNYKPPAQKSIQEIQELDKDDESLRKYKEALLGRVAVSADPNVPNVIVTRLTLVCSTAPGPLELDLTGDLESFKKQSFVLKEGVEYRIKISFRVNREIVSGMKYIQHTYRKGVKIDKTDYMVGSYGPRAEEYEFLTPMEEAPKGMLARGSYNIKSRFTDDDKTDHLSWEWNLTIKKEWKD

SEQ ID NO: 4762 - protein, 203 aa, Chlamydia muridarum Nigg
MTLVPYVVEDTGRGERAMDIYSRLLKDRIVMIGQEITEPLANTVIAQLLFLMSEDPTKDIQIFINSPGGYITAGLAIYDTIRFLGCDVNTYCIGQAASMGALLLSAGTKGKRYALPHSRMMIHQPSGGIIGTSADIQLQAAEILTLKKHLSNILAECTGQPVEKIIEDSERDFFMGAEEAIAYGLIDKVVSSAKETKDKNIVS

SEQ ID NO: 4763 - protein, 645 aa, Xylella fastidiosa Temecula1
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFLTQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAVRMEREFRITFAPPTKQPHSLITLRQVNCGYSVLSPSTPSDPPPVDIHAAAPSQPAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEVNQPQASLTAKSPTSQLPVKKSVNSQKLLVAEKHVSELETLLTELDRKLADPVNYANGEVMRRLGDEREHAARRLAEAEQAWFLLMDGG

SEQ ID NO: 4764 - protein, 202 aa, Saccharomyces cerevisiae YJM789
MHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 4765 - protein, 282 aa, Picea mariana
MAKEGSKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSAEIIGTFVLVYTVFSATDPKRNARDSHVPVLAPLPIGFAVFMVHLATIPITGTGINPARSFGAAVIYGHQKIWDEHWIFWVGPFLGAAGAAAYHQYILRAGAIKALGSFRSNPHV

SEQ ID NO: 4766 - protein, 436 aa, Oryza sativa
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTMPPDQLSQNSGVQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKPSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIELEQVTVEHALELQYQVNGRRHCVLVGLYLSGLGLFARGGRFDQAIAGTTGGDPAEV

SEQ ID NO: 4767 - protein, 306 aa, Nostoc sp. PCC 7120
MAALLGRDLLSLADLTPTELQELLQLATQLKSQQLKLRCNKVLGLLFSKASTRTRVSFTVAMYQLGGQVIDLNPNVTQVSRGEPVQDTARVLERYLDVLAIRTFEQQELATFAEYAKIPVINALTDLEHPCQILADLLTVQECFDSISGLTLTYVGDGNNVANSLMLGCALAGMNVRIATPSGYEPNPQVVAQAQAIADGKTEILLTNDPDLATKGASVLYTDVWASMGQEAEADDRFPIFQPYQISEQLLSLAEPNAIVLHCLPAHRGEEITEEVIEGSQSRVWQQAENRLHVQKALLASILGAE

SEQ ID NO: 4768 - protein, 194 aa, Rhodopirellula baltica SH 1
MAIFFALTWRLTGIFMASPNQRHLLSALVQNVPGVLAHISGMLASRGYNIDSLAVGETEDPTLSRMTFVVVGDDQVLDQVRKQLEKIVTVVRVLDISSNDYVERDLLLVKVTAPAGGVRSEIRELVDIFRGQIVDVGEGEVMIEISGRANKVQAFIERIDRYGIVELVRTGRIAMVRSGSQVTSSEPAAETVQA

SEQ ID NO: 4769 - protein, 644 aa, Chlorobium tepidum TLS
MADLVSAPAMISQAYPLLSSIHSPADLKKLSLHELELVAAECRKKVIELVSQNGGHFGSSLGVVELTVALHYVYQSPTDRIIWDVGHQAYVHKILTGRLAQMETNRRYHGLAGFPKRSESPHDAFGTGHASTSISAAAGLAAARDLAGRKEKVVAIIGDGSLTGGMAFEAMNHLGDTKSDVLVILNDNQMAISPSTGGLKNYLVNLTLNKTYNRLRKFVWDSLSLLHNEIGETAKTAVHRIEDGIKAAFTPGAYFEALGFRYFGPIDGHNMEQLIKALREMRQLHHPKLLHVITTKGKGFKPAEENQPKWHASVGGFDIETGKNVKAPGKPAKPKYQEVFGEALVELALKDPTITAITAAMPSGTSLDLFQQAIPSRCFDVGIAEQHAVTFAAGLACGGFKPVFAVYSTFLQRAYDQLIHDVALQNLHVVFAIDRAGLVGEDGPTHHGAFDLSYLNVVPNLTIMAPGDEQELRNMLYTALYDIKGPVAIRYPRGSGSGATLHKEFTPVPVGRGRILRDGKSVALLGIGTMSNRALETAALLEAAGLDPLVCDMRFLKPLDTEIIDMAASRCTHIVTIEENSIIGGFGSNVVNYLHHAHPGIKCISFGLPDAFVTHGSMDELYREVGLDAESLSGKILEFYKDKP

SEQ ID NO: 4770 - protein, 271 aa, Zea mays
MSSLDSGSNGLTGYVTLMSLMEELISLEMKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 4771 - protein, 450 aa, Methanosarcina barkeri str. Fusaro
MEKDYDIIIIGTGTAGRTLADKVAHSGLKIAIIDSGEYGGISPPRGCDTKKMFTDLAGVTDSNNRLIEKGVGTNYPLKIDWPSLIEFKGKVTKECPGRIENHFVEMGIDTYHGKAYFENQNTIVAGEDKIKGEYIFLATGSKPRKLNISGEEYVTTSEEFMKTEKLPERIIFIGGGHISLEFAHVARRAMSEVTILHRSERLLRHSDVDMVNLLIKATEAAGIKILMNKPVASIEKDANGFLVRTGSKSGTESETQSFRADMVIHGAGRVPNIEELHLEKAGIKIEKGAIVVDKYMRTSNPRIYAGGDCTSESLKLNSVAALQGEVAAANILNENSLEVDYTGVPSAVHAIPVLASVGTSASKNSDKYKVIYQDRSNWYTTRKAGMEFAASKVIIDEANNRIVGAYILGPNAEEAINIFAAVIRLGLKASDIKKLVFTYPTTCSDIRYML

SEQ ID NO: 4772 - protein, 262 aa, Triticum aestivum
  misc_feature (220)..(220): Xaa can be any naturally occurring amino acid
AYLGDTLEQVCTKKQAGTGPEFPGYRRPTRPVYFGGISSDASSDDLKKLCELVGEVVEVRIMLSNKDSRGYAFVTFRTNDLALKAIEKLNKATFKGKKLRVSSSQAKNKLFVGNIPHSWSFDDFKKAVEEVGPGVLKVDLIKDPRTDRNRGYGFVEYYNNACAEYSRQKMTAPNFKLDTNAPTVSWADPKNGDSASTGSTSQVKSVYVKNLPKNVTQGTXLKSCFERHGEIIKIVPPPSKDGHDNRYGLVPFKDRQHGPERL

SEQ ID NO: 4773 - protein, 413 aa, Methanosarcina barkeri str. Fusaro
MSQKITGKDYLTMSDVVLDNKRVLVRVDFNSPMDDNGNILDDKKIKSHLPTLQSLEHSKVVLMSHQGRPGDEDYTTLEAHAKLATELLGREVTYEDDIFSSCARNAIKSLAQGEILLLENTRFNAEEITNRPPEKQAKSQMVKKLYPLFDLFINDAFSVSHRSQCSVVGFTEVLPSVAGILMDKEITGLDKALKCREHPAIFILGGAKANDSIKAISNILKRAGADKILTTGVVATIFMMAMGVDVSEVNRKFIEDKKYMDQISIASKLLKDYSGKIIVPQDVALNSGGERQEVEVDKIKKGNLPIADIGRETIENYSKYLKEAKLCVFHGPTGIFELDNFRLGTDELLKAAAQASYSVAGGGHTLDAIDQLGLGSKFSHISMGGGASITYISGEPLPGITALKKNAFRYHQG

SEQ ID NO: 4774 - protein, 591 aa, Synechococcus sp. RS9916
MRPRFPILNALALVLTLGGTAPATAAPISRDDPETADLGRKRSVTASGRAVVVTANPLATEAGIAALQAGGSAIDALVSAQAVLAVVEPQSSGLGGGGFLLYWDANAKTLAVLDGREVAPQRSQHSDLLSTSGAPLPWRDATSTPQAIGIPGTVALLWDAHQRHGQLPWAQTLAPAIRTATDGFKPSPRFLRSLHLAKRFGVAHSPAFQALYLPSGQPPPADQPFRNPALARTLSTLAREGGPAFYAGPLAQQILGGVNALKTTTPNFRGWSASDLSSYAVVRRAPLCSQQLGHRICTMPPPSSGGIGLLQTLALLNQSTPLAESAPDDPTVWRQLGKAQAWADADRLYWVHDPVGGSVPAAALLDPAYIKERAAHLQGAGDATPEPGLPPGVSRYPFGRPAPSKEEGTTQITIVDASGNIAAYTASVETIFGSRHLVAGMVLNNQLTDFAFVPTLQGLPVANRRLPGRRPMSSMAPTLVFRGGHPVLALGSPGGRTIPHLLSRVLLASLIWNEPAERAVGLPHLSNRRGTLVLESTPPLAWPFVVEQLNSNDQPIRLQAIGSGTALVQRSNGQWQGAADPRREGTALALP

SEQ ID NO: 4775 - protein, 151 aa, Prochlorococcus marinus
MSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 4776 - protein, 334 aa, Chlamydia muridarum Nigg
MKETIAYLGMGMWGFSLANLLANNGHRVVGWARNPSLIEQLSTQRQHPAAPHVTIPSNLSFTSSMEEALDGATMIVEGVTSAGMRPVLNQLKSITDLQIPLVITSKGIEQNTGLLLSEIALEIFGKPAAKYLGYLSGPSIASEVLRGCPCSVVISAYDPATLKQIHQAFLTPTFRVYPNSDLKGVALGGALKNVIAIACGISDGFRFGDNAKSGLVTRGLHEIRKFATIMGCRPDTLNGLAGLGDLCTTCFSAFSRNTLFGKMLAEGLTPEQAKTKIGMVVEGVYTALSAHQIATHHKIDMPITTGVYRVLYENLDIQKGIAQLLQRNTKEEYL

SEQ ID NO: 4777 - protein, 339 aa, Achlya bisexualis
MAPVAIGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLQGGCKKVVISAPPKDSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLDTIKAAVKEASEGSMAGILGYTEDEVVSQDFVSDKRSSIFDANACIALNDNFVKLVSWYDNEWGYSNRLVDLVVHMATIDN

SEQ ID NO: 4778 - protein, 596 aa, Achlya bisexualis
MQVRRFSSVARKFFVGGNWKCNGSLSQAQSLVDTLNTATIPKNVEVVVAPASIHALSVKSSLRKDIGVSGQDTWSRGNGAFTGEVSAEMLKDAGINYTIIGHSERRQKGETNEEVASKAGYALSKGVSVIACIGETKIEREAQKTMQVVTEQLAAYAKNITDWSNVVIAYEPVWAIGTGLTATPEQAQEVHAGIRSWLKQNVSSAVADATRIIYGGSVTAGNAAELSKKADIDGFLVGGASLKPDFLSIINCQNDKAHQGGPVNIAINGFGRIGRLVLRAAQTNPLLNVVAVNDPFIPTEYMEYMLKHDTVHGHFDGTVRHEGDHIIVNDRKIRVFGEKDPKAIKWGESDVEYVVESTGAFTTKEKASAHLLNGPRKVVISAPSADAPMFVVGVNHDKYDPSMNIVSNASCTTNCLAPLAKVVNDKFGIIEGLMTTVHAVTATQLTVDGPSKKDWRGGRAACFNIIPSSTGAAKAVGKVIPELNGKLTGMSFRVPTANVSVVDLTVRLRNKASYEDIKAAIKYASENELRGILGYTDTAVVSSDFISDPRSSIFDADAGIVLTDDFVKLVSWYDNEWGYSNRVLDLITHMVHTERQ

SEQ ID NO: 4779 - protein, 434 aa, Chlamydia muridarum Nigg
MIHLQQETLLIHQWRPYRECGILSRISGDLLEAQGLSACLGELCQISLPRSSPILAEVIGIHNQTTLLLALTPIYSLSLGAEVVPLRRPASLPLSHHLLGRVIDGFGNPLDGNPPLPKSHLSPLFSPPPSPMSRTPIQEIFPTGIRAIDALLTIGEGQRVGIFSEPGGGKSSLLSTIAKGSQQTINVIALIGERGREVRDYVNQHKEGLAAQRTIIVVSTAHETAASKVIAGRAAITIAEYFRDQGARVLFIMDSLSRWIESLQEVALARGETLSTHHYAASVFHHVSEFLERAGNNDKGSITSFYAMLHYANHPDIFNDYVKSLLDGHFFLSPVEKSFFSPPINLLTSLSRSACQLALPHHYAAAQELLSLLKAYHEAIDIIQLGAYVSGQDAKLDRAIRLLPSLREFLSQPLSNYSDIHDTIEQLCLLLKHE

SEQ ID NO: 4780 - protein, 429 aa, Triticum aestivum
MAGAVSALFLLDIKGRVLVWRDYRGDVTALQAERFFTKLLDKEGDAEVHSPVVHDGAGVSYTCTRHNNVFLLTAARQNCNAASILLFLHRLVDVFKHYFEELEEESLRDNFVVVYELLDEMMDFGYPQYTEATILSEFIKTDAYRMEVTQRPPMAVTNAVSWRSEGIRYKKNEVFLDVVESVNILVNSNGQIVRSDIIGALKMRTFLSGMPECKLGLNDRVLLEAQGRATKGKAIDLDDIKFHQCVRLTRFENDRTISFVPPDGAFDLMTYRLTTQVKPLIWVEAQVEKHSRSRIEIMVKARSQFKERSTGTNVEIEVPVPYDATNPNIRTSMGSAAYAPERDAMVWKIKSFPGGKEYMCRAEFSLPSITSEEATPEKKAPIRVKFEIPYFTVSGIQVRYLKVIEKSGYQALPWVRYITMAGEYELRLI

SEQ ID NO: 4781 - protein, 257 aa, Vibrio sp. Ex25
MLTDKQFLRYQRQVALPEIAEIGQERLSKSHVLIIGCGGLGSAASLYLASAGVGKLVVVDDDEVDSSNLQRQIIYREQDLQVAKTKATVKQLTELNSMVQIRALNKRLDKAQLQLEVMLADVVLDCTDNMPTRQLINQVCFEQNTPLISAAAIGWQGQFAVFDYQTPNEQEAQSKACYRCLYPFDELPQTQKCSDSGVVGPVVGTLGNYQAIAAIQKLATGAFHVETAKLHLFDGLKMQWQIMAISKDKQCQVCAQV

SEQ ID NO: 4782 - protein, 334 aa, Neorickettsia sennetsu str. Miyayama
MVLMDSVVIGGGAWGTAIANLLAFNTQRVTIFCRNTTVIDSINKRHINTKYLPTFPLNKNISATSRMDVLKNAELIFVAVPSQSMRELLQKVKENIKESVQIILCNKGIERESLLLMSEVVHEELPKNDIFVLSGPNFAHEVLSKKPSFSNLAGRNKTSYDKIANALSTETFFTKYITDINGTQILGAFKNVIAIICGLLVRMDAGSNTLSALMSLALEEARSFITIKNGNPDTIMEFCGIGDLVLTCFSNKSRNFRYGYRLVDGYSENALVEGKSTLESLHELARIHNINCVLTNTLYTVTQFNSYGTSSFEQDIKRELNSAFMSLLGCAKNP

SEQ ID NO: 4783 - protein, 349 aa, Streptomyces lavendulae
MTVEQTPENPGTAARAAAEETVNDILQGAWKARAIHVAVELGVPELLQEGPRTATALAEATGAHEQTLRRLLRLLATVGVFDDLGHDDLFAQNALSAVLLPDPASPVATDARFQAAPWHWRAWEQLTHSVRTGEASFDVANGTSFWQLTHEDPKARELFNRAMGSVSLTEAGQVAAAYDFSGAATAVDIGGGRGSLMAAVLDAFPGLRGTLLERPPVAEEARELLTGRGLADRCEILPGDFFETIPDGADVYLIKHVLHDWDDDDVVRILRRIATAMKPDSRLLVIDNLIDERPAASTLFVDLLLLVLVGGAERSESEFAALLEKSGLRVERSLPCGAGPVRIVEIRRA

SEQ ID NO: 4784 - protein, 353 aa, Oryza sativa Japonica Group
MASSSSAASGKSRPECINSSNPFHECSDYCLRKIAEAKERIEDEQRPPVDRTVHPDCINASNPYHVCSEYCFKRIADAKSGLERAEQEPPSADAGKSDAAQAEGGGGDDDAEQEDAGSDDGYPQMTEKQKKLFELRLKMSWVFISLLFLVLQNEARKANQQAMVAEKKRMEPRAESRGVSKQKWLEDRKKKIGKLLDSNGLDMTKSYMLDTQESAEAKYKKWEKEPAPYGWDVFNQKTLYDAYKKRTKNIEVDMEAYNKAKEADPEFYRDASSLQYGKVSKVPEENIDRMVNELKERDEKRKAFSRRRKFHEDKDIDSINDRNEHFNKKVERAFGKYTLEIKNNLERGTALPD

SEQ ID NO: 4785 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 4786 - protein, 289 aa, Physcomitrella patens subsp. patens
MQQDKDDDVALGANKYGTRSALGTHAPVPEKDYREPSVTPFFDGGELRLWSFWRAGIAEFFATLLFLYITIQTVMGHVRNTDPCLGVGIQGIAWAFGGMIFALVYCTAGISGGHINPAVTFGLFLARKVSLNRALYYMIMQCLGAMAGAGIVKGFQPDFYQAQGGGANAVNHGYTKGDGLGAEIVGTFVLVYTVFSATDAKRSARDSHVPVLAPLPIGFAVFLVHLATIPITGTGINPARSLGAATIYNTQHNAWADHWIFWVGPFIGAALAAAYHTLVIRALPFRKRV

SEQ ID NO: 4787 - protein, 716 aa, Streptomyces avermitilis MA-4680
MRGAPSPSPAVTVRGGPVSDDEPPDNLRHLPRIGSPPPPPVPPAPTLGGTDEDSVTDPGPVRISAFDAPEVPHAPPPTAGAALRSEGLNEGEQPPDAGAPRAGALSLAAILAIALAAFEGLQTWIQESGPRRAEAAAHQREMELLAAKAGADATRHGAEADAARAKAHRGGGVQSSRDYGRSALGRGSGGPARGGGVGPGGSRGGGRGLFNGSPQGSSGRFGQGRSGAGLFGVGSRNGAHRGRSDGTAGRGSGGGRAGAGLFGGGGRGPGAGGGRGNANGKGSGKGQGSPGPGGTSGGTGGSKGGGGAGRRSPRQAVADWWGKGKHPRPAGAGGGSQQKGAAHDRAAAIQNALKKTRSGKGGGATAPTFWEAAGDRLQDRWKNRQARNPASTDAAGKTGNGGAAGTKGGNDGWSPNGRVTFRSAVFEAVNERWAKRRDRWKAQAGPRTGRRRSPNANGPTSPPSPPGSGNGGGPSGTSGPGAGKGPGPRYAGPRSSPFDTSSGPEITITVEQVDPPGTHARRWEPDAIAPPRRQLPAQGPPALSRAPQRPAGTRPGTTRRKDPIPMPPSASSSAPVIQVTPPPANAMVGRHATEISLDGAVKALTLLTTAGMETYDDCQNLARQARRLFAELEVMANDLANNHNITGARTVRAMGVLMESVGMLAVNANRMAKAALNAAELAEAEETAMERDYRPTQTAALDAGLAAPSARIHNEN

SEQ ID NO: 4788 - protein, 259 aa, Brassica napus
MTRSVNFPLLGLAAALLLSPLLAVSGKLADDLKPNRQEVYGGGKIFDISHRYTPEMPAWESKEGLSNHLRLIASMKNGSFANVSEMKLSVHSGTHVDAPGHFIDEYYDAGFDCDSLDLQTLNGPALLVDVPRDKNITAEVMESLHIPRGVRRVLFRTSNTDKRLMFKKEFDSSFSGFMTDGAKWLVENTDIKLVGLDYLSFAAFDESPATHKVILRGRDIIPVEALKLDGVEAGMYSLHCLPLRLVGAEGAPTRCILIK

SEQ ID NO: 4789 - protein, 296 aa, Physcomitrella patens subsp. patens
MATVSEKEWTGFQGLPAATQIILHTLLAKLRKQKVDKITIVLLGKGGVGKSSIVNSLFSERVAAVSAFRSETLRPRQYSRSKDGFKLTVIDTPGFVEAGRVDAALNSIRRYLLGKTINVVLYVDRLDGPREDKVDVKISRAISQAFGPQIWPHVIVVFTHAEIHLEDVTYSEFVSRRSAALRNIILKESRFKTVNTKVPFVLVENCSRCSENGEHEKILPDGTVWLPVLFEALVDLVLGSKKPILIDEKMIGISKGNPLGSIWMPLVLLAQFVLIWRPIRKAIDRDLVEEAQRHSP

SEQ ID NO: 4790 - protein, 324 aa, Brucella suis 1330
MINAIRVHRTGGPDVLHYEQVEIGEPGPGEARVRHEAVGLNFIDVYFRTGLYKAAKMPFTPGNEGAGIVVAVGAGVENVRVGERVAYAATPGSYADERILPADRLVKVPDTIDLKTAASMMLKGMTAQYLLRRTFRVEPGQTILFHAAAGGVGLIAGQWAKHLGATVIGTAGSEEKIALARKHGYDHVINYRSENFVERVRELTNGEGVDVVYDSVGRDTYMGSLDVLKPLGMFACFGQSSGVIPPFDLGILAQKGSLFATRPTLFNYIARRADLEKTTAELFDVVESGAVKIEINQTYALKDACKAHEALEARKTTGTSILLP

SEQ ID NO: 4791 - protein, 136 aa, Corynebacterium efficiens
MTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 4792 - protein, 226 aa, Chlamydia muridarum Nigg
MTLLILLRHGQSVWNQKNLFTGWVDIPLSQQGIQEALTAGEAIKNLPIDCIFTSTLVRSLMTALLAMTNHSSKKIPYIIHEERPDMSRIHSEKELEQMIPLFQSSALNERMYGELQGKNKQEVAEQFGEEQVRLWRRSYKIAPPQGESLFDTAQRTLPYFQKRIFPLIQQGKNIFISAHGNSLRSLIMDLEKLTEEEVLSLELPTGKPIVYEWTEQKFTKSALSFG

SEQ ID NO: 4793 - protein, 359 aa, Zea mays
IAGKRLASTIGAAPARRSVLSRRLGRPVSASPGGCFREMPKYSKFTQQELPACKPILTPKWVVSVFFIVGVIFVPIGVVSLLAARDVVEIIDRYDEACVPGNMTENKLAYIQNETLSKECIRNLTVTKDMKQPIFVYYELGNFYQNHRRYVKSRNDAQLRDASKANQTSACEPEKTTANGQPIVPCGLIAWSLFNDTYNFTRGNENLTVDKKDISWKSDREHKFGKDVYPSNFQNGALKGGATLDPKIPLSEQEDLIVWMRTAALPTFRKLYGRIYIDLKENDTITVRLNNNYNTYSFGGKKKLVLSTATWLGGKNDFLGFAYLIVGGLCIFLAFAFTLLYFVKPRKLGDHNYLSWNRR

SEQ ID NO: 4794 - protein, 169 aa, Picea mariana
ELHRQFLALGVGVIEDVRVQRDKGFGFVRYRSHEEAALAIQLANGRVICGKSIKCSWGSKPTPPGASSNALPPPSAPFQGVVAPQGLNQGYTAADILAYRQLNMSQAGAGQPLLPLSAQQGMGLGLGHGPMGVVGPNQNVYDNFQAGAGLPAAAAAAAAAMRQQIMYYQ

SEQ ID NO: 4795 - protein, 452 aa, Lentisphaera araneosa HTCC2155
MSSKNKMNKEEAVLEVLSVIIDPDLGKDIVSLGFIKDLKISDSGEVDFSIELTTPACPVKEEFRSRATALVESLSWVTEVNITMTAQPQKEINANRAKGVAKVQNIIAVTSCKGGVGKSTTAVNLAYSLKRTGAKVGILDADIYGPSLPVMVSPQDTDIYQGGGMLLPLEYEGVKLMSFGFLNTDQEAAIMRGPMVSQVIGQIGGGCDWEELDYLIVDFPPGTGDIQLTLLQSLPFTAAVIVTTPQNLSFIDVIKGIKMFDQLQVPSVAVVENMSYFTCGNCDEKHRPYGQGALKKLVDMYGFRHAFELPIDVELSNAGDTGIPPVLAEPNGQLARYYSDIAASVAREISRIKFMAKDKPTVEFIEERGVVLTQGEKELVFEPRELRLSCHCAACRHEFTGEKILDEKSVPANVKPESIRPMGNYAVSVIWSDGHSSSVYAYDKLFEMKDEV

SEQ ID NO: 4796 - protein, 521 aa, Phlebia radiata
MRFTALAATLLSSLLSEVYATNSGIGPVTDLRISNAVVSPDGFSRDAVVVQGQFPSPLIKGNKGDMFKLNVINQLQDTALNTSTSIHWHGLFQHGTNWADGPAFVTQCPIVTGDSFVYDFTVPDQAGTFWYHSHLALQYCDGLRGPLVVYDPHDPYAHLYDVDDESTVITLAEWYHTAADNLRPPEEANSTLINGLGRYAGGPASPLSVITVEHGKRYRFRLVSMACDPSYNFTIDGHNMTVIEVDGVNHLPLTVDKIQIFVAQRYSFILDANQPIGNYWIHAIPNGQSQLVGVANGINSAILRYVGAPNKEPTTQTPPSVAPLQEVNLHPLVNAAAPGKPFPGGADQVIPFNLSLLGANFLINNATFSPPTVPVLLQILSGAKTPQQLLPPGSIYSLKRNSVIEIVIPPGTAPGGPHPFHLHGHTFSVVRSAGSSVYNFKNPVQRDVVSIGTGANDSVTIRFVTDNPGPWFIHCHIDFHLNAGLAAVMAEDIPDIKLANPVPAEWEQLCPIYDQKVLHEH

SEQ ID NO: 4797 - protein, 159 aa, Bacillus clausii KSM-K16
MNITILSVGKLKEKYIKQGIDEYKKRLSAYAKIQEIEVPDEKAPEHLSTEDMRLVKKKEGERLLAKISADSYVIALAIEGNMKTSEQLAKNIEQLGTYGKSKIAFIIGGSLGLSNDVYARADELLSFSKMTFPHQLMKLVLFEQLYRSFRIMRGEPYHK

SEQ ID NO: 4798 - protein, 424 aa, Chlamydia muridarum Nigg
MVTCEAGIASVQQAIKDIADGNFVIVIDRESRENEGDLILAGEKVSAEKMAFLLSHTTGIVCASVTREQARVLDLPAMVQENQCAFKTAFTVSVDASSGITTGVSAADRTRTVQLLSDPTSISQSFVRPGHVFPLVSQPGGVVKRPGHTEASMDLMRLAGMYPCGIFAELVNADHSMMRQQQILDFAEQHGFTVITVDDLITYRWTFDSLVEHVSSARIPTKYGEFFIHVYKSIIDGTEHFALVKGDIREQESVPVRVHSECLTGDVLGSCRCDCGAQLDMAMRYIAEQGLGVIVYLRGQEGRGIGFGHKIQAYALQDLGYDTVEANLQLSFPIDAREYGVAAQILKDLRLTSVRLITHNPKKFFELQRLGIHILDRIVLPVIVSSENERYLRTKKDRMGHWLNFPVLNESEDEYETVERTSCC

SEQ ID NO: 4799 - protein, 269 aa, Picea mariana
SGVPPFWAETQQGIFDAVLRGYIDFDSEPWPSISESAKDLIRKMLTSNPAERLTAHGVLCHPWICKDGVAPDQALDPAVLSRLKQFSAMNKLKKMALMVIAESLSEEEIAGLREMFEAMDTDNSGSITFDELTAGLKRYGSNMKESEIRALMDAADVDNSGTIDYAEFIAATFHLNKLEREEHLFAAFSYFDKDASGYITVDELQQACLEHNLTDVRIDEIIREVDQNNDGRIDYNEFVAMMRKGNGAIGRRTMRNSLNFSRKDNLPIG

SEQ ID NO: 4800 - protein, 356 aa, Neisseria gonorrhoeae FA 1090
MTKHIAILRGDGIGPEIVAETVRVLDKFIAQGLDADYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEHEGYNTMKYSESEIRRIAHVAFQSAQKRSKKVCSVGKANVLETTELWREIFEEIGKQYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENSVQKVLQQGLRTGDIYEEGTKLVSCSEMGDAVLAAL

SEQ ID NO: 4801 - protein, 588 aa, Vibrio sp. Ex25
MQWTFNRLVLSGLFLTSPFTFTGQAFANQAADSVAPEHSTGIEQKQLVKAKDYMVTAANPLATQAGADVLEQGGNAIDAMVAVQLMLGLVEPQSSGVGGGAFLVYWDSEKQKLTTYDGRETAPLAVTPKLFLDENGQPLQFYDAVVGGRSVATPGTVKLLWDTHQKYGKLEWKKIIQPVISLAEQGFKVSPRLASLIEKDAERLSRFPVTKAYFFNSDGSPKTEGTLLKNPEYAQTLSAIAKQGAQAFYHGDIARDIIKTVQNAPGNPGVLAQPDFDTYQIRQREPVCAAYQSYDICGMGPPSSGALTIGQILAITEQYDLKGWGANSIKSWQVLADASRLAFADRGKYMADQDYVPMPTQGLLDESYLQQRAELIQVGKALSKVEAGNPPWSHAMKLSMDESIELPSTSHFNIVDKQGNVVSMTTTIENAFGSRLMVRGFLLNNELTDFSFRTHNDGIPIANRIEPGKRPRSSMAPTIMMKDNKPYMAIGSPGGSRIIGYVAQTIIAHTQWDMNIQQAINQPRLLDRFGTLDIEQGTAAEGLQPELEKMGFKTNVRDLNSGLHAIRITKDGLEGAADPRREGAAIGK

SEQ ID NO: 4802 - protein, 386 aa, Triticum aestivum
  misc_feature (196)..(196): Xaa can be any naturally occurring amino acid
RKATGHEDGSALLGSREFSYKELKHITNNFSQEIGKGGFGPVFLGYLENGNPVAVKVRSESSSQGGKEFLAEAQHLTRIHHKNLVSLVGYCKDRNHLALVYEYMPEGSLQDHLRATSTSKPLTWKQRLQIALDAAHGLEYLHIACKPALIHRDVKSRNILLTTDLGAKIADFGLTKAFSDSETHITTEPAGTIGYXLDPEYFRSYHISEKSDLYSFGVVLLELITGHAPVIPISDSMSIHIGEWVHESLDQGNIESIVDAKMGGDYDINSVWKAADLALHCKQDVSRERPTMAEVVAQLKECLELENRCSERRGNLSSNDDNLTCPGEGSALEVEEEETQRATGWRDTSGCWPCNEMIVLMTLTINAGGWSHLLYLSDKPSSCLSL

SEQ ID NO: 4803 - protein, 536 aa, Solanum lycopersicum
MASVLASLFPKLGSLGTSDHASVASINLFVALLCACIIIGHLLEENRWVNESITALIIGLGTGVVILLVSGGKSSHLLVFSEDLFFIYLLPPIIFNAGFQVKKKQSFVNFMTIMLFGAIGTLVSCAIISLGAIQTFKKLDIEFLDIGDYLAIGAIFAATDSVCTLQVLHQDETPLLYSLVFGEGVVNDATSVVLFNAIQNVDLTSLNPSIALSFLGNFFYLFLASTLLGAGTGLLSAYIIKKLYFGRHSTDREVALMMLMAYLSYMLAELFYLSGILTVFFCGIVMSHYTWHNVTESSRVTTRHTFATLSFLAETFLFLYVGMDALDTEKWKFVGDRPGLSISASSILMGLILSGESCFCFSIIILIQLNEEILGRKNTFRQQVIIWWAGLMRGAVSMALAYNKFTHGGHTQLQDNAIMITSTITIVLFSTMVFGLMTKPLISLLLPPQRQLSTVSSGANTPKSLTAPLLGSREDSEGDLNVPDLPHPPSLRMLLTAPSHKVHRYWRKFDDAFMRPMFGGRGFAPPAPRSPTEHGP

SEQ ID NO: 4804 - protein, 530 aa, Magnaporthe grisea 70-15
MTEPEAFEDDLFADLAHRDPAISPPFVPKNLLFPRSPHTSRDTPTVRPWRNVLVRYLGDGGYVRNSISPMDALGRPSFMVAEPDRKSKQNQADDESLRDYFSQFGEVIECTVMRDGTTGRSRGFGFLTFKDPKTVNIVMVKEHYLDGKIIDPKRAIPRDEQEKTSKIFVGGVSQETTDQEFKDFFAQFGRVVDATLMMDKDTGRPRGFGFVTFESEAGVEACLARDLEIHGKLIEVKKAQPRGNLREEEEANRRNGGPGNKFRKQGEGQADASGAGNPAAGGMTPQMMANYWQRMQQYFQMMQQQMAMQQQRNMGFQMNPQMMQMMQMQQMMGRGGPNGQNPMAAMAAMNPQMMQQMQQMMGQQGGGPGGMPGGGPGGDQSGEQDGEGDGNRAPFNAYDQQSFEEQKYNNQHQQQRHMQQQQQRGGFGGPQQQHPQQQMQQGGYNNQPSYEGMYDDVPQANNFNQGGRGGFRQRGGHHNHFNNNNNNNNDPANAPPPNAPTGPKNAGKPGSNYRGGGRGMSRGFHPYARG

SEQ ID NO: 4805 - protein, 345 aa, Escherichia coli O157:H7 EDL933
  misc_feature (308)..(308): Xaa can be any naturally occurring amino acid
MHGNSEMQKINQTSAMPEKTDVHWSGRFSVAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIERELSQGTYLGHITRHMLGLFXGIPGARQWRRYLSENAHKAGADINVLEHALKLVADKR

SEQ ID NO: 4806 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 4807 - protein, 327 aa, Escherichia coli O157:H7 EDL933
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNINADKAAILPAAISFEQAAASFLKGLTVYYLLRKTYEIKPDEQFLFHAAAGGVGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 4808 - protein, 480 aa, Oryza sativa Japonica Group
MATGRRLSMILLLLLLGLASGDKILFQGFNWESWRQSGGWYNLLMGKVDDIVAAGVTHVWLPPPSHSVSTQDAIQSILYPFHFGYSKYILTQGLFGITLASEAPASGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLAAHGNGYAVWEKIAAAAAAADHRTSSSASL

SEQ ID NO: 4809 - protein, 538 aa, Populus tremula
MEEMYPAVAVPFRVGNSACESPSINTQMDITRILMADTASLLSDTVTKVPTAGDKDCNCAAPASKEDRGGRGAPLLDMISETERNWVVGDDGITRESEEEDSLSLEGDPILDSSCSLSVASETSSLCGEDLLSLETASEVGTLSSVEIQKSIGGVDIVAKTADLGDSNVDTVVSDRPSVAGSVEEEAGDGSDAKTSSVVLQLTLERGTSGTVSRSVFEVDYVPLWGFTSVCGRRPEMEDAVATVPYLLKFPIQMLIGDRLLDGMSKYLPHQTAHFFGVYDGHGGSQVANYCHDRIHSALSEEIEFVKNGLSDGSIKDSCQKQWKNAFTNCFLKVDAEVGGKAGAEPFAPETVGSTAVVAIICSSHIIVANCGDSRAVLCRGKEPMALSVDHKPNREDEYARIEAAGGKVIQWNGHRVFGVLAMSRSIGDRYLKPWIIPEPEVMFIPRAREDECLILASDGLWDVMSNEEACDLARKRILVWHKKNGVALSSSRSEGIDPAAQAAAEFLSNRALQKGSKDNITVIVVDLKAQRKFKTKT

SEQ ID NO: 4810 - protein, 474 aa, Magnaporthe grisea 70-15
MKNNSENGWVVQKFGGTSVGKFPDKIAEDIVQPYLRNNKIVVVCSARSSGKKVTGTTSRLLEVFRRLKSLEISIEPTQTELIDEARRIIQDICDDHVAAAETFIRDASRCAMLIKEIQDECLELCEYIVAAKRFHLEVNARSKDRVASFGEKLSCRFMACLLQDRNVEAQYVDLSDVLSYEGARRLDHTFYSDAAAVIRKKILACGDKVPIVTGFFGNVPGSLLDGDIGRGYTDLCAALIAVGLKAGELQVWKEVDGIFTADPTKVPTARLIGAITPSEAAELTFYGSEVIHHLTMDQVIKADPPIPIRIKNVKNPRGEGTIVVPDAVFAPGKELRRSRPSELDSVGRKTPKRPTAVTIKDGISVINVHSNKRSIAHGFFARVFSILDQNQVSVDLISTSEVHVSMAIHAASDNGGNFDRARAELGDCGEVSVLHDMAILSLVGADMKNMVGVAGKMFSTLGEHNVNIEMISQE

SEQ ID NO: 4811 - protein, 176 aa, Brassica napus
MPLTRLVPDAFGVLTICLVALLILLGLLCIAYSYFQSHVRKQGFIQLGYFTGPWIIRIIFICFAIWWAVGEIFRLSLFRRHRRLLSGLDPTWQENVCKWYIVSNLGFAEPCLFLALMFLLRAPLKMDSGAMSGRWNRNTAGYIILYCLPILALQLAVVLSESRLNDGSGSYVKLPH

SEQ ID NO: 4812 - protein, 521 aa, Streptomyces sp. PGA64
MTVSDETILGRIAELTDIKASARLGPDPKATERQHAKGKLTAHERISLLLDKGSFNEVEPLRRHRASGFGLEHKKPYSDGVITGWGSVHGRTVFVYAHDFRVFGGALGEAHAQKIHKIQDLAEAAGAPLVSLNDGAGARIQEGVTALAGYGGIFRRNTRCSGVIPQISVMLGPCAGGAAYSPALTDFVFMVRETSQMFITGPDVVKAVTGEEITQNGLGGADVHSATSGVSHFAYDDEEACIEDVRYLLSLLPANNRELAPVERSGDPADRLNESLLDVVPAGAGQAYDIRKVIEEIVDDGEFFEVHPSWATNIVCALTRLDGHVVGIVANQPASMAGVLDIEASEKGARFVQFCDAFNIPLVTLVDVPGFLPGVDQEHNGIIRRGAKLLYAYCDATVPRVSLVLRKAYGGAYIVMDSRSIGADLALAWPTNEIAVMGAEGAANVVFRREINAADDPDAVRQQRIAEYKDELMHPYYAAERGLIDDVIDPRETRSVLIRSLDMLRAKHADLPTRKHGNPPQ

SEQ ID NO: 4813 - protein, 465 aa, Photorhabdus luminescens subsp. laumondii TTO1
MQHIHFDAIVIGSGPGGEGAAMGLVKQGKSVAVIERYNNVGGGCTHWGTIPSKALRHAVSRIIEFNQNPLYSDNSRVLRSSFAEILRRAEMVINQQTRMRQGFYERNGCRMFSGEATFIDDHRVSVRYADDNHDILSADKIIIATGSRPYCPPDVDFTHSRIYNSDSILKLDHEPRHVIIYGAGVIGCEYASIFRGLGVKVDLINTRNHLLAFLDQEMSDALSYHFWNSGIVIRHNEEYSKIEGVDDGVIVHLKSGKKVKADCLLYANGRTGNTDTLGLKNVGLEADSRGLLKVNKIYQTSNENIYAVGDVIGYPSLASAAYDQGRIAAQAMTKGNAEVHLIEDIPTGIYTIPEISSVGKTEQQLTAMKVPYEVGRAQFKHLARAQIAGMNVGSLKILFHRETKEILGIHCFGERAAEIIHIGQAIMEQKGESNTIEYFVNTTFNYPTMAEAYRVAALNGLNRLF

SEQ ID NO: 4814 - protein, 375 aa, Arabidopsis thaliana
  misc_feature (108)..(108): Xaa can be any naturally occurring amino acid
MDKTFFSSNEGKPITCKAAICRKAGEALVIEDIHVDPPQAYEVRIKILCTSLCHTDLTFWKLSFGPISRFPRILGHEAVGIITCICCFYWDFKPVWSRALVKTWTDLXRYAEDFISNTRRYGMASRFKDSSGEVIHHFLFVSGFSEYTVVDIAHLVKISPEIPVNKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 4815 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 4816 - protein, 882 aa, Desulfitobacterium hafniense Y51
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLDPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENKAIYAQFVETSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGERVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQASARLVKEGCEIHPEVMIPLVIHVKELAKLRKVTEEAAQTVMAEQGVTFSYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSKGQ

SEQ ID NO: 4817 - protein, 157 aa, Chlamydia muridarum Nigg
MKLLKGLPVAKDVRVAIVGACFNAPIADRLVSGARETFFESGGSPDSLTVVRVPGAFEIPCAIKKMLSKGNLFQAIVACGVLIQGETSHYEHIADNVAAGIARLSVEFCLPITFSVITAPNVEAAWERAGIKGPNLGASGMRTALEMASLFSLIEKE

SEQ ID NO: 4818 - protein, 234 aa, Malus xiaojinensis
VVTGKHLAEHCRDEYPKVTNFILWILAELAVVACDIPEVIGTAFALNMLFKIPIWCGVLITGLSTLMLLFLQQYGVRKLEFLIAFLVFLIATCFLVELGYSKPNSSEVVRGLFVPEIKGDGATGLAISLLGAMVMPHNLFLHSALVLSRKVPRSVHGIKEACRFYMIESAFALTVAFLINISIISVSGAVCSADNLNPEDRMNCNDLDLNKASFLLKNVLGNWSSKVFAIALWA

SEQ ID NO: 4819 - protein, 161 aa, Lentisphaera araneosa HTCC2155
MYEKSLIIIKPDGVQRGLVGNIITRFENAGLKIHGMKFVQPTQEMARAHYSEHVDKGFYPTVEEYILSGPVLVFALGGINSVKKIRLMVGATEPASSAPGTIRGDFAHQSYPAPGEPDDKPIRNLIHASGSSEEAVTEVKLWFNDDEIIEYGKITDELLAF

SEQ ID NO: 4820 - protein, 234 aa, Mycobacterium bovis AF2122/97
MSRAALDKDPRDVASMFDGVARKYDLTNTVLSLGQDRYWRRATRSALRIGPGQKVLDLAAGTAVSTVELTKSGAWCVAADFSVGMLAAGAARKVPKVAGDATRLPFGDDVFDAVTISFGLRNVANQQAALREMARVTRPGGRLLVCEFSTPTNALFATAYKEYLMRALPRVARAVSSNPEAYEYLAESIRAWPDQAVLAHQISRAGWSGVRWRNLTGGIVALHAGYKPGKQTPQ

SEQ ID NO: 4821 - protein, 516 aa, Pisum sativum
MAVVAAPKKNNSFNKKDNPNLLLGRFELGKLLGHGTFAKVHLAKNIKTGEAVAIKIISKDKILKSGLVSHIKREISILRRVRHPNIVQLFEVMATKTKIYFVMEYVRGGELFNKVAKGRLKEEVARKYFQQLICAVEFCHARGVFHRDIKPENLLLDENGNLKVSDFGLSAVSDEIKQDGLFHTFCGTPAYVAPEVLSRKGYDGGKVDIWSCGVVLFVLMAGYLPFHDPNNVMVMYKKIYKGDFRCPRWFSPELVNLLTRLLDTKPQTRISIPEIMENRWFKIGFKRIKFYVEDDVVCNLDSLGLDGNNGNDGNDDKKVLNIDEHRDEALESVSESEWDSEVVNRRKNRQLGSLPRPASLNAFDIISFSQGFDLSGLFEEKGDEARFVSGASVSKIMTKLEEVAQLVSFKVRKKDCRVSFEGSREGVKGPLSIAAEVFELTPSLVVVEVKKKGGDKVEYDRFLNTELKSALHSLTMEESAGSSCQNTPDETLQQRAFSDSAIDKHSDSIESLNLDT

SEQ ID NO: 4822 - protein, 295 aa, Vibrio fischeri
ESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLRNIVDYTEAPLVSIDFNHDPHSAIVDGSQTRVSNGHLVKM

SEQ ID NO: 4823 - protein, 516 aa, Arabidopsis thaliana
MGSGQWHMEKRSTLKNDSFVKEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKGVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 4824 - protein, 230 aa, Vibrio fischeri
STHGRFQHKVTHDQEYLYIDLPNGSQDKVRILHQADLSLLPWQSLEIDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIV

SEQ ID NO: 4825 - protein, 237 aa, Picea mariana
MEACGEEAQVKLLGGNISPFVLRVRIALALKGIDYEFIEENMQNKSHLLLQSNPVNKKIPVLIHNGKPVCESMIIVQYIDEAWDTKAPVLMPKDPYDRAIARFWAAFVDDKLLPCLRGVFKGQGEQQQKALEESGASFLLLEEALRTSHCFSGKPYFGGDEIGFLDIALGGMLAFVKALEKVTNLVLIDQEKMPLLSTWMNRFCEADGVKDVMPDPAKLQEFISAIRVRFTSPPAAN

SEQ ID NO: 4826 - protein, 320 aa, Oryza sativa
  misc_feature (133)..(133): Xaa can be any naturally occurring amino acid
MQARVVVFPVKGRAWCFASPRATAPAAACGGGDGGALLPPPPPTVKDLWRGIAGGGRTASENAEAVVDFVADKMNRAWIGFGSAPEGSMKNRIHRSGVFGLKLLSRVRPSEVLLKSVTKDVSLLEIVHPASLXAACFLNLCACSVTVKCINPRLVRRRLRHIAVSSIYIFPHPSVSAMFLRTRGASVHRKFLYGSVCLLPVTSVFMVLPLPNIPFFWVLFRAYSHWRALQGSERLQLLVSDSSDQWKILLEKQKEMSSRKDGNPCENTQYAPWNLQPSKKLDGFLESRKLNEGLDCDTISRICQAYDLDKIDVLKYRDLE

SEQ ID NO: 4827 - protein, 269 aa, Thiobacillus denitrificans ATCC 25259
MTVSIKTGADIDNMRVAGRLASEVLDYITPFVKPGVTTGELDRLCHAYMVDVQGTVPAPLNYAPSGHAPYPKSICTSVNNQVCHGVPGDKVLKNGDIVNLDITVIKDGWHGDTSRMFAVGEATIQARRLIQITYEAMWVGIDRVKPGARLGDIGHAIQRFAENHGYSVVREFCGHGIGRNFHEEPQVLHYGKAGTGLLLEPGMTFTIEPMINAGRRDIRQMPDGWTIVTKDRSLSAQWEHTVLVTDSGYEVLTVSAGTPAVPDRILHPA

SEQ ID NO: 4828 - protein, 343 aa, Zea mays
  misc_feature (165)..(165): Xaa can be any naturally occurring amino acid
CRPETPEPERPPHRCINMLQGCRSVDEFERLNKINEGTYGVVYRARDKKTSEIVALKKVKMEREREGFPLTSLREINILLSFHHPSIVDVKEVVVGSSLDSIFMVMEYMEHDLKGVMETMKQPYTQSEVKCLMLQLLEGVKYLHDNWVLHRDLKTSNLLLNNRGXPELLLGTKEYSTAIDMWSVGCIMAELLAKEPLFNGKTEFEQLDKIFRTLGTPSEKIWPGYAKLPGVKVNFVKQPYNRLRDKFPAASFSGRPILSEAGFDLLNRLLTYDPDKRISADDALKHKWFSEVPLPKSKDFMPTFPALNELDRRTKRYLKSPDPLEEQRLKELQGNIGNRGLFG

SEQ ID NO: 4829 - protein, 341 aa, Chromobacterium violaceum ATCC 12472
MKALAKLKAAPGLEMTDVPLPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAKKMGATRAVNVAREDLKAVMQELHMSEGFDVGLEMSGNPQAFRQMLETMNHGGKVALLGIPPSNTAIDWNQVIFKGLEIKGIYGREMFETWYKMVALIQSGLDISPIITHHFKVDEFEQGFAAMLSGQSGKVILDWR

SEQ ID NO: 4830 - protein, 593 aa, Yarrowia lipolytica CLIB122
MSERKSFTENVESDNSVGEIHEVKAEGPPDTSHLSYWGRFKHGFGPADVAHLDLEGLTPMEITALKTANAPLQRNLKGRHLQMIAIGGSIGTGLFVGSGSTLANGGPAALLIAYGVIGIMLLLTMHALGELAVCFPVSGGFCTYFTRFLDPGWGFAMSWNYIMGWFVILPLELVAASMTVNFWNEMNGTHINAAAWVSIFWIIICAINLFGVKGYGEAEFVFSIIKVAAIVGFILFGIVMAAGGGPKGGAFHEYQGGKLWQHPGAFAHGFKGVCSVFVTAAFAFAGTELCGLAAAETENPRVMLPKATKQVFWRICLFYLVSLTIVGLLVPWNNDQLLNGSSSADAAASPFVIAIRVAGVKGLPSVMNVVIMISVLSVGNAAVYGFSRTIAAMGESGQAPKIFAYIDREGRPIFGILVVLAFGLFSFIAAAGAETRNEVFNWLLALSGLSSVFIWGSICAAHIRFRMALKYRGRGTDELSFVAGFGVWGSVIGVVLNCLVLMAQFWIALYPLGVKTPNASDFFQAYLAAPVILGFWIFWKIWKRDGLFLLLKDLDIDTGRREPDLERVKAEMAEERYALSQKNFMYRLYNFWC

SEQ ID NO: 4831 - protein, 363 aa, Triticum aestivum
  misc_feature (162)..(162): Xaa can be any naturally occurring amino acid
  misc_feature (192)..(192): Xaa can be any naturally occurring amino acid
NKFVQKSRLVPVRNSRDILRPTRPPPSPAWTGNFSFHGRSLHHISNVPNPYEQGISILGQTLSKFDEDNLIPCFGFGDASTHDQDVFCFYPDERPCNGFSEALERYRELVPHLRLAGPTSFAPIIEMAMTIVEQSGGQYHVLLIIADGQVTRSVDTASGPAXGSQEQKTVDAIVRASELPLSIVLVGVGDGXPWDMMKEFDDNIPARAFDNFQFVNFSEIMSKNMPQSRKEAAFALSALMEIPQQYKATVELGILGRRSMKAPERVPLPPPGGSHDAYSYGSKSFSKPQPSTSSSAYPPYETAHTAAPAAPSSAYDNQVCPICLVNPKDMAFGCGHQTCCECGQTLESCPICRSPITTRIKLY

SEQ ID NO: 4832 - protein, 329 aa, Arabidopsis thaliana
DDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 4833 - protein, 340 aa, Saccharomyces cerevisiae YJM789
MTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFFELFQFFAHTYKDMQGFESGPPIHDPVALMPLLEFYGWDPSSAVGFRYKRMDISCIDDVFNENSGKIIIEKEYPNDSDVGTIVGLDLNIQYFWDQIFEALNRADKMSTIG

SEQ ID NO: 4834 - protein, 366 aa, Bacillus clausii KSM-K16
MALTTGIVGLPNVGKSTLFNAITQAGAESANYPFCTIDPNVGIVEVPDVRLEKLTELVKPKKTVPTAFEFTDIAGIVEGASKGEGLGNQFLSHIRQVDAISHVVRCFADENITHVSGGVNPLRDIEVINLELILADLESVDKRIGRVAKLAKAKDKAAVAELPVLEALKEAFENEKPARSIDFDDDQLKIVKQLHLLTSKPVLYVANVAEDDLLAGEDNDYVKQVKAFAEAENSNVIVVCAKIESEIAELEGDEKALFLEELGIQESGLDQLIRAAYSLLGLETYFTAGEQEVRAWTYRRGTKAPQAAGIIHTDFERGFIRAEVVAYDDLIAAGGMVAAKERGKVRLEGKEYVVQDGDVIHFRFNV

SEQ ID NO: 4835 - protein, 352 aa, Prochlorococcus marinus str. MIT 9303
MQDWPGLIEAYRSWLPVSDTTPVVTLKEGATPLIPVNSIAERIGRGVKVYVKYDGLNPTGSFKDRGMTMAISKAKEANCEGVICASTGNTSAAAAAYARRAGMRAFVLIPDGYVAQGKLAQALVYGSEVLAIRGNFDRALDIVQEMALKYPVTLVNSVNPYRLQGQKTAAFEIVDALGEAPEWLCIPMGNAGNITAYWMGFQEYKQAGKCQLLPQMMGFQASGSAPLVFNKTVNNPNTIATAIRIGNPVNKEKAIAAKSSSNGAFLDVSDEKIIEAYKLLGREEGIFCEPASAASVAGLLKRASEVPSGATVVCVLTGNGLKDPDCAINNNDATFHADLNPDLTTVARVMGF

SEQ ID NO: 4836 - protein, 489 aa, Saccharomyces cerevisiae YJM789
MELLKLLCLILFLTLSYVAFAIIVPPLNFPKNIPTIPFYVVFLPVIFPIDQTELYDLYIRESMEKYGAVKFFFGSRWNILVSRSEYLAQIFKDEDTFAKSGNQKKIPYSALATYTGDNVISAHGAVWRNYRNAVTNGLQHFDDAPIFKNAKILCTLIKNRLQEGQTSIPMGPLSQRMALDNISQVALGFDFGALTHEKNAFHEHLIRIKKQIFHPFFLTFPFLDVLPIPSRKKAFKDVVSFRELLVKRVQDELVNNYKFEQTTFAASDLIRAHNNEIIDYKQLTDNIVIILVAGHENPQLLFNSSLYLLAKYSNEWQERLRKEVNGITDPKGLADLPLLNAFLFEVVRMYPPLSTIINRCTTKTCKLGAEIVIPKGVYVGYNNFGTSHDPKTWGTTADDFKPERWGSDIETIRKNWRMAKNRCAVTGFHGGRRACLGEKLALTEMRISLAEMLKQFRWSLDPEWEEKLTPAGPLCPLNLKLKFNENIME

SEQ ID NO: 4837 - protein, 392 aa, Neorickettsia sennetsu str. Miyayama
MNIHEYQAKEILRVCGVPTPAGFLVQEDTETSEIAKSLARLGGKVFAVKAQIHAGGRGKAGGVVICRSVEEAIDNTKKMLGMNLVTHQTSPAGQKVRKVYIEAGQSILKEYYLSMVVDRENAKVAIIASEEGGMDIEEIARSTPEKIKKVFVDLSIGISDFHARKIGFELGLSLAQIKQFTPLVKKLYALFVTRDASQVEINPLIANSKGEFIALDAKLNFDDNALYRHPDTLELRDLYEEDPKEIEAAKYNLNYIKMEGGIGCMVNGAGLAMATMDIIKYYGASPANFLDVGGGANLEQVTNAFKIISSDKHVAGILVNIFGGIMRCDIIAEGIVAAAKDIGLTMPLVVRLSGTNYSAGIKIIEGSGLNIVTASELDDAAQKIVKLTRKEI

SEQ ID NO: 4838 - protein, 408 aa, Oryza sativa
  misc_feature (108)..(108): Xaa can be any naturally occurring amino acid
  misc_feature (119)..(119): Xaa can be any naturally occurring amino acid
AAEAEAAAGDEAWCRETVPRVMELVSPRLPQRDACALLAVSPWCHRALVANPKLWEVRYRVASLPSTFFVLPLLALGLDSRGVLLRCFALLRKWSLAWASSLEWPVIXSCSRCLICMRXNKAGDRLISAISLPRYCHLKIINLEFAQDIDDRHFVRLKEMGCTSLQELELLNINACQKVSDKGIETITSLCPNLRALSIYWIVGLTDLTIRHIVQNCKHIVDLNLSGCKNISDKGMQLVADNYEGLKKLNITRCIKLTDDGLQEVLQKCSSLESLNLYALSSFSDKVYKKIGSLTNLTFLDLCGAQNVTDDGLSCISRCVCLTYLNLSWCVRVTDVGVVAIAQGCRSLQLLSLFGIVGVTDVCLEALSKHCSRSLTTLDVNGCIGIKKRSRDDLIQLFPLLRCFKVHS

SEQ ID NO: 4839 - protein, 149 aa, Glycine max
MAEQTFIMIKPDGVQRGLIGEIISRFERKGFYLKGLKLVTVDRPFAEKHYADLSAKPFFSGLVDYIVSGPVVAMIWEGKNVVTTGRKIIGATNPAQSEPGTIRGDFAIDIGRNVIHGSDSVESANKEIALWFPEGPANWQSSQHSWIYE

SEQ ID NO: 4840 - protein, 383 aa, Bacillus clausii KSM-K16
MRYFDQAATSFPMAKAVADAVSEAILAYGANPGRGGHKLARQAADTLFQARKRLAAFFGAPGPEHIWFYPNATYALNQAILGFPLQQGDRVVSTAFEHNSVLRPLHILEKEKQATIVYASGKTGDETAAAVVEAMTPGTRLVVINHASNVTGEIVPLKPIATKAKEIGAVLLVDASQTAGKIAIDMEQDGIDLLACPGHKGLLGPQGTGLLAAARDVGLKPLVHGGTGHYSEHPEQPDKWPERYEAGTANTPGIAGLLAGLQELERLGGVEAVHAHEMEATRIFLEGISNHEHVHVVGSLSPQGRVAVVSFAIDGVSSQETAMILDEHYDMAVRAGLHCAPKLHNWYKTAEDGLVRASFGPYTKQEDVSALVDAITDIADAFR

SEQ ID NO: 4841 - protein, 321 aa, Bacillus cereus G9241
MRIVNKKIIFFGDFGIDDAVALIYANKTCKLDIIGIVAEYGNVSREIVTENVYFLERYYATEVKIIEGAARPMTAEEPLFFPEIHGDHGLGPIIPPEMRICKRENFCELIKLIEPCPEDIIIVATGRLTTLATLFLIYPNVMDKVCSYYIMGGAFLFPGNVTPVSEANFYGDPIAANIVMKYAKNATIYPLNVTQGALITPEMVNIINKEGTGQAKLIKPMIDFYYENFYKKEYPGIAGSPIHDLLPFISFINDDIFEYKKSAVWISTTNDVTRGQSVADFRKIAEPTRFDDRPIQRIAVGFNYPAFKEEFMRTILKPDCP

SEQ ID NO: 4842 - protein, 492 aa, Ralstonia metallidurans CH34
MMKSLRQDWLSNVRNDLLAGIVVALALIPEAIAFSIIAGVDPKVGLYASFSIAAIIAFAGGRPGMVSAATGAMALLMVTLVKDHGLQYLLAATVLTGVLQILAGWLKLGALMRFVSRSVITGFVNALAILIFMAQLPELTNVTWHVYAMTAAGLGIIYGFPYITKAVPSPLVAIVVLTGVAIFLGLDIRTVGDMGKLPDSLPVFLLPDVPLNLETLKIIFPVSATLAVVGLLESMMTASIVDDLTDSNSNKNRECVGQGVANIATGFLGGMAGCAMIGQSVINVKSGGRGRLSTLAAGVFLLLMVVFIGDWVARIPMAALVAVMIMVSIGTFNWASIRNLREHPKSSSMVMLATVVVTVGTHDLAKGVLIGVLLSGFFFAHKVGQILRVTSRTEDEGRVRTYTITGQVFFASADRFINTFDYKEVIEKVRIDVSRAHFWDITAVSALDKVVIKFRREATEVEVIGLNEASATMVDKFAVHDKDGAEDMLMGH

SEQ ID NO: 4843 - protein, 366 aa, Triticum aestivum
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGVPRVPPRAPPDEKEEKGVPDFWLNAMKNHEILAEEIQERDEEALKYLKDIKWYRITEPKGFKLEFHFNTNPFFKNEVLSKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVSWFTGEAAQDEDFDGIMDDDEDDDEDDEEDEDEDEDDEEDEDDDDGDKKKGGRVPAGEGQAGERPAECKQQ

SEQ ID NO: 4844 - protein, 257 aa, Photorhabdus luminescens subsp. laumondii TTO1
MEPLVIKLGGVLLDNEEALERVFTALQEYRQTHERQLVVVHGGGYLVDELMEKLQLPIVKEQGLRVTPADQIGIITGALAGIANKTLLSWATKYQLASVGLYLGDGNVVTVSQLSEELGHVGKAMPGDAKLLKTLLDAGYMPIISSIGVTDKGELMNVNADQAATAIAQTLGADLVLLSDVSGILDGKGQKIPDINVEKAEQLIAHGIITDGMIVKVNAALDAARTLDRPVDIASWRHADQLTDLFNGVPVGTRILA

SEQ ID NO: 4845 - protein, 99 aa, Triticum aestivum
  misc_feature (7)..(7): Xaa can be any naturally occurring amino acid
  misc_feature (9)..(9): Xaa can be any naturally occurring amino acid
  misc_feature (36)..(36): Xaa can be any naturally occurring amino acid
  misc_feature (38)..(38): Xaa can be any naturally occurring amino acid
  misc_feature (41)..(41): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (53)..(53): Xaa can be any naturally occurring amino acid
  misc_feature (55)..(55): Xaa can be any naturally occurring amino acid
  misc_feature (59)..(61): Xaa can be any naturally occurring amino acid
  misc_feature (69)..(70): Xaa can be any naturally occurring amino acid
  misc_feature (76)..(76): Xaa can be any naturally occurring amino acid
  misc_feature (79)..(79): Xaa can be any naturally occurring amino acid
  misc_feature (84)..(85): Xaa can be any naturally occurring amino acid
  misc_feature (89)..(89): Xaa can be any naturally occurring amino acid
  misc_feature (93)..(93): Xaa can be any naturally occurring amino acid
EESGVEXQXVGDDLLVTNPTRVAKAIQEKSCNALLXKXNQXGSVXESXEPXKXSXHAGXXXMTSPRSGXXEDTFIXDLXVGLSXXQIKXGAPXRSERLA

SEQ ID NO: 4846 - protein, 363 aa, Rosa hybrid cultivar 'Kardinal'
MGLAENQLSFDVIEEWIKKNPKASICTPEGVAEFKNVANFQDYHGFPDFRKAIANFMSKARGGRVKFDPDRVVMAGGATGANETVMFCLADPGDAFLVPSPYYPAFYRDLGWRTGVKIVPVDCDSSNNFQVTRAALEAAYEKARNNNINIKGLIITNPSNPLGTTVDRDTLTSLVKFINDKNIHLVCDEIYAGTVFSCPKFTCVTEVLQDVKNCNRDLIHIVYSLSKDMGVPGLRIGIVYSYNDAVVNCARKMSSFGLVSSQTQHMLSAMLLDDEFVSNFLETSSKRLARRHRFFTTGLEEVGINCLKGNAGLYCWMDLRKLLKDQTFEAEMVLWRMIINEVKLNVSPGSSFRCVEPGWFRVC

SEQ ID NO: 4847 - protein, 738 aa, Cryptococcus neoformans var. neoformans B-3501A
MSTSSHLAHATHLPRPADSLPRSPYPHDAQHSPLPPPSFLHAFPLPPRASISSVAAPPASAPLHSAPPYSSAQTLRASLPLPHPYYPLPLPHTPSGHRVLRSPNPPCLWPLPHPLPAIDSLRRPSRHPPHPASHSGSPSLDHPRAYYDPTVSVPLAYRESYPSHPSTHPSSPYLPPPTPSAYGYRAPSPFRIPPPLTFRYSRSPPPLDTMPPRKKAEPSTADTVAASNASATTGAPASASTRARRGANGKGWTTEHTYEPNGQRKEVIVIDDSASPMVQPVRKRTRAQVAAEQAAQQQQLHQAYASTNAGYSDTVSISNGHGSVASTAGTAAGGTTKKRKLEEDQGKKAKAKVASTATSASIQTTGTWQSTQQAAPAKATQYQKAPAQPAQQQGPPPWDDPEGHYIVKPDDVIGGRYKIVRLLGQGTFGKVVEARHIETRRKVAIKVIRAVQKYREASKIEIRVLETLRKHDPRNDNKCIHLDEYFDFRNHPCLVSELYGMSVFDFLKQNGFQPFPDKHIQDFAKNLHSLKLVHTDLKPENILLCSNEARLAGPRVRNARSKSILKNTEIRLIDFGSATFESEYHSSVVSTRHYRAPEIILGLSWSYPCDMFSIGCILVEFYTGNALFQTHDNLEHLAMMEVVMGKFSQRMIEKGKSKKPEYFKGNKIDFPNSTVSKASRKYVKSMQSLKQVIDPANRHQQLFLDLCTRLLEHDPDVRIKVQDALRHPYLTEPIPEPA

SEQ ID NO: 4848 - protein, 224 aa, Cryptococcus neoformans var. neoformans B-3501A
MSKAIISPSVLASDLSDLSNECRRMMANGCDWLHMDVMDGHFVPNITMGAPILEHVYKNVPNIFMDCHMMVSNPSQWVPEVAKAGGKLYTFHYEATEEPEKVIELVHSHNMLAGLAISPETPASAITDSLGKAADLLLVMTVRPGRGGQKFMPECLEKVKELRERFPGKNIQVDGGVGSGNACQCAQAGSNVLVAGTAIFGAKDPKQTIQEMRTAVDGAIAQQK

SEQ ID NO: 4849 - protein, 293 aa, Vibrio fischeri
ALYESDNPDKIEVVAVNELSQPEAMAHLFQYDSTHGRFQHKVTHDQEYLYIDLPNGSQDKVRILHQADLSLLPWQSLEVDLILDCSGVYGSKADGEKHINAGAKKVLFSHPGGSDLDNTIIYGVNHDTLLPEHRIVSNGSCTTNCIIPVIKAIDDVFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 4850 - protein, 256 aa, Zea mays
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFPNGFNQGYNPNPLGGYGMRVDGRYGLLTGARNGFSSFGPGYGMGMNAE

SEQ ID NO: 4851 - protein, 437 aa, delta proteobacterium MLMS-1
MDFNPIFEIAGNQSLITVGGRVSQVIGMVIESDGPGIPVGSICEVEVFRGRSTVPAEVVGFREGRVLLMPLGEMRGVEPGSAIRLAEGQARVTVSQALLGRIIDGLGQPMDGGPPLPGEAFYPLYAEPLNPMERERIQEPVDVGVRSINGLLTLGKGQRIGIMAGSGVGKSTLMGMIARHTAADISVIALIGERGRELKDFIERDLGPEGLARSVVIVATSDQPPLVRMRGAYLAMAVAEYFRDHDRDVVLMMDSVTRYAMSSREVGLAIGEPPTSRGYTPSVFGQLPKLLERAGTCQGKGSITGIFTVLVEGDDMNEPIADAVRSIVDGHIVLSRDLAGQGHYPAIEVSGSVSRCMSDVASAEQIEAAHRFLEIISLYRRSEDLINIGAYAKGSNPKIDNAIAMIDQLNGYLRQQVEQQVPYKDSVAQLLALFKKK

SEQ ID NO: 4852 - protein, 171 aa, Vibrio logei
SVLRALYESGKRDQIEIVAVNELSQPEGMAHLLQYDSTHGRFQHKVTHDQEYLYIDLPNGSQDRIRIVHQADISLLPWQSLQVDLVLDCTGVYGSKADGEKHIDAGAKKVLFSHPGSADLDNTIIYGVNHDTLLPEHRVVSNGSCTTNCIIPVIKAIDDAFGIDSGTTTSS

SEQ ID NO: 4853 - protein, 127 aa, Eucommia ulmoides
NDDLRRGKPTNHMVFGEDVAVLAGDSLLAFAFELIATSTTGVPADRIVRVIGELAKSIGSEGLVAGQVIDICSEGMTDVGLEHLEFIHVHKTAALLEGSVVLGAILGGATDPEVEKLRKFARCIGFL

SEQ ID NO: 4854 - protein, 271 aa, Vibrio logei
VAVNELSQPEAMAHLFQYDSTHGRFQHKVTHDQEYLYIDLPAGSQDKVRILHQADLSLLPWQSLEVDLILDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHEPHSAIVD

SEQ ID NO: 4855 - protein, 302 aa, Vibrio fischeri
SVLRALYESDKRDKIEVVVVNELSQPEAMAHLFQYDSTHGRFQHKVTHDQEYLYIDLPNGSQDKVRILHQADLSLLPWQSLEIDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMYDQQVIDAYHSDLRRTRAASQSIIPVDTKLHKGIERIFPKFSNKLEAISVRVPTVNVTAMDLSVTINTNVKVNDINQTIVNASRCTLHNIVDYTEAPLVSIDFNHDPHSAIVDGSQTRVSNGHLVKM

SEQ ID NO: 4856 - protein, 365 aa, Triticum aestivum
LIFLAHKYWKTRITIDAVEKFLQMQQMIGPTRYAYTDIVAVTSHFRDKLGQGGYGSVFKGVLLPGNVNIAVKMLEGSSNCNGEDFISEVSTIGRIHHVNVVRLVGFCSEEMRRALVYEYMPGGSLDKYIFSADKSISWDKLNEIALGIARGINYLHQGCEMQILHFDIKPHNILLDSNFVPKVADFGLAKLYPRDNSFVPSNALRGTVGYIAPEMISRSFGTISSKSDVYSFGMLLLEMAGGRRNADPNAANSSQSYYPSWVYDKLTAQEADAISLVADMHELERKLCIVGLWCIQMKSHDRPTMSEVIEMLEGGFDGLQMPSRPFFCDDEHTAVPDSYPLLSELTEISAEDEISDFYVPGPRAL

SEQ ID NO: 4857 - protein, 299 aa, Vibrio fischeri
RALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVKASRCTLHNIVDYTEAPLVSIDFNHDPHSAIVDGSQTRVSNGHLVKM

SEQ ID NO: 4858 - protein, 487 aa, Escherichia coli CFT073
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 4859 - protein, 252 aa, Zea mays
  misc_feature (80)..(80): Xaa can be any naturally occurring amino acid
MYRAFAANAPADVRQSCNIRSIIGRSAQASESDEFKKLYGTTLVTGFARICGQPVGIIGNNGILFTESALKGSHFIELCXAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 4860 - protein, 457 aa, Neorickettsia sennetsu str. Miyayama
MYDVIVVGGGPAGYPAAIRASRSGLKVALVEKNKLGGVCLNCGCIPTKALLHIAEKYHFVKTGAAELGINVSNVFLTFSSAIAYAQEKIKKLAAGVSYLMKKNKVELFYSSGRILPGKQVKLEDLGKTISAKNIILATGSTPKEITGLEYDHELIWNYNDAMTATKMPKSLLVVGAGAIGVEFACIYNVFGSKVTVIEMQNQILPAEDTEISNLAEAAFKESGITIRKGTTIQSLKKDKDKVLVTLSDGTNLEVERILVAGGVEASSQNLGLEQIPTIRMNKGFVSVDKYCETGEPGVYAIGDLRGFPCVAHKAIYDAYVCTAKIAGKEPVPLEMDSIPSCIYSFPSIASVGLTEEAAIRMGHKVKIGRAKAEGNGKSVVLGKDKGLVKTVFDAKTGELLGAHIIGYEATEILNGYIIAKASEATVESLKAVVFPHPTISEMMYEAVLAADNEEVHS

SEQ ID NO: 4861 - protein, 136 aa, Salmonella enterica
MPKPMFGDTGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLVGINNKIHPGEA

SEQ ID NO: 4862 - protein, 126 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 4863 - protein, 605 aa, Flaveria trinervia
RPERSVGVSVDGAVKDVNAPVAVEVVDSESKETTAVVGGGVEDVYGEDSATEDHFITPWSVSVASGYSLLRDPHHNKGLAFTKKERDAHYLRGLLPPVVVNHDLQVKKMMHNIRQYEVPLQRYQAMMDLQERNERLFYKLLIENIEELLPIVYTPTVGEACQKYGTIFKNPQGLYISLKDKGKVLEILKNWPQKKIQVIVVTDGERILGLGDLGCQGMGIPVGKLSLYTALGGIRPSACLPITIDVGTNNEKMLDDEFYIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIIRSRLDSLQHFKKPWAHDHEPVNKFLDAVKAIKPTVLIGSSGAGQTFTKEVVEAMSSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 4864 - protein, 399 aa, Bacillus cereus G9241
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKDNDFLPNLELIPEEIADQAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRNGAAFCEKNRAIYQERRDTLVDGFRTFGWNVDKPAGSMFVWAEIPKGWTSIDFAYALMDRANIVVTPGHAFGPHGEGFVRIALVQDKEVLQQVVENIRNSGIFALEKVDELVKN

SEQ ID NO: 4865 - protein, 363 aa, Neisseria gonorrhoeae FA 1090
MSHISPIPEILADIKAGKMVIITDAEDRENEGDLLMAAQFVTPEAVNFMIKHARGLVCLPMEGAMVEKLGLPMMTQKNGAQYGTNFTVSIEAAHGITTGISAADRALTIQTAVSPTAKPADIVQPGHIFPLRAQKGGVLVRAGHTEAGVDLAQMNGLIPAAVICEIINDDGTMARMPELMKFAEEHKLKIGTIADLIEYRSRTESLLEDMGDAPVQTPWGEFQQHVYVDKLSGETHLALVKGTPSADTETLVRVHEPFSVMDFIQANPRHSWSLPKALERVQQAESGVVILLHHTEDGASLLDRTLPKGANQAYKWDSKSYGIGAQILAGLHVKKLRVLGQPSSFTGLTGFGLEVVGFEEAEK

SEQ ID NO: 4866 - protein, 528 aa, Pseudomonas putida
MASVHGTTYELLRRQGIDTVFGNPGSNQLPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 4867 - protein, 335 aa, Prochlorococcus marinus str. NATL1A
MISNSLKTNEIANYRLSIAPMMDCTDRHFRVLMRQITKKSLLYTEMIVAQALHYSKNRNKLLDFDEIEHPISIQLGGDNPKLLAEAAQMAEDWGYDEINLNIGCPSPRVKSGNFGACLMGKPKIVANCIEKMKESCNIPITVKHRLGIDNLDSDDYLLTFVDTCSLAGADRFIIHARKAWLNGLNPKENRTIPPLQYERVQKLKNHRPELIIELNGGINTINDSIEALKVFDGAMVGRAAYSHPFLWTKIDSLIFGQKEKYLSRSKIIKRLIPFAEKHLENDGRLWQISRHILNLIENIPNAKILRQELSEKCQTQKADISILKKIAQQLEDAGQ

SEQ ID NO: 4868 - protein, 155 aa, Prochlorococcus marinus str. NATL1A
MFGLLNTLFGFTIEPKSAFASSKPMENYKTLTDADWENRLPKDAFYVLRKEGTERPFSSSLNDEKRKGVFRCAGCGLALFSSTTKFDSGTGWPSFFDHLPDAIETKTDFKLIVPRTEYHCRRCGGHQGHVFNDGPRPTGKRYCNNGVALAFEVDS

SEQ ID NO: 4869 - protein, 256 aa, Photobacterium sp. SKA34
MRHPVVMGNWKLNGSKEMVSGLIKGLDAALNGVEGVDVAIAPPVMYLDLAEQLLNKADSKIILGSQNVDLHNNGAFTGDISPAMLKEFGASHIIIGHSERREYHHESDEFVAQKFAFLKENGLTPVLCIGESEAQNEAGETVAVCARQLDAVINTQGVDALNGAIIAYEPIWAIGTGKAATADDAQRIHAAIRAHIAEKSEEVAKNVVIQYGGSVKPENAASYFAQPDIDGALVGGAALDAESFAAIAKAAAEAKN

SEQ ID NO: 4870 - protein, 540 aa, Rhodopirellula baltica SH 1
MTFDLTFDNRFTRDLPADTEPRNFTRQVHQAGFSRVKPTPVSAPKWVAGSKEVAELIGLDPKWLGSAELTEVLAGNALADGMDPFAMCYGGHQFGNWAGQLGDGRAINLGEVVTADEKHWTLQLKGAGLTPYSRTADGLAVLRSSVREFLCSEAMHHLGVPTTRALSLVLTGEKVLRDMFYDGHPEHELGAIVCRVAPSFIRFGNFEIFASREDTETLQTLVEHTIRSEFSHLLSEPDAEIGPDVIAAMFEEVCRTTAEMVVHWMRVGFVHGVMNTDNMSILGLTIDYGPYGWLEDYDPDWTPNTTDAQGRRYRYAHQPQIAQWNLVALANALVPLVKEAEPLQRGIAVYVEEFQKSWHSMMAGKLGLSKYESETDDELVDSLLTLLQLAETDMTIFYRRLADIELGTREQPVTLELAAVLRHLSEAHYVADEVTEEYQQALMDWMRSYQSRVLADDGFPAEDSQRRQRMNAVNPKYVLRNYLAQLAIDACDKGDDSLVSELLEVLRRPYDDQPGKERFAEKRPEWARHRPGCSMLSCSS

SEQ ID NO: 4871 - protein, 528 aa, Candida dubliniensis
MAIVETAIDGINYFLSLSVTQQITILLGVPFVYNLIWQYLYSLRKDRAPLVFYWIPWFGSAASFGQKPYEFFESCRQKHGDIFSFMLLGKIMTVYLGPKGHEFIFNAKLSDVSAEDAYKHLTTPVFGKGVIYDCPNSRLMEQKKFAKFALTTESFKRYVPKIREEILDYFVNDESFKLKEKNHGVANIMKTQPEITIFTASRSLFGDDVRKLFDRSFAQLYSDLDKGFTPINFVFPNLPLPHYWRRDAAQKKISATYMKEIKSRRERGDIDPSRDLIDSLLTHSTYKDGVKMTDQEIANLLIGILMGGQHTSASTSAWFLLHLGEKPHLQDAIYQEVVELLKEKGGDLNDLTYEDLQKLPSVTNTIKETLRMHMPLHSIFRKVKNPLRIPETNYVVPRGHYVLVSPGYAHTSERYFDNPNNFDPTRWDTAAAKANSVSFNSSDEVDYGFGKISKGVSSPYLPFGGGRHRCIGEQFAYVQLGTILTTFVYNLRWTVEGNRVPDPDYSSMVVLPTEPARIIWEKRETCMF

SEQ ID NO: 4872 - protein, 289 aa, Vibrio fischeri
  misc_feature (36)..(36): Xaa can be any naturally occurring amino acid
  misc_feature (76)..(76): Xaa can be any naturally occurring amino acid
  misc_feature (89)..(90): Xaa can be any naturally occurring amino acid
  misc_feature (101)..(101): Xaa can be any naturally occurring amino acid
KVEVVAVNELSQPEAMAHLFQYDSTHGRFQHKVTHXQEYLYIDLPDGSQDKVRILHPADLSLLPWQSLEVDLILDXTGVYGSKSDGEKXXTAGAKKVLFSXPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKM

SEQ ID NO: 4873 - protein, 506 aa, Cryptococcus neoformans var. neoformans B-3501A
MEGRYNPFEDPDTIPVYQIFLLFITFVGPPTFLFVLFARRTATRPHLHHTATVLVLGDIGRSPRMMYHSESLARHNWRTFMVGYAETPPTSALLENPMVHLLGLKEPPKMVGLLPWILRAPIRIIYQVFSVIHTCIWRVPCNTEILLVQNPPSIPTLALAQFICLATKTKLIIDWHNTGYSILGLRVGEGSRLVRIAKWFESTFGQTAYAHLFVTKALQEFLIREWDLKGRTSVLHDRPPTHFHRTVPMIQHELFSRLLPELKPSLPPSHLDTNDPTHTAFTEISSEGLAVLKHTRPALIISSTSWTADEDFSLLITALDLYQSAVDSGSALPKLVVLITGKGALRAPFENIVKSREISKWKDITVRCVFVPAQEYPPLLGCADLGVSLHTSSSGKDLPMKVVDMFGCGVPVLAKDFQCISELVKDGENGKVFGTGEELGEQMIDILSSFPSSEKLDDLKGYFDRMNTPRRRATLPTADVGEDEWSNWDDNWDNVVYNGILNKIRR

SEQ ID NO: 4874 - protein, 127 aa, Nicotiana tabacum
NDDLRRGKPTNHKVYGEDVAVLAGDSLLAFAFEYIAAATAGVSPSRILAAIGELAKSIGTEGLVAGQVADIACTGNPNVGLDTLEFIHIHKTAALLEASVVLGAILGGGTGEEVEKLRRFARCIGLL

SEQ ID NO: 4875 - protein, 234 aa, Glycine max
  misc_feature (86)..(86): Xaa can be any naturally occurring amino acid
  misc_feature (135)..(136): Xaa can be any naturally occurring amino acid
MEYVSPEGLRLDGRRPMEMRQIRAEIGAVSKADGSAIFEMGNTKVIAAVYGPREVQNRSQQISSHALVRCEYCMANFSTGDRMRKXEISLVIRQTMEACILTHLLPRSQIDIYVQVLQADGGTRSACINAATLAXXDAGIPMRDLVTSCSAGYLNSTPLLDLNYVEDSAGGPDVTLGILPKLDKVTLLQMDSKLPIDILENVMQLAIEGCKAIANYIREVLLENTKQLEYRRGV

SEQ ID NO: 4876 - protein, 296 aa, Vibrio fischeri
FESDNPDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKM

SEQ ID NO: 4877 - protein, 260 aa, Shewanella sp. MR-7
MSTNNSVLVLKVGGALLQCEMGMARLMDTAAAMIANGQQVLMVHGGGCLVDEQLAANGMETVKLEGLRVTPPEQMPIIAGALAGTSNKILQGAATKAGIVSVGMSLADGNTVSAKIKDERLGLVGEVSPKDATYLKFILSQGWMPICSSIAMMDDGQMLNVNADQAATVLAKLVGGKLVLLSDVSGVLDGKGQLIPSLTGQQIAELVKQGVIEKGMKVKVEAALEVAQWMGQAVQVASWRDASQLVALAKGEAVGTQIQP

SEQ ID NO: 4878 - protein, 386 aa, Dechloromonas aromatica RCB
MYRPARRLADIEPFHVVELLTRARQLEAEGRDIIHMEVGEPDFPTPEPIANSAINAIKSGKTLYTQALGLPELREAISQFYGQRYGASVPASRIAVTNGASGALNLAFACLADPGSEWLLTDPGYPCNRHILRAYEGCPQNIPVGPDTNFQPTPELLRRHWKSTTAGLLVASPANPTGTLLTLPEIAGLSEVCREKNGHFLVDEIYHGLTYEIDAPTACAAGEDIWVINSFSKYFQMTGWRLGWMVIPEAYVRDVEKLAQNLTLCPSTPAQHAALAAFEPETIAILESRRSEFRRRRDFLAPALEAIGFRITARPEGAFYLYCDCSALADDSFALAKDLLEKTGVAATPGLDFGSNQPEKHIRFAYTTGVERLAEAVERLSRYFGR

SEQ ID NO: 4879 - protein, 127 aa, Nicotiana tabacum
NDDLRRGKPTNHKVYGEDVAVLAGDSLLAFAFEYIATATAGVSPSRILAAIGELAKSIGTEGLVAGQVADIACTGNPNVGLDTLEFIHIHKTAALLEASVVLGAILGGGTDEEVEKLRIFARCIGLL

SEQ ID NO: 4880 - protein, 269 aa, Vibrio fischeri
  misc_feature (6)..(6): Xaa can be any naturally occurring amino acid
  misc_feature (16)..(17): Xaa can be any naturally occurring amino acid
  misc_feature (159)..(159): Xaa can be any naturally occurring amino acid
LSQPEXMAHLFQYDSXXGRFQHKVTHNQEYLYIDLPHGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVXDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQ

SEQ ID NO: 4881 - protein, 759 aa, Dechloromonas aromatica RCB
MDSRQLREAALYYHREPKPGKIAVTPIKQLTNQYDLSMAYSPGVAFACEEIVADPREASTLTSRANLVGVITNGTAVLGLGAIGPLAAKPVMEGKGVLFKKFANIDVFDIEIEERDPDKLIDTIASLEPTFGGINLEDIKAPECFYIEKKLRERMKIPVFHDDQHGTAIVVGAAILNGLHLIGKDLAKVKIVTSGAGAAALACLDLLVMLGAPPSNIWVTDIKGLVYEGRVEEMDEIKARYAKVTDARTLGEVIADADVFLGLSAGGVLKPEMVAKMASNPLIMALANPTPEITPELVKSVRNDAIICTGRSDYPNQVNNVLCFPFIFRGALDVGATTITEEMKMAAVKAIAELARAEQSEVAARAYGEKVASFGPEYLIPNPFDPRLIVKIAPAVAKAGMDSGVATRPIKDWDAYIQGLNEFVYHSGMIMKPVFSQAKMAPKRIVFAEGEDERVLRAVQVVRDEGIAWPILIGRHAEINRRIEVAGLRIREGEDFEVVHSDNSAFFDEHYEEFWQTYHGLMERKGVSPDYARREVRRRNTLYGALMVRLGYADGLICGTFGRHETHREYVQSVIGTRADHDRYYAMNLLMLPERTVFIGDTYVNYDPTAEQLADMTLLAAEEIRNFGIVPKVALLSHSTFGTEDTPTSVKMRDVLAQLKQRAPDLEVEGEMHGDAALDEQIRKAAFPNSRLKGQANLLVMPTLDAANISFNLLKVAAGDNLTIGPILLGAAKPVNILTPTATVRRIVNMTALTVVDAV

SEQ ID NO: 4882 - protein, 490 aa, Physcomitrella patens subsp. patens
MVQLNEAGLFKSQGLIGDKWVDAENGHTLPVNNPATGEILTSVPFMGKREAEKAIAAASQAFTSWSKRTANDRSKILRQWFNLLIKNKDDLGKLIVLEQGKPLAEAVGEVIVYGAAFVEYYAEEAKRVYGDIIPSPFPEKRMLVMKQPVGVVAAIAPWNFPLAMITRKVPPALAAGCTVVIKPSELTPLTALAAAELALQAGIPPGVVNVVMGDAKGIGDAMLDSTEVRKITFTGSTGVGKMLLAGAGKTVKKVSLELGGNAPCIVFDDANLDVAVKGVLAGKYRNSGQTCVCINKIFVQDGIYDKFAEAFAKAVSGLRAGNGLEPGITQGPLINETALEKVERHVQDAVSKGAKVLVGGKRHSLGRTFYEPTILGNASDEMLIFREEVFGPVAPLVRFNTDEEAIKLANNSEFGLAAYAFTENITRGWRVAESLEFGMVGLNEGLISTEVAPFGGMKQSGLGREGSKYGLDEYLEMKYVCLGNMAQPVG

SEQ ID NO: 4883 - protein, 227 aa, Picea mariana
AILIDWLIEVHLKFELMPETLYLTVNIIDRYLSIEIVTRKNLQLVGITAMLLACKYEEIWAPEINDFVCISAKEYASEQLVAMEHTILNQLKFNLTVPTPYVFLVRFLKAAGSDKEMENLAFFLVDLSLLHYIMIKYSPSMLAAAAVYTAQCTLKKSSPWSKTLILHTGYSEADLKECAHFMVNFHLNAGGSKLRVVHKKYSDPFFGCVAFLSPANLPVDDSCSSSN

SEQ ID NO: 4884 - protein, 135 aa, Zea mays
FLLLGFVTHGKGVLSHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 4885 - protein, 138 aa, Salmonella enterica
LGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4886 - protein, 386 aa, Thiobacillus denitrificans ATCC 25259
MNLHEYQAKQVLRSSNLNTPRGIAATSADAAADAARELGGEAWVVKAQIHAGGRGKAGGVKVVTSIDAVRSVAAALLGKPLVTVQNAPDGQPVHTVLVEETLPIARELYLSLLVDRASERVAVVASAAGGMDIEQVAHATPEKVLTEICDPLLGVQDFQCRALAFALGLGGDAYKDFCRLLPQLYRVFVANDLSLLEINPLVVTTDNRVLPLDCKMSVDDNALYRRKALADLRDDSQIDAKEAAANAANVNYVALAGNIGCMVNGAGLAMATMDLIQLEGGAPANFLDVGGGATPETVAQGFKIILLDPNVKAVLINIFGGIVRCDVIAEGIIQAVREVGVEVPVIVRLEGTNAELGRTLLAESGLAIVAAESLTQAAKFAVEKAA

SEQ ID NO: 4887 - protein, 297 aa, Rhizobium leguminosarum bv. viciae 3841
MRAYIVGNVAIDETIAVSELPVTGASILGNAGGSDLGGKGTNQAVVMARCGVSTTLVAPVGKDARADTIRHYLADEPLRSELIEMEDASSDVSIIFRLPGGENAIVTTTESAQSLSLSDVRRILSTAGSGDLMILQGNLSDRTTRDILEHARAIGMVTAFNPSPVRSYFSDLWDLIDIAFLNKGEAQALTGTTGRDAAEYLLSRGLREIVLTLGGDGATLVNRHDSIEVPAQVCEVVDTTGAGDTFMAAALASCALRGQRLDRLAIEHAVAAAAITVSRHGTRKAFPTISELEAILR

SEQ ID NO: 4888 - protein, 528 aa, Pseudomonas putida
MASVHGTTYELLRRQGIDTVFGNPGSNALPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 4889 - protein, 122 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 4890 - protein, 331 aa, Oryza sativa
  misc_feature (264)..(264): Xaa can be any naturally occurring amino acid
MLRMAAKRISIIGSGNWGSTIAKIIGKNVAHNAKFDPQVKMYVYEELIHGRKLTEIINTEHENVKYLPGHKLPENVFATPDVIDAAKDADIIIFVLPHQFIATTCKPLVGHVKSDAFGVSLCKGFYVNEKGRLDLISNMIRNLLGIDCGVLMGANIANEVAAELFCEATVGSRNLDYGNLLKEALQTNYFRIAVSKDAECVEACGALKNIVAVGAGFCDGLEFGDNTKAAIIRLGLMEIIRYCEVFFPGGNPRTFFESCGVADXVTTCYGRSKSTSWRAFAKAHGKKSIEELEKEMLNGPKLQSPENRLKINILFKIKKSRFKFSLCSWPF

SEQ ID NO: 4891 - protein, 338 aa, Neisseria gonorrhoeae FA 1090
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKIQLYSHCRNGGWILGYMIDGTQAEYVRTPYADNSLVPPHDNVNEEIALLLSDALPTAHEIGVQYGDVKPGDTVFIAGAGPVGMSALLTAQLYSPAAIIVCDMDENRLKPAKELGATHTISPASGDVSKQVFAIVGEDGVDCAIEAVGIPATWNMCQDIVKPGGHIAVVGVHGQSVDFKLEKLWIKNLAITTGLVNANTTEILMKAIFSSSVDYTKMLTHRFKFSQLEKPTTCSNTPPKTKR

SEQ ID NO: 4892 - protein, 711 aa, Xanthomonas campestris pv. campestris str. ATCC 33913
MKFFASCAKGLEYLLADELLALGASKATATISGVNVEGALRDAQRAVLWSRLASRVLWPLTEFDCPDEDALYAGVAELPWHEHLSTGHTLSVDAHVSGTAITHARYAAQRIKDAVVDTIRRQGLERPSVDVESPDLRLNLSLRKGRATISVDLGGGPLHRRGWRMAQNEAPLKENLAAAVLLRAGWPRAYADGGGLLDPMCGSGTLLIEGALMAADVAPGLQRYGSDIPSRWRGFDRDSWQQLVTEARERDSVGRAALKQVIHGSDMDPHAIRAAKENAQVAGVAEAIWFGVREVGDLQTRPQATGVVVCNPPYDERLAADAALYRKLGDTLQRVVPQWRASLLCGNAELAYATGLRAGKKYQLFNGAIECALIVCDPIAVPRRTPLAAPTALSEGAQMVANRLRKNLQKFKKWRAREGIECFRVYDADLPEYSAAIDVYQQADGDRRIFLHVQEYAAPATIPEADVRRRLGELLAAAREVFEVPAERVALKSRERGKGGSKYGRFEQRNEIVNVREHGALLRVNLFDYLDTGLFLDHRPLRGTMAQQSKGRRFLNLFCYTGVASVQAAVAGASATTSVDLSGTYLQWCADNLALNGQAGSKHKLVQADALAWLEAERAHFDVIFCDPPTFSNSARAEDFDIQREHVRLLRAAVARLAPGGVLYFSNNFRRFKLDEEAVSEFAQCEEISPRTIDPDFERHARIHRAWRLTA

SEQ ID NO: 4893 - protein, 329 aa, Rhodococcus erythropolis
MKLLVTGGAGYVGSVCSTVLLERGHEVVVIDDLSTGNADAVPAGAEFIEGDVGALAADVLGSAGSPVFDGVLHFAAQSLVGESVLHPEKYWRGNVVTTIELLEAIRVSGTPRLVFSSTAATYGEPEQSPIVETAPTRPTNPYGATKLAIDHAITSYSIAHGLGATSLRYFNVAGAYKSAGENRVIETHLIPLVLQVALEQRDKISVFGTDWPTPDGTAVRDYIHVLDLAEAHLLALESSVPGEHRIYNLGSGAGFSVREVIAACARVTGLPINVEDASRRLGDPAVLIASSDKAIAELGWTPTRTDLDVIVADAWQFLQDLGDRSHAAR

SEQ ID NO: 4894 - protein, 481 aa, Neisseria gonorrhoeae FA 1090
MSTQTNFDLVLFGATGDLAMRKLLPCLYQAHVAGLLHPEGRILGVSRSELDTEGFLAKVETSSKIHVKENFSGEAWASFVERLAYLKVDVTQPDDFAALGDLVKARKETDNVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPAGLDADAVRDEKVKVIKSLKPLTIESVNENVVRGQYTAAKGMNGYLEEINVPQDSFTETYVAIKAEIENERWKGVPFYLRTGKRMAGKVAEIVLNFRPLQNHIFDNSQTAPNRLVIELQPNESVRLYTQVKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 4895 - protein, 580 aa, Ostreococcus tauri
MSDARTRSRGTVDIDGETLKRADRGRRGRESGDRRSETNAVAAAGEDGGERDADALRVLLATDDAHTRGMVHKMLRELGVEVVMATNGKEVLEVLRGRPKGVAAAAEDVSVDMILLDVLMPALDGEVELVEVCKSNEALRGVPIVIMSTVDERKACGTRYEHSGAAGFLTKPVNRTELKESLSHTRMLKSHESGSAENDGSGNDPNVGSAKSSLTKLTNGEKAAGGSGDGGSGGGGSGQGQNDSGSDNVRLYNEGNEKSRRREAEAMDRWASREGGSGDCGSGGSGQGTGSGSGSHEGSGSGQRDSNENEKFRGLSVQLIKAHGGATTMLELSLPEHSSEHVVVRRSNSRSAFKGFQTYLKSEKKESSVQMMSLDLTQQQHQSFYEASSMMPPADFARFYGPIMPAGMPPPPMDLPLPPPPYIDMNQFTAAAFTSASIRPDMMDSTANPFWSVLQTAADHTQQTSSSQAAEHRAAAIRRFLKKRKERNFDKKVRYASRQQLAASRPRLRGQFVRNAEETTTENGSNGSDGKKSNEFNASAAKGEVQGREEQYVDRHGSNTGTSNEGSKEGSRSSSRDGSK

SEQ ID NO: 4896 - protein, 482 aa, Clostridium perfringens str. 13
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 4897 - protein, 542 aa, Escherichia coli CFT073
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEIDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTIEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 4898 - protein, 340 aa, Prochlorococcus marinus str. NATL1A
MTLRVAINGFGRIGRNFMRCWLSRGANTNIEVVGINVTSDPKTCAHLLKYDSILGAIKDAQISHTDDTFQINGKTIKCYSDRNPLNLPWKEWGIDLVIESTGVFNTDVGASKHLQVGAKKVILTAPGKGDGVGTYVVGVNADSYSHEDFDILSNASCTTNCLAPIVKVLDQKLGINKGLMTTIHSYTGDQRILDNAHRDLRRARAAAMNLVPTSTGAAKAVALVYPQMKGKLTGIAMRVPTPNVSAVDLVFESGRKTSAEEVNSLLKTASQGEMKGIIKYGDLPLVSTDYAGTNESTIVDEALTMCIDDNMVKVLAWYDNEWGYSQRVVDLAEIVAQKWK

SEQ ID NO: 4899 - protein, 548 aa, Neisseria gonorrhoeae FA 1090
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMCGKTPDEVRAELKAQGMDEARIEELVPHKTFSGNRPTNLILMDKVNPRNMGSLIAMYEHKTFVQGIIWGINSFDQWGVELGKQLAKTILGELTGETEPQKHDSSTERLINLYLQTNRK

SEQ ID NO: 4900 - protein, 119 aa, Oryza sativa Indica Group
MAEVNPKAYPLADSQLAQAIQELVSQAANYKQLKKGANEGIAEFVVMAADAEPLEILLHLPLLAEDKNVPYVFVPSKQALGRACGVTRPVIACSVTSNEASNLRDPINNLKVAIEKLLI

SEQ ID NO: 4901 - protein, 405 aa, Puccinia triticina
MASAAVALPSSATGGSMNPTAPASTSVNATTINITNAPANKPKQAGSRAVGEPRRVRFNVGSKYHVMDVIGEGAYGVVCSAIHRPTGQKVAIKKIVPFDHSMFCLRTLRELKLLKYFQEHNVSENIVSIVDIIRPPTIEAFKEVYLIQELMETDMHRVIRTQVLSDDHCQYFIYPTLRAMKALHSADVIHRDLKPSNLLLNANCDLKVCEFGLARSIRTAEQETGFMTEYVATRWHRAPEIMLTFKQYTKAIDVWSVGCILGEMLSGRPLFPGRDYHHQLTLILDVLGTPTLDEFYAINSRRSRDYIRALPLRKKRPFATIYPNASPLAIDFLTKTLTFDPKKRLTVEEALQHPYLEAYHDPEDEPTAPPLDEDFFAFDRQKDEISKEELKRLLFEEINSFHFTT

SEQ ID NO: 4902 - protein, 301 aa, Shewanella sp. MR-7
MKHLLSIKELTQQQLLDLITLAKTIKANPAEYRHALDGKSVVMLFEKPSLRTRVSFDIGINKLGGHCLYLDQQNGALGKRESVADFASNLSCWADAIVARTFSHKTIEQLAEFGTVPVINALSDLYHPCQALADFLTLAEHFENISDVKLAYVGDGNNVTNSLMYCAAILGATMTVICPAGHFPDGYVVAEVQELASRYGGKVVLTSDIGAIEGHDAIYTDTWISMGDPTPLAEIKDKFAPYQVNKGLMTKAGAHFFMHCLPAHRGVEVTDEVMDGEGSLILQQAENRMHAQNAVLVTLFS

SEQ ID NO: 4903 - protein, 366 aa, Phanerochaete chrysosporium
MSDPSAHGKLDLRVGGKYRLGKKIGSGSFGDIYLGINIISGEEVAIKLESVKAKHPQLEYESKVYKTLAGGVGVPFVRWFGTECDYNAMVIDLLGPSLEDLFNFCNRKFSLKTVLLLADQLISRIEYIHSRNFIHRDIKPDNFLMGIGKRGNQVNVIDFGLAKKYRDPKTHLHIPYRENKNLTGTARYTSINTHLGVEQARRDDLESLAYVLMYFLRGSLPWQGLKAATKKQKYDRIMEKKMTTPTGLLCRGFPNEFGIFLNYTRALRFDDKPDYSYLRKLFRDLFVREGYQYDYVFDWSVQRGQMEEQGQSSSSKVAGRRKVVQEEDHRGTDRMLRSHTRQQQQQAGVVPGAVGQQRRGRDGDMW

SEQ ID NO: 4904 - protein, 965 aa, Cryptococcus neoformans var. neoformans B-3501A
MDYNDLDSANGRGLPTGGLTWSNEGPVLQMEDAVVETVVTHTTRTTTSFQPITLPRVPSPEHLKLPNHLPGEKYPLADQPAPSDMRLFTMTLGGRRVIVQDESASGESGIEMSGPGWTRTLLNGSMTEAENGVDVADESLTFLQALNRSKGKEKKREYEERSDAPASPVANDISARRSPPRKKIRGLDEINIPTAPTAQAPNMGSGVELSALFSLPSLVSHFDTLPDRLQQHFLMHLLRRSRMPTLQRISNFVSTALRRDFITQLPHEVAIQILKSVDGKSLASASRVCKKWKRIIDMERSVWKARLLDDKLWSGFGTEEQEESLVLERYEALDLHDQLEGRRTSYQAVSGEDEQMFSPTLGHDLRERPTPLKHVYRRRYQDQKNWIHTRPEHSSFTGQGTNVVTCLQFDEDKIVSASDDHSINIYNTNDGQLRKRLDGHEGGVWTLQYKGHTLVSGSTDRTVRIWDLEDLRMTYVFAGHTSTVRCLQIVEPVWEEETQSYQPPVPMIVTGSRDATLRVWKLPQKDDPLYDGIVEEEQTELIGPDVNPFHMHLLEGHSLAVRTIATHGRICVSGSYDMSVRVWDIVKGTSLHVLTGHEDKVYSIVYDPYRKRCASGSLDSTVKVWDIVSGQCLHTLQGHTSLVGLLGLSPNYLVSAAADSSLRIWDPNTCQLKNVLASHSGAITCFQHDETKVISGSDGTLKLWDVKTGTFVRDLVVGISAVWQVSFNKNLLVAASNRNGATVFDVFRFGQSSTQDVDDPSLDNLQPPRWERWAAEKRRRLEMEEKKKRKSRSRKARTESAWDDRLEKVRDPRMASWKTTLPYAPTGHLGYSVEGEEPDERVGLQPPPAFGFRTGSHAGSSKGNSPYQLSSAQSGSNNVVRRGLHDLSGSPTPTGVARRRAGLMISKVPRAEGSNGASAALPPGSVVGPLDIGESSASTAVVEDNYQDDEGEEDEEMENADEHSY

SEQ ID NO: 4905 - protein, 255 aa, Photorhabdus luminescens subsp. laumondii TTO1
MRHPLVMGNWKLNGSTHMVNELITGLRQELSSVTGCDVAIAPPALYLSQAKQALAGSRIALGAQDVDVNLSGAFTGETSATMLKDIGAEYIIIGHSERRTYHQESDEFIAKKFAILKQQGLIPVLCIGETEQENEAGQTESVCARQIDAVLNTLGVAAFQGAVIAYEPVWAIGTGKSATPAQAQAVHKFIRDHIAQKDAAIAQQIIIQYGGSVNADNAAELFSQPDIDGALVGGASLKANAFAVIVKAAAAAKKA

SEQ ID NO: 4906 - protein, 222 aa, Saccharomyces cerevisiae
QFNPYGDNGGTILGIAGEDFAVLAGDTRNITDYSINSRYEPKVFDCGDNIVMSANGFAADGDALVKRFKNSVKWYHFDHNDKKLSINSAARNIQHLLYGKRFFPYYVHTIIAGLDEDGKGAVYSFDPVGSYEREQCRAGGAAASLIMPFLDNQVNFKNQYEPGTNGKVKKPLKYLSVEEVIKLVRDSFTSATERHIQVGDGLEILIVTKDGVRKEFYELKRD

SEQ ID NO: 4907 - protein, 421 aa, Vigna radiata
MDSFSRLSIFCLFISLLPLFSSPALLFQGFNWESSKKGGWYNSLKNSIPDLANAGITHVWLPPPSQSVSPEGYLPGRLYDLDASRYGSKNELKSLIAAFHEKGIKCLADIVINHRTAERKDGRGIYCIFEGGTPDSRLDWGPSFICRDDTAYSDGTGNNDSGEGYDAAPDIDHLNPQVQRELSEWMNWLKTEIGFDGWRFDFVKGYAPSISKIYMEQTRPDFAVGEKWDAISYGQDGKPNYNQDSHRGALVNWVESAGGAITAFDFTTKGILQAAVQGELWRLIDPNGKPPGMIGVKPENAVTFIDNHDTGSTQRLWPFPSDKVMQGYAYILTHPGTPSIFYDHFFDWGLKEQIAKLSSIRLRNGINEKSSVKIMASEGDLYVAKIDNKIMVKIGPKMDLGNLIPSNLHVATSGQDYAVWE

SEQ ID NO: 4908 - protein, 635 aa, Brucella melitensis 16M
MPKSGVFKATSSTIFKYQEHSMVANGGSLYLQSLMILGGAIIAAPLFKRLGLGTVLGYLAAGITIGPVARLIADGEEFLHFSELGVVFLLFIIGLELNPSRLWSLRHSIFGLGTAQVLLCGAALAALGVYLAGLDTEAAIIIGFGLALSSTAFAMQVLEDRAETNQKHGQRAFAILLFQDLAIVPILAIIPALSPNEPSQASAGFHLATAIASIAALVIAGRYLINPMFRIIANTGAREVMIAAALFVVLGSASLLQYAGLSMAMGAFIAGVLLAESSYRHELEADIEPFRGIFLGLFFVAVGLSLNLSVILEYWAVILAAVPIFMATKIVIIYLLCRIFRSSHNDAVRIAFLLPQGGEFAFVLFSAASAAAIISCALGSELVAAVTVSMALTPLSVAIGSRLLIKDKADDIIEENFDGAGSDVLMIGFSRYGQIAAQILLAGGIDVTVIDSSSNRVRAAGKFGFRIYFGDGTRKDVLEAAGIRKAKIVAICTHKKSTTNHIVNLIQSEYPDVRLFVRSYDREHTLQLRAQGVEYELRETFESGLLFGQRTLEGLGLSEANAYAIREDVRQRDEDRLHVQASEGIMAGRHLLFNKPVTPEPLVKPTREGQRIDKSDDGQRAPSPQETAAAPVAAE

SEQ ID NO: 4909 - protein, 604 aa, Moritella sp. PE36
MTNRLPQKISSTISTLNDLAKLANYSLMDTLNCDPDATENGADHVPRQVFSGHYVPVNPTPIKDPEYVAHSKNFFSELGFADSMVESTDFVRMFSGDISQVPEPMRKVGWASGYALSIYGTEYIQQCPFQTGNGYGDGRAISVLEAVINGRRWEMQLKGGGRTPYCRGADGRAVLRSSIREFLAQEHMHALGVPTSRSLSLYVSKTETVKRPWYSQGSRSENPDMLISEAVAISTRVAPSFIRVGQLELFARRTRKNEHPKAMEELEKIVLHLIDREYAVAADVVDRQLTTPEKVVLLAREFQRRLTSLVANWIRVGFCQGNFNSDNCAVGGFTLDYGPFGFCDVFNPYYQPWTGGGRHFSFMNQPSAAQRNFDMFCSALRPLLASHQDCLLALDEVQSGFSKVMHTQMDSMWAAKLGLDLDIGTFNTTSHQALCKTLYKELLSELETLMMQTPVDYTIFFRELSSIPDDISPLKKSFYNNMAHDSDLKKRESKEMDKRWAAWLGKWKMLLNSASDANATSPRSNEAISRQMKLVNPKYILREWFVMPAYQQATAGNYALIRELQDVMTQPYAEQSKDMEDKYYRLKPPEFFAVGGLSHLSCSS

SEQ ID NO: 4910 - protein, 822 aa, Oryza sativa
MEIARQLSVAYYQRPAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGEAERACRVAFWCIQDDENARPAMATVVQVLEGLVEIGVPPIPRSLQFLAELADQSNYLQFFSDLLPSN

SEQ ID NO: 4911 - protein, 103 aa, Glycine max
CYPREEGVPDSFARIIAPRIAVATSLLHFTGIDDVFTSSRGSTKTLGNFVKATFDCLMKTYGFLTPEFWKETRFSKSPFQEYTDLLAKPTGKTLILEEERVDA

SEQ ID NO: 4912 - protein, 185 aa, Candida albicans SC5314
MIGETISNSDLIRSIHNSFSAPHSFVDEDKPPPPPDRDDKDDGLFHFVGYIFKQGKIYELDGLKQYPISHGECSGQDEFIQKLPTIVQERISKYGNELRFSLLAVTNNKLEQAQAMGDQEEIASQLHKRELWKKENELRKHDYTGLIVQLLKNISKEKSDKEWEDFLQKGRNKTQQLIAQSIKKT

SEQ ID NO: 4913 - protein, 94 aa, Picea mariana
TGIVSFSYVQKVSEKVSLASDFMYNHMSRDSTASVGYDYLLRQCRLRGRIDTNGCVAAYLEERLNMGVNFVLSAEIDHWKKDYKFGFGMTVGEL

SEQ ID NO: 4914 - protein, 557 aa, Nostoc punctiforme PCC 73102
MAISNILKEPQLLRLNRWFSGLRGDLTGGLTAAVVALPLALAFAVASGVEPKAGLYTAIVAGIVAAIFGGSPVQITGPTGAMAVVLVGIVAKYGLEKVWIAGVMAGIIQIALGVAKLGQLVKFIPYPVTAGFTNGIAVIIFCGQLNNFFGLRIPRSEHFLPGLWQSLTHVEALNWAAVGLATLVMAANIFWPRINTTIPGSLVGLVLATGIATYFHLDVPTIGSIPQSLPMPQGIPHWNDFSVIRELINPALALAALGSIESLLSAVVADGMTVSEKHNSDRELIGQGLANIIIPFFGGIPATGAIARTAVNVRSGGKTRLSGVIHGVALAIIVLTLAPLAAQIPLAALAGILMVVSVRMIEWEAIGLLMRATYSDFAVMILTWLVTILFDLVLAVEVGLIAAGALFIKRMSDLSLVKIPETEVFPPGTPLELGKEIAVYRIDGPVFFGAAERFATFLRDEPEVKYLILRLRFVPNMDTTGLVALEDIYHDLERHNCRLILTGLQPEVKQLLERTGLLKTIGLSNCFETTTDAICSISPQIQRCSQPVAADLKELND

SEQ ID NO: 4915 - protein, 435 aa, Nostoc punctiforme PCC 73102
MTPPENKPSLPEVHRSIGVPNSSSFWRKMMAYTGPGYLVSVGYIDPGNWATDIAGGSRFGYTLLTVILLSNLMAILLQSLCVRLGVATGRDLAQACRDYFSPKVSFCLWVLCEIAIAACDLAELLGSAIALQLLFGIPLVWGVCITAVDVLLLLFLQHKGFRYTEALVIMLVGTVGICFTAEILFSRPDMGGILLGYLPKKEILQNPEMLYIAIGILGATVMPHNLYLHSSIVQTRSWQPNTEKRWEAIKFGTIDSTFALSLALFINSAILIVSAATFHFSGNQHVAEIQDAYKLLSPLLGVSAASAIFGIALLASGQSSTLTATLAGQIVMEGFLQFRFPSWLRRLITRLIAIIPALITIIIFGENSTSSLIVLSQVILSLQLPFAVIPLVMFTSNRRLMGEFVNPLWLKSLAWLVAIVIVGLNIWLLLQSILG

SEQ ID NO: 4916 - protein, 305 aa, Clostridium tetani E88
MKIYNNLIELIGKTPLVNLNKFEKKNGLDSNIIAKVEYFNPSGSVKDRAALSMIEEAERTNLINKDTVIIEPTSGNTGIGLALICAIKGYRLILTMPETMSIERRNILKAYGAEVVLTPGNKGMNGSIQKAEELAKEMGNVFIPQQFNNPSNSAIHKITTAKEIINDLDGKVDIFIAGVGTGGTVTGVGEGLKEYNKNIKIVAVEPENSPILSGGKPGPHKIQGIGAGFIPEILDMNIIDEIFKAPNEESIEIMKKIVKLEGLFVGISSGAALYAAKEIGKREENKGKNIVVLLPDTGMRYLSSY

SEQ ID NO: 4917 - protein, 310 aa, Nostoc punctiforme PCC 73102
MSIIVFGSINIDLVATTPRLPVPGETLLGEEFFKVSGGKGANQAVALAKLGIPTQMVGRVGADDFGVELVNNLQSSGVQIDNIFVDETVSSGVAIIAVNHAGENQIIVIPGANGRVNQEDVERLSQLLPEATALLLQLEIPITTVIAAATAARKSKIRVILDPAPAQSNFPDELYPLVDIITPNEVEAAQLVGFPVDGEEQAAKAAEVLLQRGVKCAIVKLGAKGVFCATAEEKFFVPVFPVHAVDTVAAGDAFNGGLTAALFAGFSLHQAVVWGAAAGALATTKSGAQTSLPDRFTFDAFLREKASVRD

SEQ ID NO: 4918 - protein, 135 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 4919 - protein, 298 aa, Prochlorococcus marinus str. NATL1A
MIQEIVKRSKPLPPKSKLIIFGGGFSGQRIASVGRHLGVKVLCSRRREGSKGANFIFNTDQEFTNEVLEGATHVLSCIPPLLSGEDPVLLKLKTQLLNAKKIKWVGYLSTTGVYGDSKGNWVNENTPPNPLQERSIRRLSCEKQWLDTKLPIQILRLPGIYGPGRSVFESLLNGTTKMIDKPGQVFSRIHVDDIAGSVLFLINLYFQGKTPSIVNVADNLPANNLDVINFAANIAKKSLPSKVPFEIAQKTMSPMAKSFWQENRKVDNKLLCKKLGYSLIYPDFKSGLKNCYFQQKIN

SEQ ID NO: 4920 - protein, 219 aa, Debaryomyces hansenii CBS767
MSDPINANPTVIDVSNLPTRFDDSEIQEKEVARNTELVDRILSLSLLNQGSLTHTDTELMPDLVSDVEADTSSMEEELLDETDDQEEEDVIDAQEIFDLISTISDPEHPLTLAQLAVVNLVDIKVTHGANKHTDISEILIKITPTITHCSLATLIGLGIRVRLERCLPPRFRIIILIKEGTHQSENQVNKQLNDKERVAAACENDQLLSVILQMLSTCK

SEQ ID NO: 4921 - protein, 415 aa, Photobacterium sp. SKA34
MTEDFRQQALDYHSLPTPGKIAVALTKSANTVEDLALAYSPGVAEPVREIAQDPDNVYKYTAKGNMVAVITNGTAILGLGNLGPLASKPVMEGKSLLFKRFAGIDSIDIEVKHRTIDEFVDTVANIADTFGGINLEDIKAPDCFEIEQRLIERCNVPVFHDDQHGTAIVTAAGMINALELQGKEISEAMIVCLGAGAAAVACMELLIKCGAQREKIYMLDRKGVIHTRRDDINEYKQLFANNTDKRTLEDVIAGADIFVGVSGPDLLQPDALALMAENPIVFACSNPDPEIKPELAHQVRDDLIMGTGRSDYPNQVNNVLCFPFIFRGALDVRASQINDEMKLAAVHAIRELAKEPVPQSVLEASGAPHLEFGRDYIIPKPMDPRLLPRVAKAVAQAAIDSGVARIEMPMGYMEV

SEQ ID NO: 4922 - protein, 332 aa, Ralstonia eutropha JMP134
MSSNNGKPKLKTSAMIASIAGEGQATRSAPFGHALVELAKQKSNVIGMTADLGKYTDLHILAQAFPERYYQMGMAEQLLMGAAAGFAHEGAQPFVTTYAVFATRRAYDFMHQTIAEDNLDVKIVCALPGLTTGYGPSHQAAEDLALMRAMPNMTVIDPCDATDIEQMVPAIAAHAGPVYARLLRGNVPVVLDEYDYKFELGKAKLLRDGADVLVISSGIMTMRALEVAKALEKDRVGVAVLHVPTIKPLDTETIVREARRSGRLVVVAENHTVIGGLGEAVATALMQAGVHPPFRQVALPDLFLDAGALPTLHDRYGISTQVMAANIKGWLV

SEQ ID NO: 4923 - protein, 384 aa, Prochlorococcus marinus str. NATL1A
MQDKLNLMIPGPTPVPENVLSSMSKHPIGHRSGDFQKIVQKTTEQLKWLHQTTADVLTITGSGTAAMEAGIINTLSKGDQVICGDNGKFGERWVKVARAYGLDVKVVKADWGTPLDPNQFKRILEEDTNEKIKAVILTHSETSTGVINDLKSINNEVKNHSKAITIADCVTSLGACNIPMDEWGIDVIASGSQKGYMIPPGLSFVAMSKRAWEANNQSNLPKFYLDLKQYLKTVNQNSNPFTPAINLYFALEASLTMMQKEGLNNIFARHARHQKATQEGIKAMGLNLFTKENFGSPAITAVKPENIDAESIRKAIKNDFDILLAGGQDHLKGKIFRIGHLGFVNNRDIISVISALESTLDKMGKLNVPIGQGIAKTISVLNNE

SEQ ID NO: 4924 - protein, 1390 aa, Arabidopsis thaliana
MSQTDGVEFASRNTNENGHDDDDQLRSQWVAIERSPTFERITTALFCKRDEKGKKSQRRVMDVSKLDDLDRRLFIDDLIRHVENDNHVLLQKIRKRIDEVGIDLPKIEARFSDLFVEAECEVVYGKPIPTLWNAISSKLSRFMCSNQAKKISILKGVSGIIRPKRMTLLLGPPSCGKTTLLLALSGRLDPSLKTRGDISYNGHLFSEFVPEKTSSYVSQNDLHIPELSVRETLDFSGCFQGTGSRLEMTKEISRREKLKGIVPDPDIDAYMKAASIEGSKTNLQTDYILKILGLTICADTRVGDASRPGISGGQKRRLTTGEMIVGPIKTLFMDEISNGLDSSTTFQILSCLQQFARLSEGTILVSLLQPAPETFELFDDLILMGEGKIIYHGPRDFVCSFFEDCGFKCPNRKSVAEFLQEVISRKDQEQYWCHIEKTYCYVSIESFIEKFKKSDLGLELQDRLSKTYDKSQTQKDGLCFRKYSLSNWDMLKACSRREFLLMKRNSFVYVFKSGLLIFIGFIAMTVYLRTGSTRDSLHANYLMGSLFFSLFKLLADGLPELTLTISRIAVFCKQKELYFYPAWAYAIPSAILKIPISFLESFLWTMLTYYVIGYSPEMGRFIRQFLILFALHLSCISMFRAIAAVFRDFVVATTVGSISIVLLSVFGGFIVRKPSMPSWLEWGFWLSPLSYAEIGLTANEFFAPRWGKITSENRTLGEQVLDARGLNFGNQSYWNAFGALIGFTLFFNTVFALALTFLKTSQRSRVIVSHEKNTQSSENDSKIASRFKNALPFEPLTFTFQDVQYIIETPQGKKLQLLSGVTGAFKPGVLTALMGVSGAGKTTLLDVLSGRKTFGDIKGQIEVGGYVKVQDTFSRVSGYCEQFDIHSPNLTVQESLKYSAWLRLTSNISSETKCAIVNEVLETIELEEIKDSIVGIPGISGLTTEQRKRLTIAVELVSNPSIIFMDEPTTGLDARAAAIVMRAVKNIAETGRTVVCTIHQPSIDIFEAFDELILMKNGGKIIYYGPLGQHSSKVIEYFMRIHGVPKLKENSNPATWILDITSKSSEDKLGVDLAQMYEESTLFKENKMVIEQTRCTSLGSERLILSSRYAQTSWEQFKACLWKQHLSYWRNPSYNLTRIIFMSFTCMLCGILFWQKAKEINNQQDLFNVFGSMFTVVLFSGINNCSTVLFSVATERNVFYRERFSRMYNSWAYSLAQVLVEIPYSLFQSIVYVIIVYPMVGYHWSVFKVFWSFYSIFCTLLIFNYFGMLLVVVTPNVHIAFTLRSSFYAIVNLFAGYVMPKPNIPRWWIWMYYLSPTSWVLNGLLTSQYGDMEKEILAFGEKKKVSDFLEDYFGYRYDSLALVAVVLIAFPILLASLFAFFIGKLNFQKK

SEQ ID NO: 4925 - protein, 528 aa, Prochlorococcus marinus str. NATL1A
MASMISAEKRNPAIVILDFGSQYSELIARRIRETEVYSLVMSYTTSADKLRSLKPKGIILSGGPGSVYEEGAPYCDPEIFNLGIPVLGVCYGMQLMVHELGGSVKPATGKAEYGKAPLEVDDPTALLTNVISGSTMWMSHGDSVQKLPKGFVRLAHTSNTLEAAIALHDKSFYGVQFHPEVVHSTHGMVVIRNFVYDICSCEPDWTTNLFIDEAVSQVQQQVGDKKVLLALSGGVDSSTLAFLLNKAIGPQLTCMFIDQGFMRKGEPEFLMSFFDEKFKINVEYINARERFISQLKGVTDPEQKRKIIGREFIRVFEEESLRLGPFDYLAQGTLYPDVIESSGTNIDPKTGERIAVKIKSHHNVGGLPKDLQFKLVEPLRRLFKDEVRKVGKSLGLPDEIVRRHPFPGPGLAIRILGEVTHEKLNCLRDADLIVREEINNAGLYNKIWQAFAVLLPVYSVGVMGDQRTYAWPIVVRCVSSEDGMTADWSRLPYAVLEKISNRIVNEVEGVNRVVLDITSKPPGTIEWE

SEQ ID NO: 4926 - protein, 259 aa, Photobacterium sp. SKA34
MSQGPLVIKLGGAVLSCTETLEKLFSAINHYQANSQRPLMLVHGGGYLVDDLMAKLQLPIVKKQGLRVTPSDQIALIAGALAGTANKLLQGQAIKSGVKAVGLSLADGGLCEVSQLDPELGSVGNAKPGNGTFITQTMAAGYMPIISSIGLDGQGELMNVNADQAAVAVAAAVDGELVLLSDVSGVLDGKGQLVEALTEAEAESLIEQAVITDGMIVKVRAAFDAAKALGRPIEVASWRSPEKLTALFDGESIGTKFTL

SEQ ID NO: 4927 - protein, 468 aa, Pseudomonas putida KT2440
MTQTSPIATDEPHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDGGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPNVVEAFTLVTTVSAVLFMFVWTLILLSYLKYRKDRAALHQASNYKMPGGRFMCYVCLSFFAFILVLLSLEADTRSALVVTPIWFVVLAVTYQLVRSRRHPRTAVRNG

SEQ ID NO: 4928 - protein, 353 aa, Gibberella zeae PH-1
MADFTEYGNATAEWLAVTDSRPPMDPSLSLKEMQAITNMHRENLAKHELEKLGNPEIHMKDYTVTARDGFPLEVRTYRPPSADANARLPIYIHLHGGGYVFGNIPSEDAICTAIALGSNVTVVNLNYRHAPDYAYPTAWDDTEDTFHWVHDHIDELLGNPSQVLIGGISAGAQLSASLTLRQNMSPDGLSRPKLAGQVLMIPALVHPECYAPILEQLTDPSVSSYVQNENAPLLNKAAVEKFTGLLKVSNPDLKDTRLNIGHASVDEVKGMPPTTIGISGLDPLRDEAIFYGKKLVEAGVPTDIHLFKGLPHGFRRFGDQLSESKRWDKTMENGIKWALSNPAATGKFDIKLE

SEQ ID NO: 4929 - protein, 464 aa, Brucella melitensis 16M
MAQAALPEISRLDGVSNFTLPNGMQVVVIPDHRAPVVTQMVWYHVGAADEAPGVSGIAHFLEHLMFKGTKNHPAGEFSARIASIGGQENAFTSYDYTAYFQRVSPEALEMVMDFESDRMENLVLDEEAVKTEREVILEERRMRIDSNPGAMLMENTDAVLFYNHPYRKPVIGWQQEMEKLSLKNAIDFYNQYYTPNNATLVIAGDVTPERVRELAMKTWANVHKRAEVLLRERPQEPAKHAARVVTLHDERVSTPSFRISWLVPSYANEKRFANVKPGDAPALDLLSEILGGSQLSRLYQQLIVKQGIAAETGASYDGDALDDGTFSVYGVPRNGASLGDVEKAVAAQVDRIIRDGVTQAELDQARNRFLKAVIFARDSQTGMARIYGSALSVGQTVDDIQKWPDLIKSVTVDQIKDVARRYLVKDQAVTSYLLPPDTEAESARKKPNAPANDASASGAGGAIQ

SEQ ID NO: 4930 - protein, 654 aa, Allochromatium vinosum
MATSSDEMKMKPTWRRFEDGEHVWDNLTDKIFNQDRSHKCPTYVHKTPPCQGSCPSGEDIRGWLQIVRGMEKPPQGMDWQEYAFRRSTDANPFPAMMGRVCPAPCQDGCNRNELEDFVGINSVEQFIGDTAIANGYTFEAPELDTGKRIAIVGGGPAGLAAAYQLRRKGHSCTIFEANDGLGGMFRFGIPGYRVPRDKLDAEIQRILDMGRVEVRLKTRIGTDVTVEQLEKDYDAILWAIGCQSGRGLPVPGWEGTPNCVTGVAFLKAFNEGRMKVTAGKVVCVGGGDTSIDVVSVARRLGHVNKSNPNELPETVIRDGYVAHDAASAAAAQGAEVTLTSLFTRDKMTASEHEVDDATREGVTILDGVMPVEVIKDANGRAIGLKVADCTMTDGRPTPVEGTERVLEADLIVSAIGQGGDLSGLEQLDNGRGLMDSDKFYQVPGKAGHFVAGDIIRPHLLTTAIGQAWIAADSIDAYVMQAEHKRRPKVDVHHFNLLDKLTEAHLAPESFVAGQAGDMRGTSDANYAIHNYEDRSGAEVIPHEELFLGHFNYVPRNLRKEEVPSADEVLGHFHERVIGLTEPEAIDEAKRCMSCGLCFECDNCVIFCPQDAVFRVDKGSRTTGRYVDTDYAKCIGCHICADVCPTGYIKMGLGE

SEQ ID NO: 4931 - protein, 225 aa, Shewanella sp. MR-7
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKPDYKAVVDEMRAELAKVEVK

SEQ ID NO: 4932 - protein, 589 aa, Populus trichocarpa x Populus deltoides
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLIGGSLADHTFLFLGAGEAGTGIAELIALEMSRRSKTPLEETRKKIWLTDSKGLIVSSRKESLQHFKKPWAHEHEPVKGLLEVVKAIKPLVLIGTSGVGKTFTKEVIEAMASFNEKPLILALSNPTSQSECTAEEAYTWGKGKAIFASGSPFDPVEYEGKVFVPGQSNNAYIFPGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 4933 - protein, 440 aa, Moritella japonica
MSSNVKKIGLIACTGVVAGNMMGSGIALLPSSLAAVGSVSIFSWIICLVGALSLAFVFARLSTKDPQEGGPIAYAGDVSPVLGFQTGVLYYHANWIGNLAIAITGVSYLSVFFPILAGPIPAAIATITAVWIFTFINLLGGTWVSRLCTLGLVLILIPVIGVATVGWTHFDTAVYNQNWNVSSGSNSHAIISAVLICLWSFVGVESAAVSSGMVKNPKRTVPLATMLGTTLAGVIYILSTQVIAGMFPAADVAASSAPFALAATSIFGGWSAPFVAAFTALACFTSLGSWMMLVGEAGKRSATDGHFPAIYGEVDKSGVAKKGLILASIKMTLLMGFITLFSGSSNTGGLFNQLTTIAVLLTMLPYFYSSVNLIRLESMTTRNIFVMLFSGVACVFCLIALAGAEGSALTGTFLVSLIILVFYGKKKGLSQASSVTTTAA

SEQ ID NO: 4934 - protein, 333 aa, Escherichia coli
SGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYARVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLREYQVNSKMMQLTGNPEVKFLHCLPAFHDDQTTLGKKMAEEFGLHGGMEVTDEVFESAASIVFDQAENRMHTIKAVMVATLSK

SEQ ID NO: 4935 - protein, 151 aa, Saccharomyces cerevisiae
MKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIPEPIGAGSEFHGNPDDDLQARLNTLKKQT

SEQ ID NO: 4936 - protein, 209 aa, Chlamydia muridarum Nigg
MSKTPLSIVHPWHGPVLTRDDYESLCCYIEITPSDSVKFELDKETGLLKVDRPQKFSNFCPCLYGLLPKTYCGDLSGEYSGQQSNRDNIKGDGDPLDICVLTEKNITQGNILLQARPIGGIRILDSGEADDKIIAVLEDDLVYGAMEDISDCPGSVLDMIQHYFLTYKATPESLIQAKPAKIEIIGLYGKKEAQKVIRLAHEDYCNLFM

SEQ ID NO: 4937 - protein, 392 aa, Burkholderia xenovorans LB400
MKYSNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIAAFVRALPAR

SEQ ID NO: 4938 - protein, 299 aa, Acidovorax sp. JS42
MKPLIFHLSGDEAFAEGLVRALRAERATLQLHRFPDGESLVRLDADVTGRTVVLMASLAQPDAKALPLLFAADAARDLGATRVLLAAPYLAYLRQDRRFNTGEAITSRTFAALVSTVFDGVVTVDPHLHRYHSLGEIYRVPTRAVQSAPVIAAWVAANVERPVLIGPDAESEQWVQEVARGADAPFTVLQKIRRGDKDVEVSLPDTSALAGRQPVLIDDIVSSARTMIQAIASVRRVGLPPPVCIGVHALFAADAYDALLAAGPQRVLTCDTVPHASNGISVVEPLAAAVQDLIEASVT

SEQ ID NO: 4939 - protein, 512 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGHAFSVVRSAGSTEYNYANPVKRDTVSIGLAGDNVTVRFVTDNPGPWFLHCHIDFHLQAGLAIVFAEDAQDTKLVNPVPEDWNKLCPTFDKAMNITV

SEQ ID NO: 4940 - protein, 146 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4941 - protein, 347 aa, Solanum tuberosum
MATLSRFLKKRSLASNRLFSTQLPHTNIKSEVSQLIGKTPMVYLKKVTEGCGAYIAVKQEMFQPTSSIKDRPALAMINDAEKKGLISPEKTTLIEPTSGNMGISMAFMAAMKGYKMVLTMPSYTSMERRVTMRAFGADLILTDPTKGMGGTVKKAYELLESTPNAFMLQQFSNPANTQVHFDTTGPEIWEETLGNVDIFVMGIGSGGTVTGVGLYLKSKNPNVKIYGLEPTESNILNGGKPGPHHITGNGVGSKPDIVDMDLMEEVLMVSSEDAVNMARELAVKEGLMVGISSGANTVAALRLAQKPENKGKLIVTVHASFGERYLSSVLYQDLRKEAENMQPVSVD

SEQ ID NO: 4942 - protein, 440 aa, Clostridium tetani E88
MGHYIMGVIILRYSDLIVGANTLVPTSNNRYVRYINFDNAATTPPFKKVIDDILRFSPYYSSAHRGMGYKSQISTDVYEKGRRIVLNFVKGDINNSNVIYVKNATEGINKLSNMIYYKDPDKIILSTEMEHHSNILPWRKFKMDFIRVDKFGRLDMTDLEYKLRKYKGKVALLAVTGASNVTGYKNPIYEIAFLCHKYGCKILVDGAQLVPHGDIDIKPIDSEYHIDYLVFSAHKMYAPFGGGALIGDKLSFKNIPPDYSGGGTVDIVVKDFVKWHETPLKDEAGTPNIIGSVALSSSINVLNTIDMKNVEKYESSLLKYAYNKLAKVKGIEIYIDNCDYNVSIIPIHVKGIYHETIAKILSYEYGIGVRSGCFCAQPYIQSLLNISSEESFKLMEKTNRRPGFVRLSFGIYNTFKEIDYFVQAIEEILSNKEKFIKKYE

SEQ ID NO: 4943 - protein, 137 aa, Salmonella enterica
ATFMPKPMFGDNGSGMHGHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4944 - protein, 378 aa, Yarrowia lipolytica CLIB122
MQSFFAKSQQAQKADGKKTSKNKAPPPWVEKYRPKSLDDVSSQDHAVTVLKRTLGSANLPHMLFYGPPGTGKTSTVLALAKELYGPELMKDRVLELNASDERGIAIVRDSIKNFAAQKVVAPKDHIAEKYPCPPFKIIILDEADSMTTDAQSALRRTMETYSAQTRFCLICNYVTRIIDPLASRCSKFRFRLLDGNDALARLRHVSDAEQLSVEDGVLEKILEVANGDLRRAITILQSCSRLSGESSAAQNDEDGDATMAETRPITIADVNETAGVIPTETLKAIIKACKDSKGPIGDTVPDILVAVKELTYSGWSSAQITSQMHDLIITDVLIEGKEKSKIAELLSVTDKRLADGADESLAMLNLIVGIADVLGAAK

SEQ ID NO: 4945 - protein, 185 aa, Triticum aestivum
  misc_feature (33)..(33): Xaa can be any naturally occurring amino acid
  misc_feature (59)..(59): Xaa can be any naturally occurring amino acid
  misc_feature (76)..(76): Xaa can be any naturally occurring amino acid
  misc_feature (103)..(103): Xaa can be any naturally occurring amino acid
  misc_feature (117)..(117): Xaa can be any naturally occurring amino acid
RSLRQGSKAINRIMKIENCESFFYFFSASRVRXDDEEMDEDAIEHFLFQMELRLDIGSXIRVKIITHAVSLFTGEXAQEENFDVIIDDDEDAAEEAEERSMIXDEEDEEDEAASDRXIIRRVRRVLAVEGQAGDRLAECKLQRDPSQWINYFSGEKNICFYQMLCLRDECGRMTEEDGENQFSGK

SEQ ID NO: 4946 - protein, 413 aa, Clostridium perfringens str. 13
MTVNEQNLKEEALRCLMCKNPRCKANCPISTPIPEVIGLFKEDKIKEAGEILFENNPLSVVCSIVCPHENQCKGNCIKGIKDTPVNFSEIEREISEEFLDNLELTQDTILEDKIAIIGGGPAGITAAFILAKKGYQVTIFDENDKIGGVLRYGIPEFRLSRDIIDKYEEALIKLNVKIRPNTLIGTVITLDMLKSDGYKAIFIATGVWNPKTLNVKGETLGNVHYAIDYLKAPKSYNLGERVVVIGAGNVAMDAARTAKRNGADTYVLYRKSFEDMPATKVEIEEAKEDGVKFELYKAPLEIYEDGVKYIQTERVISEDGRVSFKTLEGSEGVFKCDSIIVAISQAPRTNIVSSSRDLSTDKYGLVVTDEKGITTLNGVFASGDVVSGPKTVVEAVANSKKVAHAIDEFCKNN

SEQ ID NO: 4947 - protein, 922 aa, Oryza sativa Indica Group
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRALFPPASEEFSSVEHTVYPPICHKEVAKHTIHWMSNHNSPCDIPKPASVDEFVKNGKKKKSFMSSIFRKKGRSGTGSSDKKLLSRRDIVFDRHCATKIESLTLSCLDSPHRQFDTREYRVFVGTWNVAGKPPNSSLNLEDFLQIEGLPDIYVLGFQEIVPLNAGNVLVIEDNEPAAKWLGLIYQALNKPQDQSSGDELSPPETSDSRQGGGSGSRDSIPKSSSGGMLFFQKPSLKMLSKNYRVDSALVKTCTCLTDPSTMQRRAREMREFLYRIEASPPPSLASAAAAADEDGGPDAGGELARSSVNYCLIASKQMVGIFLSVWVRRELVQYIGHLRVDSVGRGIMGRLGNKVLDAVLLCLCSLFGSLDSWRRHGWLSCLQGCIAMSMTLHQTSVCFVCSHLASGEKEGDEVRRNSDVAEIIKSTQFPRICKVPGQRIPDKILDHDRVIWLGDLNYRVALSYDETKTLMGENDWDTLLEKDQLMIERQAGRVFKGWKEGKIYFAPTYKYKQNSDSYAGETAKSKKKRRTPAWCDRILWHGQGIEQLQYIRGESRFSDHRPVCSVFVIEADVDNGSMIRKGYSTLDSRIHFESPIPQRHSFYDDF

SEQ ID NO: 4948 - protein, 330 aa, Helicobacter pylori
MRYIDDELENQTILITGGAGFVGSNLAFYFQENHPKAKVVILDKFRSNTLFSNNRSSSLGHFKNLIGFKGEVVIADINNPLDLRRLEKLHFDYLFHQAAVSDTTMLDQELVMKTNYQAFLNLLEIARSKKAKVIYASSAGVYGNTKAPNVVGSNESPENVYGFSKLCMDEFVLSHSNDNIQVGLRYFNVYGPREFYKEKTASMVLQLALSIMAFKEVKLFEFGEQLRDFVYIEDVIQANVKAMKAQKSGVYNVGYSQARSYNEIVSILKEHLGDFKVTYIKNPYDFFQNHTQAHIEPTILDLDYTPLYDLESGIKDYLPHIHAIFKEQHA

SEQ ID NO: 4949 - protein, 350 aa, Oryza sativa Japonica Group
MAALPKAGKPLVENDAGSYLAWSGKNQPALAGEKLGCGLLVLKPLGFALPHYADSGKFGYVLGGSAVVGVLPVGLDARERVVRLEAGDVIAMRAGEVTWWYNDADGEDVTIVFMGDTARAASPGDISYFVLAGPMGVLGGLDAGLLATASGLTSPEQAATAFRSQPAVLLTRLSRKLQDVRPREHDRHGIVVNAARMPADSSTGGAAAGTKIVTAAHLPVLGQLGFSVGLTPLDAGAAVRGPWVLRDAAAQAVYVARGSGRVQVAGAGGASTLLDAEAAAGSLLVVPRYAVALVGVDAGGMELVSLIKSPRPAMKQFTGKGSVIGGLTPEIVQAALNVSPELVEQLRMTK

SEQ ID NO: 4950 - protein, 377 aa, Desulfitobacterium hafniense Y51
MKRDYYEVLGVSKSADEQEIKKAYRKLARQYHPDVNPGDKDAEEKFKEATEAYDVLSDTEKRARYDQMGHSAFDPNQQGFGGFGGDFGGFGDIFDMFFGGGGGGGQRRQGPTRGNDLRYDLTITFEEAAFGTEKEIQVPRQETCTECHGSGSAPGTHPTTCSQCHGTGQVKATQRTPFGAIQTARTCPACNGSGQFISSPCKECSGKGTTRKVKTIKVTVPPGSEDGLNLRFSGNGEAGLRGGPSGDLYVVLNVKAHKFFEREGNDVYCEIPITFVQAALGSELDVPTLDGKVKMKIPEGTQTATVFRLRGHGIPYRRGNGRGDQHVRVVVATPTKLTDRQKELLREFGEVTSDQQQMGKKSFFEKVKENIRDAIDL

SEQ ID NO: 4951 - protein, 788 aa, Idiomarina loihiensis L2TR
MQEYVVWYQHLGMQDVNRVGGKNASLGEMISNLAGAGVEVPGGFATTADAYNQFLEQSGLNDRIHDLLDTLDVDDVQALAQAGKKIRQWIIDTPFQPEFEAAIKDAFAELSENNDEFSFAVRSSATAEDMPDASFAGQQETFLNVRGLSSVMEAIKHVFASLFNDRAISYRVHQGYDHRGVALSAGIQRMVRSDIASSGVMFSIDTESGFDDVVFITSSYGLGEMVVQGAVNPDEFYVHKPTLKAGRPSVLRRTLGSKKIQMIFSDDREHGKQTLIEDIEKSKSQTFSVTDEEVETLAKQALIIEEHYGRPMDIEWAKDGVDGKLYIVQARPETVQSNQKGQAIERFALKTKSDVVCTGRAIGQRIGRGVARVLNDISEMDKVQPGDVLVTDMTDPDWEPIMKRAAAIVTNRGGRTCHAAIIARELGIPAVVGCGDATDHISNGQAVTVSCAEGDTGYIYQGELDFDITESQIDAMPDLPLKIMMNVGNPDRAFDFASLPHAGIGLARLEFIINRMIGVHPKALLNYDQQSDELKQTIDSMMAGYSSPREYYVARLVEGISTLGAAFSPERVIVRMSDFKSNEYANLIGGKQYEPGEENPMLGFRGASRYISEEFRDCFALECEAIKRVRNDMGLTNIEIMIPFVRTLEEGRKVIELLAEQGLVQGENGLRVIMMCELPSNALLADEFLDIFDGFSIGSNDLTQLTLGLDRDSGVIAHLFDERDEAVKKLLAMAIQTAKKRGKYVGICGQGPSDHPDFAAWLVDQGIDSVSLNPDTVIETWMYLAENL

SEQ ID NO: 4952 - protein, 265 aa, Idiomarina loihiensis L2TR
MSQQVEVLFENLWQDYLSRTPSAKKVHQILGEGHPIVNDHVAFRTFDISPVGLEVLAQHFLDLGYKEGGDYHFEAKKLRAKHFEHEDPELPKVFISELMTAEFSDELQSKVKDMVAQVSAEDTKKPDFLYSGTHWKVSYADYQSLLEESEYAAWMAAFGYCANHFTVSVNQLPGYKTLEQVNQKLKDNGFKLNTSGGEIKGSPEVYLEQSSTMADRHPVEFSDKTVEIPSCFYEFAKRYEIEDGKLYTGFVAASADKIFESTNAK

SEQ ID NO: 4953 - protein, 515 aa, Oryza sativa
MTPEQRLRAADLDAKAASLRRSIHDLRLRVPPPHVAQRLPHLHAHSLASSAALALQLNAHSSTKEQQSSSCNYSSRAGCYLHPYLKLKTSAATCFGSLPPFRIAADLRFPAISAMTTNMRPNDTFNTISHKALQREITLQEENAAYEKAISNCRQKIQEKQMEVTLLRSNLKEMEISEQDLKAQLDNAQNEQYASQNKASAAASDNTGNALMEAESLINLKSNDLKEKNEELAQAEGLIVDVHAKEKELERLNNLHKNLQSRNNDGSVARNPFRAVHEDSDAKAVRRPYQFGLRTEGLKRLMILRSAFVLYILVLHIVVFIKLSVSKQGDTGGGHCRRANSASPPQGRRQQGLLLPQGRGFGAHDPGQLLGRRQALGEERDGLAAGVEGDGIGSWVDRVAMARRRHWSDALPARSDTLSSGSGLPGAGGQPPVLAATARRRGTAAWWRWHRDAGSGTPRQISPTLSGSGLPGAGGQPRGPAARAWRMRRKRGGSGATVEVGETAGRGYGGDGADI

SEQ ID NO: 4954 - protein, 479 aa, Clostridium acetobutylicum ATCC 824
MGKVTGFKEYDREESPSRPIDERIKDYKDVHMGLDKEKLKIQGARCMECGTPFCSWGCPLGNLMPDFNDMVYKGEWKKAYERISLTSCFPEFTGRICPALCEGSCTLSYNSDAVSIKEIELGIIEEAFKNGWVKPKIPKVRTGKRIAVIGSGPAGLSAAEELNSVGHSVVVFERADKVGGLLRYGIPDFKLEKHVIDRRIDVMEKSGIEFKTSTNVGFDVSAEELLNDFDVVLLTGGSTIPRDLKVEGRENIKGVHFAVDYLKQQNMRNAGMEIKEEEITAKDKVVVVIGGGDTGSDCIGTAIRQGAKKVYQYEIMDKPPAQRDETMPWPLFPRVFKTTTSHEEGCERLFGVSTKKLEGKDGKLELLKGVQVKWEKDENGKMSMKEIEGSEFEKKVDLILIAMGFVHPQHKGIVEDLQLKLDSRGNVFTDENFMTSRENVFAAGDMRRGQSLVVWAMHEGRQSAKEIDKYLMGETSLRG

SEQ ID NO: 4955 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPQAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 4956 - protein, 552 aa, Clostridium tetani E88
MNCMAYTALYREWRPSTFEDVIGQKHITITLKNQIKNERIAHAYLFCGTRGTGKTSTAKILAKAVNCLDLRDGEPCNECEICKKINSNMLIDIEELDAASNNSVDNIRSIIEEVYYPPREAKYKVYIMDEVHMLSTGAVNAFLKTLEEPPSNVIFILATTDPQKLPITILSRCQRFDFKRIKSEDIFQRLRFIITQQGFFADDNSLRLISRISDGAMRDALGVLDQVISTGNGRVEYEDVVSILGLITNENLIKLTDSIIKKDIEECVKIIEEVIFSGKDSNNIIKDLILHMRNLLIIKVSQNPYEVLDMSEENIALLKEQSEKVRVEEIMRFIRILQEAEEQSKWVKQSRVYLELAIIKMCKIEYDTSKEIILSRLNMLEEVMKSGEIKVSCENITSSKSQYKNEIEKDNIMKSDQAKSSKNQDMVRPIEQFNPDSKVNIDMVRKYWKDILETFKGKRLMVIYASLMTAVPLKCINGEITLMYGKEYAFNKQRLEKENNSEMVENIFSQVLKDKVRIKYIIEDEKDEVIEKDPEQVLKNTFGENIVEIIEE

SEQ ID NO: 4957 - protein, 119 aa, Arabidopsis thaliana
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 4958 - protein, 489 aa, Vibrio vulnificus CMCP6
MCKTKIVATLGPASQTREKLTQLIQAGVNVVRLNFSHGSAEEHIARAEMVREIAQELNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVAAMVRIAQGVEHETSCAQGCWDKLHHLCNDAGKSFALSSMISATKVHKDLGVAIVTQHGETPLLMSRCQSQATIWAVSNKPELLRKLAILRGVTPVYLPTLDKRGDIAHQLISLLGADAKQKQISSIMMTQLESVEGVGDMNVCRLLNLNETPITTAIAA

SEQ ID NO: 4959 - protein, 357 aa, Arabidopsis thaliana
MVKTKKEDLNQFLIPRLNTIYETLQLFDGTASPTVERVNWNDVLQMSDHLSKQATIVGMLWTGESPKADSLKETMESYFNALQGFLLCCHGSTLGAGPTLSSIIHVSVKQIVDSSFRLLQGSVSLYEGSYEKDKKPSIPQLSGVVWEACSSFKKVPATNITAIGRAITQVAVSMKDVLREMKEVKPACPLSECEASGDNMSSDDDDDDDLGDDLSPEEMEVATMVTEIVSETIMVIKELIRVITGMIKMENPKDNSGFVESLEKLLKLCQGTGVQIDELGACVYPPQEMNKMKQTVKVIQGNLDEFETEVERLKSSSDGFSGACGKLRNSLKHMETELDKRCEAELVVEMQNVTLDS

SEQ ID NO: 4960 - protein, 707 aa, Neisseria gonorrhoeae FA 1090
MAYQVLARKWRPKTFSDLVGQEHVVKALQNALDEGRLHHAYLLTGTRGVGKTTIARILAKSLNCENAQHGEPCGVCQSCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLRNMTAQQVADHLAHVLDSEKIAYDPPALQLLGRAAAGSMRDALSLLDQAIALGSGKVAENDVRQMIGAVDKQYLYELLTGIVNQDGEALLAKAQEMAACAVGFDNALGELAILLQQLALIQAVPSALAHDDPDSDILHRLAQTISGEQIQLYYQIAVHGKRDLGLAPDEYAGFMMTLLRMLAFAPLAAASCDANAVIENTELQSPSAQTAEKETAAKKPQPRPEADAAQTPVQTASAAAMPSEGKTAGPVSHQENNDVPPWEDAPDKTETAAGTARTSAKSIQTASEAETPPENQVSKNKAADNETEASLSEVPSENPIQATPNDEAVETETFAHEAPAEPFYGFPDNDCPPEDGVEIPPPDWANVLPADTAGGGTDEEAEAGGIGGNNTPSAPPPEFSTENWAAIVRHFARKLGAAQMPAQHSAWTEYRSDTGLMVLAMTAEARATADKKRLDKIRDTLAQAYGLQLTLQTEDWRDEAGRETPAMQDKRVQAEDRQKAQALLEADPAAQKILQAFGAQWQPESLELAANRP

SEQ ID NO: 4961 - protein, 507 aa, Burkholderia xenovorans LB400
MLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCLGQLGLPVTESLPAHRLAAATGAAATA

SEQ ID NO: 4962 - protein, 130 aa, Salmonella enterica
MFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4963 - protein, 465 aa, Burkholderia xenovorans LB400
MTQLDQLFDADRAHFMHPSTHAHDHASGALPGRIVTGAQGIRIEDHQGKSYIDAFAGLYCVNIGYGRTEVAEAIYEQAKKLAYYHTYVGHSTDTIIELSSRIIEWAPQGMKKVYYGMSGSDANETQIKLVWYYNNVKGRPDKKKIISRQRGYHGSGIVTGSLTGLASFHQYFDLPIGRVKHTVCPHWYRHAPAGMNEAQFVAYCVEELEKLIAQEGADTIAAFIAEPVMGTGGILPPPAGYWPAIQQVLKKHDILLICDEVVCGFGRLGSKMGAQHYGIAPDLITVAKGLTSAYAPLSGVIVSEGVWDVIDKASQEFGAMGHGWTYSGHPICAAAALANLDILERENLTQNAAQTGAYLLEQLHAAFDSHPLVGEVRGAGMLAALEFMADKDGRQPFDAALKVGPRVSAAALQRGLIARAMPHGDILGFAPPLITSRSEVDEIVKLAREAVDEVASAVLSPAASA

SEQ ID NO: 4964 - protein, 124 aa, Triticum aestivum
  misc_feature (10)..(10): Xaa can be any naturally occurring amino acid
  misc_feature (40)..(40): Xaa can be any naturally occurring amino acid
RDPVWVNRAXVQLKATNGIVPKATEEKLMDAMSLADRPAXVACPHTGVALAALFKLREEGTIGANDRTVVVSTAHGLKFSQSKIDYHDQKIEDMACKYANPPVSVKADFGAVMDVLKKRLKGKL

SEQ ID NO: 4965 - protein, 434 aa, Xanthomonas campestris pv. campestris str. ATCC 33913
MFISTRGAAPAVSLSQAIAAGLAPDGGLYVPQTLPPARTLQAGATLADTATTLLQPFFEGDALAGELAAICAEAFDFPAPLVPLATPGDYALELFHGPTAAFKDFGARFLAACLTRLRRAEDRPLTILVATSGDTGAAVAAAFHRQPGLRVVVLYPDGRVSPRQAHQLGCFGDNIQALRVAGTFDDCQAMVKQALNDGELQAQLPLSSANSISLGRLLPQMSYYAHAALQHHAGSGAALNLVVPTGNLGNGLAAILARALGVPLGQIVLASNANHVLPDYFAGDDYAPQPSVATVANAMDVGAPSNFERLRWLYDGDDAALREAFRALSVDDTAIRHTVQQRFARYGEVHCPHTATAVHVLEQLRAEGVEGGTGDWAVAATAHPAKFEAVVEPLIGRAVEIPPALAALLQRPAHAEPLAPDYLAFRQRLLADAP

SEQ ID NO: 4966 - protein, 493 aa, Eucryphia cordifolia
TTSGPGVSALEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLETENKLKK

SEQ ID NO: 4967 - protein, 124 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4968 - protein, 404 aa, Vibrio vulnificus CMCP6
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDERHRVHSFVEKPQNPPHLPNDPERSLVSMGIYIFSMEVLQQALIEDADDDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSIIANGVINSGGSVQHSIVSSNVRINDSATVVDSIIFDDVEIGEGCQLVNCIIDKHVKVPPYTQIGLNRLEDAQRFKISENGIVVVPESYQF

SEQ ID NO: 4969 - protein, 630 aa, Bacillus sp. SG-1
MRMLTVENITKSYGEKTLFKDIGFTITEKERAGLIGVNGTGKSSLLKIIAGLDDADSGDMTKPGDYVISYLDQEPELNPELTVISQVFQSDAAVIKVMREYETALLQLEADSENERNQEKLFEAQRQMEILNAWDANANAKAILTKLGISQFSKKVGELSGGQKKRVALAQVLIETPDLLILDEPTNHLDYQSIKWLEDYLSRYQGAVLLVTHDRYFLDRVTNRIFELDGGALYSYKGNYQAFIEAKAERNDQEKQMAEKQKNLYRRELAWMRRGAKARTTKQKARIQRFENLEENMSSSSSNDGIDMSLSGSRLGKQVFEFKDASKSFPGQTILDQFNYLIKPGDRIGIVGRNGSGKSTFLNILAGQDELDSGELNQGQTVKIAYYTQGHEEMDENKRMIEYIRESGDVITTDSGDQISAASMLERFLFPMHSHGTLIRKLSGGEKRRLFLLKLLMTKPNVLLLDEPTNDLDTETLTVLEDYISDFSGVVITVSHDRYFLDKTAAQLLVFEGNGHIGTYLGEYSEYLTQKAEETTDVKAKKSVEKQAPVKSDSSEKKKRMSYNEKREWETIDDKIAEIEEKLEAAQSELQTVGSDFEKAQKLMEQIDEYNTLLETLIERWSYLSEIAEG

SEQ ID NO: 4970 - protein, 162 aa, Chlamydomonas reinhardtii
MGKSKKSEATAVEASEGGDNYDAKVKFCSVIAKPLADEKLCKKVYKLCKKASKRKQIRRGVKEVVKALRKNAKGICILAGDISPIDVLTHIPIVCEDHKIQYIYVPSKEDLGAAALSKRPTSCLLVLPKPIKGGDGDEAEAKEFAEAYTEVEKKVKSAQIVF

SEQ ID NO: 4971 - protein, 249 aa, Oryza sativa Japonica Group
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVGQQEYP

SEQ ID NO: 4972 - protein, 245 aa, Bacillus thuringiensis serovar konkukian str. 97-27
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKTLKKGEFPLTECLVDTEKRVLAYWHSEIAPKLKDGNKVIISSHGNTIRSLVKYLDNLSSDGVVSLNIPTSIPLVYELDENLRPIRHYYLSMDGEVPEGEIPKHITF

SEQ ID NO: 4973 - protein, 307 aa, Francisella tularensis subsp. tularensis SCHU S4
MLSLIGKTPIIKLKNIINNHNLYAKCEWLNPTGSIKDRVAKYILENLIKNKKIKPQQAIIEASSGNMGTSLAAIGKLYKHPVYITCPEKTGQIKREMIKSFGANLTICKNTSDHTDPDFYVNKAKQLTEDLDGILVNQYDNLLNTECHYKTTGQEIVDYFLTQNVDIDYFITVGGSGGTITGCAKKIKEFFPKTQVIMPDPYGSVYYDIFYYGAPIKENIHSYKVEGPGNPVFCKSMDFAYIDEIIQFSDNQAIQACHELASEQGIYAGHSSGANYFIAKKLLEKLPQHQSYNILIMVLDSGMKYAF

SEQ ID NO: 4974 - protein, 446 aa, Ralstonia eutropha JMP134
MTTTPTDAEAQATADYVRFAQAEAAHIPDFPKDLPLRPVNHVAVIGAGTMGGGIAMALANIGIPVTLIDSSEKGLETGLRRVRDNYAGSVSRGKLEPAAMETRLSLIKGSGALADAASADMVIEAVFEDMALKQQVFRDLDARCKPGAILATNTSGLDVDAIAAVTKRPQDVVGAHFFSPAHVMRLLEVVRARDTAPDVIATLMDLGRRMGKTAVLARVYPGFIGNALFRNYTREAHFLVEEGALPHEVDQALTDFGYAMGIFAVHDMAGNDVGYQTRKAQIATRPQDRRWNDLILKLTELGRLGQKSGKGWYRYEPGSRQPLRDPEVETFIEQESARLGMVRRPIDAEEIIKRCVYGMVNEGAKLLEAGVALRPSDIDTVYLTGYGFPARHGGPMYYADRIGLREVYADIERFHAEHGYWWEPAPLLVRLARDGKTFADYQRGNA

SEQ ID NO: 4975 - protein, 341 aa, Escherichia coli CFT073
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMTELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 4976 - protein, 142 aa, Oryza sativa Indica Group
MGIHEHVEGIKAHWAKNFAFLDYFKKVYGRDKPLPKWTDADVDEFIASDPVYGPQLKAMRESRKFALGGALVGGAHLGGIALKYSKAPHGVVLATGFGAICGAVVGSEVAEHWYQLYKTDKQGANLRFIYWWEDKVAGNQKS

SEQ ID NO: 4977 - protein, 163 aa, Brassica napus
NSKDRIVGAHASGPAHLMTLLEIVRTENTSAQVILDLMALGKAIKKVPVVVGNCIGFAVNRTFFPYSQAAHMLVNLGVDLFRVDSVITSFGLPLGPFQLGDLAGHGIGIAVKDIYAKAYGDRMFSSPLTELLLNSGRNGKINGRGYYIYEKGSTPQPDSSVLS

SEQ ID NO: 4978 - protein, 331 aa, Erwinia carotovora subsp. atroseptica SCRI1043
MGQLVDGVWHDTWYETKSTGGHFKRSESAFRNWVTPDGAPGLTGKGGFPAQSGRYHLYVSLACPWAHRTLLMRQLKGLEDHIAVSVVHPLMLDHGWTFGTDFEAATGDSLYQHEFLYQLYLHAKPDYSGRVTVPVLWDTEQHTVVSNESADIIRMLNSAFDGVGAIAGDYYPEALRTQIDELNSWIYDKVNNGVYKAGFATTQSAYDESASTVFAALSDLETILAKQRYLTGEQLTEADLRLWTTLIRFDPVYHTHFKCDKYRLSDYPNLFGFLRDIYQMPGIAETVDMAHIRHHYYRSHGTINPHGVISLGPEQDLNQPHQRDKKFVDLY

SEQ ID NO: 4979 - protein, 335 aa, Oryza sativa Indica Group
MAPLGDGAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 4980 - protein, 431 aa, Idiomarina loihiensis L2TR
MSKSDIEFDRQHIWHPYTSMLNPLPAYKVESAKGCRLTLDTGHEVVDGMSSWWAVIHGYRNPRLDAVAHRQIDKMSHVMFGGITHQPAIDLARRLIELTPEPLQRVFIADSGSVSVEVAIKMALQFWLAQERPEKHRLLTIKGGYHGDTFKAMSVCDPVNGMHHLFNRAINSQLFAEAPRLTPDDDWAETAGDELRHWFEQHHHELAAVILEPVVQGAGGMRFYHPEYLRLIRQLCDDFDVLLIADEIATGFGRTGKLFACEHAGITPDVLCVGKALTGGYMTLAATLTTKQVAETIGHGPGGGALMHGPTFMGNPLACAVAAESLAIIAEGKWQQQVAEIEAQLKQQLLPLAECDAVKDARVFGAIGVLEMHHPIDVAIAQKRFVELGVWIRPFGRLLYIMPPYVISTNELSRLTVAMKDYVETQSSIKA

SEQ ID NO: 4981 - protein, 451 aa, Burkholderia xenovorans LB400
MRHAHASPHRMLMHETLWFLIVGGVLVFMGLAATTLRRLPVSAAMFYLAIGYALGPPGIGLLRLDMIADAHLLRVITEVALLVSLFAIGLRLRLGMLEKLWTVPLRLGFLAMLATIPLLTLFGVYALNLGWGPALLLAAILAPTDPVLAHDVQVHNPGDHDLLRFALSGEGGLNDGIALPFAVLGLTLCAAPAAAAGDLLNLKLAGSIVWGVAGALAIGGGLGWATTHAVAWLRTRHAQALGLEGFFALGLIELCFGAAQLAQTYGFLAVFAAGVAMRRVEHRASGGMSARKAIGTVDSEDVEATAANPSKAHAFMTESVLGFTIELERIAEVAVMAMVGNVLATMQAPLFTWQTVALTVTLFVLVRPVSVELSLLGSSATPTQRRLMSWFGIRGIGSFYYLAFALENGSAANVAPLVPLTLAVIAASVVVHGVSATPLMNWYHRLRSREG

SEQ ID NO: 4982 - protein, 382 aa, Arabidopsis thaliana
MSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 4983 - protein, 937 aa, Coprinopsis cinerea okayama7#130
MLAQEPPPSARTPNSGKRFRPPTLDISGALERRPSIQVETDPTPVKEHADSSDDDSDNDVFEDTLQLSSPESIDGFKGVTGPGADEIEKELADLDELRRSVKQNLKVRPIRSRTDLKIQPNLDGDVPLPPFPTTRSSTLPNPPDSAASSNPPESALSSYFTPLSEIIPHQSIFAASSSTTTPCFTAEPTSSSLSGPSPSKSGTTTPRPQAVPISAKSLYDRLRSSRRPLLIDARSLAAHEAFHIRSSINIAIPSLILKRCKKPGGGFQSLETLQQYITTEYGKATWEDLIAKPGGGAWDGDVVIYDDDMNPNDKNNVGSTAWAIIPVISPLLSYGTVHYLEGGISSAGHDPDLQTLILSGEEASSRGVQATADAAASRDPTPQQKTLRKPSVGLFQLDTQTTYRSRQLPELEPSSTVSTNPPSPIPPPAPSPLPVMPASSSSSSLRASPNLNGGHAGIEDPSPSPPPSSLAGFRRPPPPRRPSVPNLRKIDTRSMEKINTNLPKLSLRTKPMRSATLAAPPTLSLQVPTSPSHLKLAHSTHSPISPSRHGPMSAYPAEPGRVTGFFTPPHSPGTPKAASSFSFNLDAAPPPSPNPMGSGSFSLHPPSNNHSLAPNHLPDPPPTARPDAGFDLEFDNPPSTSEEEEAFPTFAVSTILPNFLYLGPELTSQEHVDELKSLGVKRILNIAAECDDDQGLGLREVFEKYLRIPMRDTVEEDNITKGVRIVCDFLDDARLHSAPTYVHCKAGKSRSVTAVMAYLIHANRWTLSRAYAFVLERRKGISPNIGFVSELMNFEEQELGNKSVGVQPSAPVVSGTAVDMQEGFAAAVSSGNAASSSGMGVNGSAGVRSAHGHLVRSRTHVRDSLPPAIGMDSGREPMSAGGVMDRVNIGGDSAQEVEVKDAHGRYRHARRAPVNESTLQPMRRVSKAGLESFVVNS

SEQ ID NO: 4984 - protein, 439 aa, Shewanella sp. MR-7
MSKSANKIGVVQLTIITIVNMMGSGIIMLPTQLAQVGTISILSWLVTAAGSTALAYAFAKCGMFSKKSGGMGGYAEYAFGRSGNFMANYTYAVSLLIANVAIAISAVGYAAVLLEVNLSPMAICLATIGVLWLATVANFGGARITGRVSSVTVWGIILPVIGVSLIGWFWFDIDLYKGAWNPHELPFFKALGGSIAMTLWAFLGLESACANSETVDNPEKNVPIAVMGGTLGAALIYIVSTNVIAGIVPNADLANSNAPFGLAFAQMFNPVVGKIVMACAIISCTGSLLGWQFTIAQVFKASADEGFFPKIFSKVSKADAPIWGMTIIVSIQTLLSLMTISPSLSKQFEALVNLAVVTNIVPYILSMAALGVMQKQLKVPANKARVANVIAVIGALYSFYALYSSGETAVMLGAIATFFGWTIYGVISNKTPTAEIKAA

SEQ ID NO: 4985 - protein, 336 aa, Roseovarius nubinhibens ISM
MDRFDRLLAPFPQAGFMPAPTPLERLDRLSELYDLDLWVKRDDLTRIGFGGNKIRQLDYYFGAALAEGADVALITGAVQSNYVRSAAACAARLGMGAVVQLEDRVPGKGALYHSSGNVLLDKLLGAEILHYPEGEDEAGADRALHARAEELRAEGRKPFVIPLGLENPPKGALGYMQCGREILAQDAAGFDHYVVASGSGATHTGLLAGLRLCGASAPVHGICVRRDAEAQRARIGRLAELLAELLGEAVFGAADIDIWDGALAPGYGRMGETTRRALDQMARYEGLFLDPVYTAKSFAGVEGLLQEGVIQPGARVCFIHSGGLPALFAYGEDLLA

SEQ ID NO: 4986 - protein, 294 aa, Cyanothece sp. PCC 8801
MWEYTDKVMEFFYNPRNQGTITEKQEGQAITTGEVGSIACGDSPKIHLKIDEATQIILDARFQTFGCASAIASSSALTELLVGKTLDEALSLTNREIAEFLGGLPEEKMHCSVMGQEALEAAIFNYRGIPLDHHEDDEGALICKCFGVTDARIRRVIIENDLTTAEQVTNYVKAGGGCSSCLSDIDDILADITQEKATAVTAATELVQSKLTPQKPLNNLQKITLIQQILDEEIKPALAKDGGDVELFDVEGDLVKVILQGACGSCASSTQTLKMGIEARLRERVSPELTVISV

SEQ ID NO: 4987 - protein, 400 aa, Cyanothece sp. PCC 8801
MKDCIYLDNNATTQVDEEVLGAMLPYLTLYYGNPSSMHTFGGQVGSAIRTAREQVAALLGAEPSEIVFTSCGTEGDNAAIRAALAAQPNKRHIITTEVEHPAILNLCKNLERQGYTVTYLSVNNQGQLDLSELEASLTGNTAVVSIMYANNETGVIFPVEQVGQMAKEYGALFHVDAVQAVGKVPLNMAESTIDMLTYPAIKFMPPKGLVHICRRNTRFRPLLIGGHQERGRRAGTENVPGIVALGKAAELAAYHLQYGTSERELRDYLEQTILTIIPDTVLNGHPVQRLPNTSNIGFKFIEGEAILLSLNQYGICASSGSACTSGSLEPSHILRAMGLPYSVLHGSIRFSLSRFTTQEQIQKVLEVLPGIIDRLRALSPFNSDEAGWLVEQEKAALAKS

SEQ ID NO: 4988 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRSARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 4989 - protein, 53 aa, Brassica napus
  misc_feature (52)..(52): Xaa can be any naturally occurring amino acid
MPLTKLVPDAFGVLTISLVALLILLGLLCIAYSFYFQSHVRKLGFTQLGYFXG

SEQ ID NO: 4990 - protein, 281 aa, Cucumis melo
TLEDGMKVAVKRGNPRSEQGLAEFRTEIEMLSKLRHRHLVSLIGYCDERSEMILVYEYMANGPLRSHLYGTDLPPLSWKQRLDICIGAARGLHYLHTGAAQSIIHRDVKTTNILLDENFVAKVADFGLSKTGPSLDQTHVSTAVKGSFGYLDPEYFRRQQLTEKSDVYSFGVVLMEVLCTRPALNPVLPREQVNIAEWAMTWQKKGMLDHIMDPNLVGKVNPASLKKFGETAEKCLAEYGVDRPSMGDVLWNLEYALQLEETSSALMEPEDNSTNQSLPSN

SEQ ID NO: 4991 - protein, 145 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4992 - protein, 230 aa, Neisseria gonorrhoeae FA 1090
MTAYRIAPSILSADFARLGEEVANVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYVLENVLDRLDMVLLMSVNPGFGGQSFIPHTLEKIRQVRAMLDRYEGKSGRRIAIEVDGGIKTDNIAAVARAGADTFVAGSAIFGKPDYKAVIAAMRAELEKAARAEP

SEQ ID NO: 4993 - protein, 488 aa, Bacillus thuringiensis serovar konkukian str. 97-27
MNSATNQATSKTEATKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 4994 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 4995 - protein, 135 aa, Salmonella enterica
DNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4996 - protein, 519 aa, Arabidopsis thaliana
MELFTKGNNVKLRSHLDKFLVADDDQETIRQSRKGDARRAVWTVEPVVDKPNLIRLKSSHGTYLTASNKPLLLGMTGEKVTQTASFNKLMDWQTQWEPERDGFQVKLKSWCGKWMRANGGTPPWRNSVTHDEPHTSKTKNWLIWDVITIDGSDLENMSDGDESSVSSPVGSEFGSEPGSPVSARSTKSSISRFASLGLSTSPRWSSKPKSTASSFNQKETPVSVSAMEFFQKAKAIRMRNSHNKYLTADDDEETVTQNRNGSTKNARWTVEPVRDSFHVIRLKSCYGKYLTASNERFLLGATGKKVIQLKLSRVDSSVEWEPLREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 4997 - protein, 378 aa, Burkholderia xenovorans LB400
MKALVYEGPRKVTVKEMPDAKIERPTDVLVKITTTNICGSDLHMYEGRTNMETGRILGHENLGVVVEVGAGVERIKVGDRVCLPFNIGCGFCKNCERGLTGFCLTTNPGMAGAAYGFAGMGPYSGGQAEYLRVPFGDFNCLVLPPDAEEKENDYVMLSDIFPTGYHATVLAGVEPGDSVVIYGAGPVGLMAALSASIKGASKIMVVDSHPDRLKLAEKIGAIPVDDTDGSSAERILEMTGGEGADRGCECVGYQCSCKGHEVPNLTMNNLIKAVRPTGGIGVVGVFVAEDPKAGDELAKKGQLALDFGQLWMKGQHIATGQANVKAYNRKLRDLIAAGKARPSQIISHELPLDKAPDGYKHFDERDDGWTKVVLKPAA

SEQ ID NO: 4998 - protein, 151 aa, Prochlorococcus marinus str. NATL1A
MTLERTFVAIKPDGVQRGLIAEILGRFETKGFKLVGLKQLTPSKELAEKHYGVHKDRPFFSGLVDFITSGPVVAMVWEGEGVIASARKLIGATKPLEAEPGTIRGDLAVNIGRNVIHGSDGSDTAVFEINLWFQENELVDWNPSDQAWRVE

SEQ ID NO: 4999 - protein, 418 aa, Vibrio vulnificus CMCP6
MTNTFIELGLDSSLSDHLSQLGFNTPTPIQQQAIPHLLQGRDVLAAAQTGTGKTAAYGLPLIQMLSRQSREETAPKHPRALILAPTRELAQQVFDNLKQYAQHTELAIVTVYGGTSIRVQQEQLAKGVDILIATPGRLLDHLFTKKTSLNQLQMLVLDEADRMLDMGFLPDIQRIMKRMPEERQTLLFSATFETRVKALAYRLMKEPVEVQVAAANSTADTVKQMVYPVDKKRKSELLAYLIGSRNWQQVLVFTKTKQGSDALVSELKLDGIKAASINGDKSQGARQKALDDFKSGKVRALIATDVAARGLDIAQLEQVVNFDMPYKAEDYVHRIGRTGRAGQTGLAVSFMSRDEEYLLQAIENLLDTRLPQEWLAGFEPSEKENYVEDTPSKRTSRSAEKRKLKQKLKIHQGRGKKR

SEQ ID NO: 5000 - protein, 250 aa, Francisella tularensis subsp. tularensis SCHU S4
MSKENKTTDFGFTQVPWEEKQKKVAGVFHSVAAKYDLMNDLMSFGIHRIWKKQTIAKSGVRKGDNVLDLAGGTGDLAYKFCQMVGQQGKVILSDINSSMLEVGKEKLTNKGCVGNIEYVQANAECLPFPDNYFDCITISFGLRNVTDKDKALASMCRVLKPGGRSLVLEFSKPIIPLLSKVYDEYSFKALPFLGKIITQDAESYKYLAESIRKHPDQQTLKQMMYDAGFDNVEYQNMTGGIVALHIGYKY

SEQ ID NO: 5001 - protein, 513 aa, Gibberella zeae PH-1
MFATQSPRHLQVLLCRTKKFALASPPICYKVGAASSGSIRKFLSARFSTSARARNLKQSVLDNSGRHGVYLYPTLKPEPLNVVSAKDTTVVFSNGKTIEDTTCGAAVACLGYNNERVKNAMIKQMDSFCYSNSLFYGHEIGEELAAELIGGTNGEMAKVYLMCSGAEAMESAMKMARQYYMELNPRQPQRTNFIAREGSYHGSTLGALSMGGHVGRRKLFEGMLLDNNIHRVSAANEYRGKADGQTTEEYVQQLADELDRKFQEVGPETVAAFVAETLVGATLGTIPAPTGYFKAMKKVCDKYGALLILDEVMCGMGRCGSLHEWEQEGVVPDIQTVAKGLAGGFAPMAAMFINHRLSDALMSGSGTSVFSHGHTYQGHPVGCAAALEVQRIIREDNLVENVRKNGEYLGKLLHDQLDDHPNVGNIRGRGFFWSMEFVADKETKEPFLPSDGIAKKVHLTALNDVGISLYPGMGTKDGVAGDHAWIGPAYNCSKQDIERIVSKVKEAVVLALG

SEQ ID NO: 5002 - protein, 208 aa, Solanum lycopersicum
NSARAQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYVGASNLSEGASESLHVKDYKY

SEQ ID NO: 5003 - protein, 567 aa, Helicobacter pylori
MRRSFLKTIGLGVIAFSLGLLSPLSAASYPPIKNTKVGLALSSHPLATEIGQKVLEEGGNAIDAAVAIGFALAVVHPAAGNIGGGGFAVIHLANGENVALDFREKAPLKATKNMFLDKQGNVVPKLSEDGYLAAGVPGTVAGMEAMLKKYGTKKLSQLIDPAIKLAENGYAISQRQAETLKEARERFLKYSSSKKYFFKKGHLDYQEGDLFVQKDLAKTLNQIKTLGAKGFYQGQVAELIEKDMKKNGGIITKEDLASYNVKWRKPVMGSYRGYKIISMSPPSSGGTHLIQILNVMENADLSALGYGASKNIHIAAEAMRQAYADRSVYMGDADFVSVPVDKLINKAYAKKIFDTIQPDTVTPSSQIKPGMGQLHEGSNTTHYSVADRWGNAVSVTYTINASYGSAASIDGAGFLLNNEMDDFSIKPGNPNLYGLVGGDANAIEANKRPLSSMSPTIVLKNNKVFLVVGSPGGSRIITTVLQVISNVIDYNMNISEAVSAPRFHMQWLPDELRIEKFGMPADVKDNLTKMGYQIVTKPVMGDVNAIQVLPKTKGSVFYGATDPRKEF

SEQ ID NO: 5004 - protein, 322 aa, Bacillus sp. SG-1
MPKKKVLLFSDFGVDDVIAVLYALYTEEIEIVGIVADYGNVSKQTALQNVKFLQSLTETSRPIIGGAVAPLTGDLPEYFPEIHGIAGLGPIIPENHASDESFMENFFEVKAMITKYQQDITIYSAGRLTSLATAFILYPETMKLVKDIYIMGGAFGVPGNVTPVAEANIYGDPYAANIVLKLSPKPAYIIPLDVTKYAIFTPEMINDLDLYFKQTGDKVGEIIKPLVDYYQKFYKKTYPDIQGSPLHDLLAMWALKPDSEIEYVQVPVSIEVNIGNTFGQSSGDFRAIAEKEDWRVHNVAVNFNYRNFIEDVYGAFKNPPKR

SEQ ID NO: 5005 - protein, 194 aa, Triticum aestivum
  misc_feature (56)..(56): Xaa can be any naturally occurring amino acid
  misc_feature (91)..(91): Xaa can be any naturally occurring amino acid
  misc_feature (111)..(111): Xaa can be any naturally occurring amino acid
  misc_feature (120)..(120): Xaa can be any naturally occurring amino acid
  misc_feature (132)..(132): Xaa can be any naturally occurring amino acid
MKLNISFPANGSQKLIEIEDERKLRVFMEKRMGAEVPGDSVSDEFKGYIFKITGGXNDKQGFPMKQGVMHPTRVRLLLSDGHSCYRARRTXGERKRKSVRGCIVPMDLSVXALSIVKQGXNDIPRLTDTVNXTMGPKRATKSKVFGSQGNDAPVRFPRPSNRKEATQQKSTLSDSARINSMLRQDTHTYNRTVQ

SEQ ID NO: 5006 - protein, 386 aa, Ralstonia eutropha JMP134
MEMMRDAVQFEPADSRVTRPSFWSSLPERWTSDVEETLVCCHVRQETHDVKSFFFHSPDGRAFVFEPGQFITLELEIEGETINRCYTISSSPARPHTLSITVKRVPGGKVSNWLHDNVRPGTPIRVLGPAGEFTCARHPARKYLFLSAGSGITPLMSMSRAHHDLGEDRDIVFVHSARTPDDIIFSRELDLIASNHANFRTSFVCESVGARTSWPGVTGFLSLPLLKLIAPDFMEREIFTCGPAPYMKAVRDLLDEGGFDRRRYHEESFSFETLTADGPADAPAPDTGVASAPHGIADMAAFSVSFAKSRREIVCSSGQHVLEAARQSGVRLPASCTQGMCGTCKVKLVSGQVEMKHNGGIRQREIDQGMVLLCCSKPLSDLVIDK

SEQ ID NO: 5007 - protein, 464 aa, Solanum lycopersicum
MATCGIDWKSVLPNCFKGNNVRSEAKVMENSKQMNSDHHRLAFSDISTDSRSVLISLDDLSSNAVIGSNLHVFTYEELKLITSDFSSANFLGKGGFGPVHKGFIDDKIKPGLDAQPVAVKLLDLDGNQGHQEWLTEVVFLGQLRHHHLVKLIGYCWEEEQRLLVYEYMARGNLEDQLFSRYSSCLPWLTRIKIMVGAAKGLAFLHGEEKPVIYRDFKASNILLDSDYRAKLSDFGLAKDGPEGDDTHVSTRVMGTHGYAAPEYIMTGHLTSKSDVYSFGVVLLELITGRRAMDKKRPLKERILVDWARPMLRDPHKLDRIMDPRLEGQYSTQGAKKVAALAYQCLSHHPRSRPTMSNIVKILEPVLDMKDIPMGPFVYVVPSSKPDKGTEIGELKTKVNDENKAGVRENEVDNAGENREDGNAKQRRVGHRYKHRLKTDASVYSDTHLYHKTVKHERTNKLNSY

SEQ ID NO: 5008 - protein, 184 aa, Oryza sativa
  misc_feature (77)..(77): Xaa can be any naturally occurring amino acid
MVSSREDGARHRRHPRNRVNNVGTNIRKPTTEFSAEEYSFMMATNLESAYHLCQLSHPLLKASGSGSMVFISSVCGXLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASSFWQIRTLKVLW

SEQ ID NO: 5009 - protein, 591 aa, Moritella sp. PE36
MPTTHVIKALTFGFIGCISLTLPTALAKTTSSVTVAKIKPSTSAIYSQMAIHHPVWAANGMVASQEALATQIGVDIMQQGGNAIDAAVAVGYALAVTLPRAGNLGGGGFMLVYLADEQRSIAIDYREVAPQAAYPDMYLDDAGNPDSQLSRFHGLAVGVPGTVLGFELALNKYGSMSLAQVMAPAIKLARDGIVVTPDLANSLRATKKRLSQWPSTQSIFYKADGSNYQPGEILKQADLANTLSAIAKKGSPAFYQGPIAKQISDSVRDAGGIMTMQDLASYKAIERQPVTGDYRGYQVISMPPPSSGGVHIVQMLNMLAQFPIDKMGHNSAATIHVMAESMRRAYADRSLYLGDPDFFNVPVAALTNQQYAKQLVSQINLNKATPSSDVSPGTLLPYESNQTTHYSVVDKFGNAVSNTYTLNFSYGSGLVADGTGVLLNNEMDDFSAKPGTPNAYGLIGGKANAVAAKKRPLSSMTPTIILKDNKPYLVTGSPGGSRIITTTLQVIMNVIDHNMNIAEASAAPRFHHQWLPDVIRIEKGLNVDTINLLESKGHKVEVKAAMGSTQTIMLTEEGVYGASDPRRPNALSLGY

SEQ ID NO: 5010 - protein, 425 aa, Mycobacterium tuberculosis H37Rv
MTRLDSVERAVADIAAGKAVIVIDDEDRENEGDLIFAPEKATPEMVAFMVRYTSGYLCVPLDGAISDRLGLFPMYAVNQDKHGTAYTVTVDARNGIGTGISASDRATTIGLLADPTSVSDDFTPPGHVVPLRAKDGGVLRRPGHTETPVDLSRMAGLQPAGAICEIVSQKDEGSMAHTDELRVFADEHGLALITIADLIEWRRKHEKHIERVAEARIPTRHGEFRAIGYTSIYEDVEHVALVRGEIAGPNADGDDVLVRVHSECLTGDVFGSRRCDCGPQLDAALAMVAREGRGVVLYMRGHEGRGIGLMHKLQAYQLQDAGADTVDANLKLGLPADARDYGIGAQILVDLGVRSMRLLTNNPAKRVGLDGYGLHIIGRVPLPVRANAENIRCLMTKRDKLGHDLAGLDDFHESVHLPGEFGGAL

SEQ ID NO: 5011 - protein, 79 aa, Idiomarina loihiensis L2TR
MSTIEERVKKIIVEQLGVKEEEVKPEASFENDLGADSLDTVELVMALEEEFETEIPDEEAEKIKTVQSAIDYVNNHSND

SEQ ID NO: 5012 - protein, 404 aa, Oryza sativa Indica Group
MAAGAVSALFLLDIKGRVLVWRDYRGDVSALQAERFFTKLLDKESDAEVLSPVVHDDAGVSYMFIQHNNVFLLTASRQNCNAASILLFLHRVVDVFKHYFEELEEESLRDNFVVVYELLDEMMDFGYPQYTEAMILSEFIKTDAYRMEVFLDVVESVNILVNSNGQIVRSDVIGELKMRTFLSGMPECKLGLNDRVLLEAQGRTTKGKAIDLDDIKFHQCVRLARFENDRTISFIPPDGSFDLMTYRLSTQVKPLIWVEAQVEKHSRSRIQITVKTRSQFKERSTATNVEIEVPVPEDSTNPNIRTSMGSAAYAPERDAMVWKIKSFPGGKEYMCRAEFSLPSITSEDGMPEKKAPIRVKFEIPYFTVSGIQVRYLKIIEKSGYQALPWVRYITMAGEYELRLI

SEQ ID NO: 5013 - protein, 222 aa, Physcomitrella patens subsp. patens
MEVHSDNGEVKALDGVEGEGKSVLEDEAWESAEFVHEPPMLKITQPKGSFCQIDARFSVALPPDGVFNIITDPNNRRVFKNIKEVVYRKVLEDDGNRQLVEVEQLGRWRFLMLSGTFSSRVIVEQNREEKLMLFDLSRQGMMKKFSGSWKIEPMLASELSIGSRENNATPGSWVNFQQVLEPAIVPPWPLNGYVRGVTERIIREMLADLQLECLRLSQVNNS

SEQ ID NO: 5014 - protein, 442 aa, Burkholderia xenovorans LB400
MSTVFHRLPKQLLPVAVAGEGIEIIDSTGKRYIDASGGAAVSCLGHSNQRVIDAIKRQSQQLPYAHTSFFTTEPAEALADRLVASAPQGLEHVYFVSGGSEAIEAALKLARQYFVEKGEPRRRHFIARRQSYHGNTLGALAIGGNAWRREPFLPILIEAHHVSPCYAYREQRADETEEAFAQRLADELERKILELGADTVAAFIAETVVGATAGAVPPVREYFRKIRAVCDRYGVLLILDEIMSGMGRTGYLYACEEDGVAPDILTIAKGLGAGYQPIGATLVSERIYQAIVGGSGFFQHGHTYIGHATACAAALEVQRVIEEDNLLPNVLARGEQLRVRLREHYAQHPHIGDVRGRGLFVGVELVRDRAGKTPFDAALKLHAAIRREAFARGLMVYPMGGTVDGKIGDHVLLAPPFICTARDIDEIVSRLTDAIDGALAAV

SEQ ID NO: 5015 - protein, 210 aa, Zea mays
  misc_feature (117)..(117): Xaa can be any naturally occurring amino acid
  misc_feature (196)..(196): Xaa can be any naturally occurring amino acid
  misc_feature (203)..(203): Xaa can be any naturally occurring amino acid
MAAALPQLDDEIVHGMAIGAVFTDYTGKINCLDFHRTEDLMITSSEDDSIRLYNITSATLLKTTYHRKHGADRVCFSHHPSSILCSSRYNLESIESLRYLSLYDNRCLRYFKGHKDXGILRLRGRPSVAYDQQGLVFAVAMEGGAIKLFDSRSYDKGPFDTFLVGGDTAEVSDIKFSNDGKSMLLTTTNNHIYVLXAYGGDKXCGFSLEP

SEQ ID NO: 5016 - protein, 263 aa, Brassica napus
  misc_feature (82)..(82): Xaa can be any naturally occurring amino acid
MASVASSTTLISSTRILLPATKSPLLPSPSLSSPSPSASLRLAHPSPLTSIRSTSRRSFAVKAQTDDLPLVGNKAPDFEAEXAVFDQEFIKVKLSEYIGKKYVILFFYPLDFTFVCPTEITAFSDRYAEFEKLNTEVLGVSVDSVFSHLAWIQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 5017 - protein, 402 aa, Xanthomonas campestris pv. campestris str. ATCC 33913
MQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQGTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 5018 - protein, 105 aa, Brassica napus
  misc_feature (26)..(26): Xaa can be any naturally occurring amino acid
VPNLQKAENERGVASAKRPIAAGVMXLLSIKYLWEQGYKESVAAQDLRVMSRPSWNIELIQARRVPEVTLGVVREMEPPAHILGYYSLAGQKTDCPPTVRVLREL

SEQ ID NO: 5019 - protein, 480 aa, Geobacter sulfurreducens PCA
MDTLSRKTKIIATLGPVSSSPDMIRQLMDAGVDVFRLNFSHGSNDQRREVIAAIRRLSAERGKEIGILADLQGPKIRTGRMENGAIPLVRGDSLDITTDEVLGRPGLISTIYQSLPHDVKPGSRILLDDGLIELRVQSVSGATVRCTVVQGGMLKDLKGINLPGVKVSAPSLSEKDLRDLDFCLEVGVDYIALSFVRTAADVEGLKRILFERDVQVPVVAKIEKPEALRNFKSILKVADAVMVARGDLGVEISPEKVPLFQKKIIRACNEAGKPVITATQMLESMISHPRPTRAETSDVANAILDGTDAVMLSGETASGQFPLEAVRTMDKVALDVERFAQVEDGSGPRRHSVSIAEAVAEAACHAAVILKAKAVACMTQSGSTAARISRYRPPLPILAFTGSVDTMRRLSLYWGVKAYPIGTMAGTDEQIVAVESTLLSGGYRKGDVVVITMGVPVEARGSTNLMKVHKLGTGQFFEIF

SEQ ID NO: 5020 - protein, 413 aa, Thiobacillus denitrificans ATCC 25259
MTYQHIQIPAAGQKITVNADNTLNVPDTPIIPFIEGDGTGVDITPAMKKVVDAAVAKAYGGRRQIAWMEVFAGEKAVKVYGGDQWLPEETVSAVRDYVISIKGPLTTPTSGGIRSLNVALRQILDLYVCLRPVRYFAGVPSPVKAPEKVDMVIFRENTEDIYAGVEWEANSDEAKRVIKYLQRQMGVKKIRFPATSAIGIKPVSIEGSERLIRKAIQYAIDNKRRSVTLVHKGNIMKFTEGGFKKWGYELAAREFGAKLIGEGPWMELPNGIVIKDVIADAFLQQILLRPDEYDVIATLNLNGDYISDALAAEVGGIGIAPGANLSDTVAMFEATHGTAPKYAGKDYVNPGSLILSAEMMLRHLGWIEAADLIVASMEKAIAAKAVTYDFARLMEGATEVKCSQFAEAMVAKM

SEQ ID NO: 5021 - protein, 585 aa, Bacillus licheniformis ATCC 14580
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAAALITEEGGLTSHAAVVGLSLGIPVIVGMENATSILKEGEDITVDSARGAVYKGRASVL

SEQ ID NO: 5022 - protein, 134 aa, Nostoc punctiforme PCC 73102
MTPNENNTQSNINELPPHSGTRYWGEVEVIEEGDTYRISRVEIKPRHGIKPQIHYHRNEHWVVVSGVAKVTCGDAEILLNRNESTYVPAATLHKVENPGHIPLVILEIQNGEYLGEDDTERPYDLNLVKSVTEG

SEQ ID NO: 5023 - protein, 555 aa, Chromobacterium violaceum ATCC 12472
MPAIAFRPRLLDALRGYNRALLRADLMAGVTVGIVALPLAMAFAIASGVPPQAGIFTAVIAGALAAALGGTRLCVTGPTGAFIVILYGIVSKYGVANLLICTFMAGAMLVLMGVCRLGQVIRFFPMPLITGFTNGIAVLIFLTQLKDFFGLPIAKMPSGFFAVIAELSRHFSGLHWPTTLLSSALLLLILLWPRRLNRLLPSPFAALVLATLATMLFDLPVATLGSRFGGIPQGLPAPAGLDLNPAHLSDLLAPAFTIALLGAIESLLCAVVVDSLTADRHDANQELIGQGIANMVVPFFGGIPATGAVVRSVTNIGNGARTPLAAVFHAALLLLVLLLAAPLAAHVPLAALAAILVSVALKMGDWDIRKARQFPRHDTLVLVVTFVLTVAFDLTVAVEIGLLMAAVFFIRSMASHTGFRRLLPEHAQLFERHSIAGKSVPDGCAAFRVEGALFFGAADSVDIILREAPRARAVILQLHRLVLLDTSGLLALEALRARLAEQGKTLILCGAADEVMAMLEGSRLAERLGEGNLQPDLTSALRRAEAVLTDGVVWG

SEQ ID NO: 5024 - protein, 321 aa, Bacillus thuringiensis serovar konkukian str. 97-27
MKALCFETFGNADVLQYKEIPDPIINPNEILVRTKAIGLNFADIYRRRGDYHLAGNPPYILGYEGAGIVEEIGTNVTTIKPGDRIAFADVPFANAELVAVPSEKTIQLPNSISFETAASVLLQGLTAHYLTKDSYQIKQGDIALVHATAGGVGQLLIQIIKLLGGTAIGLTSSNEKAKVATLAGADHVFLYSEKWHSKVLEITNGTGVNVVYESVGSTLEESFNATKIGGTVVFYGMAGGNPAPVDPRILMDTSKTLTGGDLWNVLTTFEERKQRSTQLFDWIASGKLNTASPTTFSLQDGAHAHKLLESRKSTGKILLIP

SEQ ID NO: 5025 - protein, 287 aa, Lupinus albus
GKEQDVSLGANKFPERQPLGIAAQSQDEFKDYQEPPPAPFFEPSELTSWSFYRAGIAEFVATFLFLYITILTVFGVQRSPTKCQSVGIQGIAWAFGGMIFALVYCTAGISGGHINPAVTFGLFLARKLSLTRAVFYIVMQVLGAIVGAGVVKGFEGKHRYTQYNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHQVVIRAIPFKSK

SEQ ID NO: 5026 - protein, 411 aa, Bacillus licheniformis ATCC 14580
MSLKEKALHMHKVNQGKLESKSKVQVRNADDLSLAYSPGVAEPCKAIYDDNSKVYDYTMKGNMVAVVSDGTAVLGLGNIGPEAALPVMEGKAVLFKSFAGVDAFPICLNTSDVDKIVETVKLLEPTFGGVNLEDIAAPNCFVIEERLKKETKIPVFHDDQHGTAIVTVAGLVNALKLSGKTMSSVKVVANGAGAAGIAIIKLLYHFGVRDIIMCDTKGAIYEGRPNGMNAVKEEVAKYTNKNRIDGSLKDVIKDADVFIGVSVEGALTKEMVESMADKPIIFAMANPNPEIMPAEAHEAGASVVGTGRSDFPNQVNNVLAFPGIFRGALDVRATHINEEMKIAAVEAIASLVSDEELRPEYVIPAPFDPRVAPAVAKAVAKAAMETGVARIDVDPEEVAEKTRKLAVIEGK

SEQ ID NO: 5027 - protein, 319 aa, Clostridium perfringens str. 13
MENHSKNIKIFTGNSHPELAREIAKALNIPLGKAEVGTFSDGEISVNIKETVRGCDVFIVQSTCSPVNNNLMELLIMIDAFKRASAGRINAVIPYYGYARQDRKAKSRDPITAKLVADLLTAAGADRVLTMDLHAAQIQGYFNIPVDHLLGSPILAKYFVEKGLADRDDVVVVSPDLGSVTRARKFADKLNAPIAIIDKRRPKANVSEIMNIIGDVKDKVCILIDDMIDTAGTITNAANALKDLGAKNVYACCTHGVLSGPAFERINNSAIEELVMLNTIALPEGEGLNKFKSLSVAPIMADAINRIYDDEPLSGLFQD

SEQ ID NO: 5028 - protein, 141 aa, Bacillus sp. SG-1
MKKEDLKKELTPMQYEVTQNNGTEPPFKNEYWDEFGDGIYVDIVSGEPLFSSKDKYDAGCGWPSFTKPITEEEVKEKMDYSHFMVRKEVRSKSGDSHLGHVFDDGPGPTKLRYCINSAALRFIPKENLEKEGYGEYNKLFD

SEQ ID NO: 5029 - protein, 400 aa, Oryza sativa Japonica Group
MGRGCGRWWWVAVALVVVAAAAAAEGAREEAAVAVAVAPRRHAYAAMMYMGTPRDYEFYVATRVMMRSLGRLGSDADRVVIASLDVPPRWVQALKDDGVKVVSVENLKNPYEKQGNFNMRFKLTLNKLYAWSLVSYDRVVMLDSDNIFLQNTDELFQCGQFCAVFINPCIFHTGLFVLQVGLLAIWVSPFFCKISFNFLHPSMDVFKNMLHELAVGRDNPRWYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 5030 - protein, 437 aa, Bacillus sp. SG-1
MPHSHLIKPMLSGYYPEIDYGKGIFLYDKAGFEYLDACSGAVTANIGHGIEEILQAIYRQGQQVSFVYRSQFTNEPSEQLAALLSQETGLDWCFLVNSGSEAVETAMKIAVQHWQEKGKPAKRRIISRWLSYHGITFGALSASGHPVRRERFDSFVGDWPAVEPPYCYNCPFGKTYPQCNVQCARQLETVIRRIGEGNVAAFIAEPVIGAAGGAIDAPKEYFKIVKEICEKYDVLLISDEVMTGCGRTGTFLAMDQWGVRADIVALGKGLSAGYAPIAAALMSKEVLEPILKGSQVIMSGHTFSGNPLSSAAALAVLKLIKSEKLIEGVHGKGKYLRKKLNELRKNYSFIGEVRGKGLLLGIEFSRSVAGKTIDSAFTTMVVEEAKKEGLLLYPAAAGLDGRSGSAILIAPPLTITTDELDELIVRLKRTLKALSET

SEQ ID NO: 5031 - protein, 398 aa, Ralstonia eutropha JMP134
MSSNRGVVYLGPGQVEVQKIDYPKMVDPSGRAIGHGVILKVVTTNICGSDQHMVRGRTTAPTGLVLGHEITGEVIEIGRDVETLKLGDLVSVPFNVACGRCAMCKEQHTGVCLTVNPSRAGGAYGYVDMGGWIGGQSEYVMVPYADFNLLRFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEIDCAVDCVGFEAHGHGSSGYVEEAPATVLNSLMEITRPAGAIGIPGLYVTDDPGAQDAAAQRGSLSIRFGLGWAKSHSFHTGQTPVLKYNRNLMQAILHNRLPIAEIVNVTVIPLDQAPEGYKQFDGGAPRKFVIDPHGLLAA

SEQ ID NO: 5032 - protein, 315 aa, Haemophilus influenzae R2846
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLENPIVVSPDIGGVVRARAVAKLLNDTDMAIIDKRRPRANVAQVMHIIGDVADRDCILVDDMIDTGGTLCKAAEALKERGAKRVFAYATHAVFSGAAAKNLASDAIDEVVVTDTIPLSEEIKAIGKVRVLTLSSMLAEAIRRISNEESISAMFN

SEQ ID NO: 5033 - protein, 521 aa, Arabidopsis thaliana
MTVMVSFDLLNCFIFTLIFLISTLFLFVLFYKKPNDGFDVPPSPPSLPIIGHLHLLLFASIHKCFQKISSKYGPFLHLRIFHVPIVLVSSASTAYDIFKTNDINVSYRGDVAIDECIVFGSFGYFRAPCEDYWKFMRKLIMARALGPQALERTRGVRAAELERFHRKLLDKAMKKQSLKIGEEARILVNNTLGKMSLGSSFSIENNDGTKVSEYSIKLADLSQMFCVAQIFHKPLEKLGISLLKKQIMDVSHKFEELLENIVVKYEEKMDNHQSTEFMDALLAAYQDENAEYKITRNHIKALLAELFFGAGESSSSTTRWAMGEIFNNPRIFEKLRTEIDSVVGTTRLIQESDLPKLPYLQAVVKESLRLHPVGAVLPREFTQDCNIGGFYIHEGTSLVVNAYAVMRDPDIWEDPNEFKPERFLDASRLGQEEEKKEKTLKFLPFGAGRRGCPGLYLGYTLVETTIGVMVQCFDWEIEGDKVNMQEGSGLRFFLDLAHPLKCTPIPRIINHEPSNTQIPNS

SEQ ID NO: 5034 - protein, 1339 aa, Arabidopsis thaliana
MSNQKKRNFQIEAFKQRVVVDPKYADKTWKILEHAIHEIYNHNASGLSFEELYRNAYNMVLHKYGDKLYTGLVTTMTFHLKEICKSIEEAQGGAFLELLNRKWNDHNKALQMIRDILMYMDRTYVSTTKKTHVHELGLHLWRDNVVYSSKIQTRLLNTLLDLVHKERTGEVIDRVLMRNVIKMFMDLGESVYQDDFEKPFLEASAEFYKVESMEFIESCDCGEYLKKAEKPLVEEVERVVNYLDAKSEAKITSVVEREMIANHVQRLVHMENSGLVNMLLNDKYEDMGRMYSLFRRVANGLVTVRDVMTLHLREMGKQLVTDPEKSKDPVEFVQRLLDERDKYDRIINMAFNNDKTFQNALNSSFEYFVNLNTRSPEFISLFVDDKLRKGLKGVGEEDVDLILDKHLAKRLLSGKTVSDDAERNLIVKLKTECGYQFTSKLEGMFTDMKTSHDTLLGFYNSHPELSEGPTLVVQVLTTGSWPTQPTIQCNLPAEVSVLCEKFRSYYLGTHTGRRLSWQTNMGTADIKAVFGKGQKHELNVSTFQMCVLMLFNNSDRLSYKEIEQATEIPTPDLKRCLQSMACVKGKNVLRKEPMSKEIAEEDWFVVNDRFASKFYKVKIGTVVAQKETEPEKQETRQRVEEDRKPQIEAAIVRIMKSRRVLDHNNIIAEVTKQLQTRFLANPTEIKKRIESLIERDFLERDNTDRKLYRYLALGEICKAVICPEIAASRYNGMLKTYLKVDKLRLIEVCGTSESEFHCDLTSMMDLCFDFFRVSKEKKDLKETKGSKSLVDVVPQKKRRLDDTHLMMSLMESTPPTEAFAELRFYVYNKKENKYFTIQDVEVKRFNALRMVWGLLKVLSYDTFTNPENGFIFEGGECEFGVDVLVAPPLTNWEILSFDEKLSPPKFSWNLKNFSELKEDVYTSNKYPMGGKEWVLKLYPKGNSRADGKYLSLYVHLADSETLKSDEKNFKQGHVRVLNPLGSNHVEVQSSCWYKESSRGWGWDHFLSIANLRKTYLDKEDALNVEIEFKVVSATKISVIYHSSTIVLRHNAICPGPNKMGASCSAPVSSTIKKNWRDHPPSSYSLKIHNFSQLEKTTSFSGHKYQSRLFSSGDITGNVKDNGSGFISMYVELDSSSLMESKPPTEVFAELRFFVYNKKQNKYFTKDVEIKRFDALKMVWGLPKVFPYETFINRKMDTYSRVMNVTWSVKNFSQWKENECSKPNRFSIGGREWVLKLFPKGNSRAKGKYLSVFLYLADNETLKPDEKIFTQVVVRILNPLGSNHVASRLNYWHKGSNFGYGWCKFLSLDKIRKTYLDKEDTLMIEAEFEVVSATKFSTII

SEQ ID NO: 5035 - protein, 329 aa, Burkholderia xenovorans LB400
MAKQFGATSTTDDVLSGKRLDGKRILVTGVSAGLGVETARALASHGATVVGAARDLEKAERAITSARQEAVAGGGSIELIELDLASLASVRACSDKLLAEGKPFDIVIANAGVMATPQGKTADGFETQFGTNHLGHFVLVNRLARLLHDGGRVVMLASSGHRFANVDLDDPGFERTPYDPFVAYGRSKTANILFAVAFDQRHRARGVRAAAVHPGGIQTELGRHMGEEQLATMVETINKQLASEGKPPFQFKTVPQGAATSVWTAAVASAEEIGGRYCENCHVSEVVPDDTVITPVSEGVRRYALDLANAEALWRKSEQMVGETFPASA

SEQ ID NO: 5036 - protein, 511 aa, Coprinopsis cinerea okayama7#130
MSKPSLDSDLYGDIYGDELQDFLDDDGTANDATEQTSTEPQDASDDANRSASPQQAMDTSSSDNTQPGQLSYSAQIAQQFSAYKQTPSQERQQRAAQRPIPRVDSSTPAASSSDSIFGKKPSEMHDAGKMFIGGLSWDTTDEGLRDYFEQFGKVDACTIMRDPNTGTSRGFAFLTFEDPNCVDLVLKQSHSLDGKAIDPKRAIPREEHLRNTRFFVGGLAHSTTSESMKAFFSSYGKVVDATVMMDKETGRSKGFGFVTFEDVGTSLNHIVGKIGLVLDDKEIEIRLAQARNQRDQTRNLVNKITSDRGSTPDRSSTTPSPALSLPALNLAQMGPMAAMLFNRSMGNLGAMNMANMNNNPMSIPNTPMNNMGMPMNMSMNNMNPAAGGAMPLNVMAAMNPMMLASLNMANLASGNASGGNSNSAGAPIQNPLNAMAGMNMMLMNGLNPTMRMGMGGMIPGMAGAAGMQQGMAGMMNNSGRGKPGGMQPNGLGPARTHGAMRKQQGFHPYSR

SEQ ID NO: 5037 - protein, 607 aa, Coprinopsis cinerea okayama7#130
MHSDAFDVIPYEDIKGDWKKLGSGSFGNVYKGSYLGIDVAIKEVLPSNDYDVAKYFEREWRLMKECRHPNICLFIGLSRAPPPDNRIFIVSEFIEGGNVRLYIHDKNKPFPWRLRMSFATDVARALAYLHARKCIHRDLKGENLLVTSNGRIKVTDFGFARIAARNEEELRRLTFCGTDSYMSPEILLGDEFDLPTDVFSLGIIFCEIAARRLADDRHFKRHPPTFGIDPEEVRKLATPGCPEDFLKLCLDCLNTEPARRPGTREILDRLRLIEAEVLARPAEDGDVNVGSVRFISGARRPGAAPRIPSFGMGVGKDIRGGSGMSSASSASSDESDEELMEAVSRLTITKAGLEERSAWSTSSSVQPLLDNQHTPNGSTYSTSVIRQAAHSNTPSAPALSSILTIRPSPDPNRVPEHVLPATTSDISHASTASVDPLESPSIVSIATLDSYRTANTGESVISSTYATEGGSTIRSLHAPGHAVLPTVHRFTLLKPGTKPKKVSLGGGPGGIGGAGGTAGVVTQSSVETSVWNPLEIFFSSGLLISKCDLCAKRIGWKPFLECDDCGLRTHVKCGDLAPRDCGMRAVMNGHQHSTPVEMKKISQSDSK

SEQ ID NO: 5038 - protein, 365 aa, Physcomitrella patens subsp. patens
MQRKISVARGIVNGELRHRKGGDTRTNDPAPMRLPPPSAVTSKPQVQFPWRPSSLRVLTSARVEFVASAEIICIVARRAEVCTLPEVVWRGTSFVFREREERDTTLLVRYSSADTIVFTLLEEKIRNMVRTRPSGEAFGSNRRSPTLMRRRREEINAARDAASSQSSEEDTSPSRSLSSSPTHRGGIEGFSGPAEVTVEKKNGFFEIKGNMFMPVDPDITYGILTDFERNPDIFKTVSKVEVEHNNEGKFVTQHAHWNLMFLSGTFDMKMKVEEDPSRKAVSYKLNEPGFLKMFNGYWDVEPRMVNGKSMGCNVVVTQEVLPSTLPPGPLSSYVSRILGNQVKEVLHDLSVEAVKKQQSRQISAQ

SEQ ID NO: 5039 - protein, 466 aa, Rhodococcus sp. RHA1
MTSHYDVVVLGAGPGGYVAAIRAAQLGLSTAIIEQKYWGGVCLNVGCIPSKALLRNAELAHLFTKEAKTFGISGEASFDFGAAYDRSRKVADGRVKGVHFLMKKNKITEYDGKGSFTDANTLSVELSKGGTETVTFDNAIIATGSTTKLLPGTSLSENVVTYEEQILTRDLPESILIVGAGAIGMEFGYVLKNYGVDVTIVEFLDRALPNEDADVSKEIEKQYKKLGVTIKTGAAVQSIDDDGSKVTVSIKNNKSGDIETVVVDKVMQSVGFAPRVEGYGLEKTGVQLDRGAIGITDTMQTSVPHIYAIGDVTMKLQLAHVAEAQGVVAAETIAGVETLPIEDYRMMPRATFCQPQVASFGLTEQQAKDEGYDVKVATFPFTANGKAHGLGDPTGFVKLIADKKYGELLGGHLIGPDVSELLPELTLAQKWDLTVNELARNVHTHPTLSEALQEAIHGLAGHMINF

SEQ ID NO: 5040 - protein, 332 aa, Clostridium acetobutylicum ATCC 824
MGGVTFIGGGSFGTALAIMLAKKGHNVVIWDRNKEILEDINTLRTNTRYLPNNIIPCCVKAVDDIEKAAKESKYIVLAVPSFAIREVCRKIKGFLREDQIIISIAKGMEEETKKRLSEVVKEELYKNPVVVLSGPSHAEEVANDIPTTVVVTSTDMKYAEEVQDVFMTNSFRVYTNSDIVGVEIGGAVKNIIALASGIGDGIGYGDNTKAALMTRGMSEIMRIGVKLGGKPETFFGLTGMGDLIVTCTSMHSRNRKAGILIGRGMSCREACDKIGMVVEGVKACHTFYELKESLGVSMPITTSLYKVLFENGDPKKEVYELMARDKKNEYYF

SEQ ID NO: 5041 - protein, 478 aa, Chromobacterium violaceum ATCC 12472
MPEAWAPVRPETPPAPELLYWNAELADELGLDAGQTDKGELARLFSGADIPEGAQPIAQAYAGHQFGGLSPSLGDGRALLLGEVTDRNGQRRDIALKGSGQTPFSRRGDGKAAVGPMLRELIVGEAMQALGIPTTRALAVTTTGEPVYRERPLPGAVLTRVAASHLRVGTFQYFAIRGETAMLNKLADYTIARHYPQLAGRDGRHLALLAAVAERQAALIARWMHAGFIHGVMNTDNMALSGETIDYGPCAFMDAHYPGTVFSSIDHQGRYAYGNQPAIAQWNLARFAETLLPLISPDDPAAAVPAATEIVEGFEDLYQRRWLEQARRKLGLEGERDDDQALADDWLMLLAAHGVDHTLAWRYLADEAEGKGERLAALFPSPDALTPWLKQWHARHVPRTRRPPDIAAAMRRESPLYIPRNHLVEEALDAASERGDMGPTLKLLEALHQPFAERDGLDRYAQPAAAELAEGYRTFCGT

SEQ ID NO: 5042 - protein, 308 aa, Pyrococcus abyssi GE5
MNWEKFVEEKVKEIRETVGDSKAIIALSGGVDSSTAAVLAYKAIGDKLHAVFVNTGFLRKGEPEFVVKTFRDEFGMNLHYVDAQDRFFSALKGVTDPEEKRKIIGRVFIEVFEEVAREIGAEYLIQGTIAPDWIESQGKIKSHHNVGGLPERLNLKLIEPLRDLYKDEVRELAKFLGLPEKIYNRMPFPGPGLAVRVIGEVTPEKIRIVREANAIVEEEVERAGLRPWQAFAVLLGVKTVGVQGDIRAYKETIAVRIVESLDGMTANAMNVPWEVLQRIAFRITSEIPEVGRVLYDITNKPPATIEFE

SEQ ID NO: 5043 - protein, 188 aa, Pyrococcus abyssi GE5
MIVIMDNGGQYVHRIWRTLRYIGVESKIIPNTTPLEDIKAMNPSGIIFSGGPSLENTGNCEKILENYDEFNVPILGICLGHQLIAKFFGGKVGRGEKAEYSLVEIEILEEDEIFKGLPRKLRVWESHMDEVKELPPNFKVLARSETCPIEAMKHEELPIYGVQFHPEVAHTEHGEDILRNFAKLCGEL

SEQ ID NO: 5044 - protein, 355 aa, Novosphingobium aromaticivorans
MRRYSIASIPGDGIGREVVPAAIEVLTAAAAKCGFVLEFRHFDWSCQTYLETGKMMPDDGLDRLRDHDAVFLGAVGFPGVPDHISLWGLLLPIRREFEQYVNLRPVRLLPGIASPLRDKAPGDIDFWVVRENSEGEYSQIGGRTGTGENEIVVQQAIFSRRGTDRILRYAFDFARRSGRRHVTSATKSNGLYHSMPFWDERFAAIGAEYPDVAADQYHVDILAARFVMSPERFNVVVGSNLFGDILSDLGPGITGTIAVAPSANLNPERRFPSMFEPVHGSAPDIAGQGIANPIGQIWSGAMMLEHLGEAEPAALVMRALETALIAPDIARTPDLGGNGTTAGFAQAVRSTLLGL

SEQ ID NO: 5045 - protein, 392 aa, Corynebacterium glutamicum ATCC 13032
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 5046 - protein, 540 aa, Francisella tularensis subsp. tularensis SCHU S4
MLFCDDSKKYLKEQNINLKNEFDKDDKRVEKFSLKHQNIYFDYSKNLINDYILKSLLESAEKSSLKDKIKQMFNGAKINSTEHRAVLHTALRDLSSTPLIVDGQDIRQEVTKEKQRVKELVEKVVSGRWRGFSGKKITDIVNIGIGGSDLGPKMVVRALQPYHCTDLKVHFVSNVDADSLLQALHVVDPETTLFIIASKSFSTEETLLNSISAREWLLDHYEDEKAVANHFVAISSKLDKVKEFGIDLEHCYKMWDWVGGRYSLWSSIGMSIAFAIGYDNFEKLLAGAYSVDKHFKETEFSKNIPVIMALLASYYSCTYNSQSQALLPYDERLCYFVDYLQQADMESNGKSVNIAGETVNYQTGVVLWGGVGTNGQHAFHQLLHQGNIFIPVDFIAIATSHHNYDNHQQALLANCFAQSQALMFGQSYDMVYNELLKSGLNETQAKELAAHKVIPGNRPSTTILLDELSPYSLGALIALYEHKIFVQGVLWDINSYDQWGVELGKKLGKNILKAMNDDSSDEYQNLDDSTRQLIAKVKNK

SEQ ID NO: 5047 - protein, 249 aa, Physcomitrella patens subsp. patens
MPQAPVGPNNPLNDVFYGAGSGILGTYLGNSKDYVQSNVSRYLATHDIQYYFQVTDQYVKNKLKVVLCPFLHKGHWTRIAEQVAGGLKYKPPRHDINAPDLYLPLMAFATYIMLCGFTLGQMGNFKPDVMSGLVTKATLAWFLETILLKSLGWVLGTVDAPTLDIVAYGGYSFIGVSLSVFAHVFSTYAYHITWIYTSLCMASFLVRTMKRLLFAEARRYDRDSTRHHYLLLLIAAAQFPLFYWLVHVR

SEQ ID NO: 5048 - protein, 227 aa, Geobacter sulfurreducens PCA
MKIIDITVSLSPDLPVYPGDPPFSLEPVARVARGDGANVSRITLGTHAGTHIDVPRHLRDDGASVDQVPLDLLTGKARVIELHDVIAIGRRELAHLPVKGEERIILKTANSRLWSHAGFLDSYASLTPDGARYLAEVGTRLVGIDYLSIGPFGNEAEVHQILLDAGILILEGLNLADVEPGHYELLCLPLKIAGGDGAPARALLRSFARVAAGESSFDPHTTRWPLS

SEQ ID NO: 5049 - protein, 315 aa, Bacillus thuringiensis serovar konkukian str. 97-27
MELRAMKKVLFLGDPGIDDSLAIMYGLLHPDIDIVGVVTGYGNVTQEKATSNAAYLLQLAGREDIPIINGAKIPLSGDITTYYPEIHGAEGLGPIRPPKNLSPNIRPFCEFFDILEKYKGELIIVDAGRSTTLATAFILEKPLMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKITGSPVHDVVTMMVAANPSILDYVYRRVDVDTVGIAKGESIADFRPQPDAKALKNWVRIGWSLHYKKFLEDFVKIMT

SEQ ID NO: 5050 - protein, 640 aa, Neisseria gonorrhoeae FA 1090
MIEIKNLTLQRGLKVLLDKASAAVNPGQRVGLIGKNGTGKSSLFALIKGEITQDGGDISIPKNWRLASVSQETPDLDISALDYVLQGDAELQAFQTALRQAEVQNDGMKQAEYHAKLEEIDAYTAPARAAKLLNGLGFSQEEHSRPVKSFSGGWRMRLNLAQALICRADLLLLDEPTNHLDLETVLWLENHLASLPCTQIIISHDRDFLNAATTQTIELSQQKLTQYSGNYDFYQTERAQRLAQQQAAYVKQQAQIKHLQSFIDRFKAKATKAVQAQSRMKALAKLERIAPAHLDSEFSFEFYNPDHLPNPLLKLEHADLGYEGKTVLHDITLSLESGARYGLLGVNGSGKSTFIKALAGKIDLLSGSIVHSEKLNIGYFAQHQLDTIRADQSPVWHIQQLSPEVREQEIRNFLGGFDFVGDMALQKTEPFSGGEKARLALAMIIWQKPNLLLLDEPTNHLDLDMRHALTLALQSFQGALIVVSHDRSLLEATTDSFLLIDKGRLKNFDGDLNDYRQWRLAQENAATAPAASTQSQNRKDTKRIEAQIRQEKARRSKPIQQKIDKAEKEMVQLSEIQTGCEAFLTQEDAYLEANKEKLQNTLSELAKVKTQLAQIEETWLACQEELERIETEIEKQFAER

SEQ ID NO: 5051 - protein, 888 aa, Novosphingobium aromaticivorans
MSSVFSFGSGVLVAGQIGLDKRVLGGKGANLAEMARIGLPVPPGFTISAGECLAYLDHGRASLDRIRDEVSAALGLVERATGKTFGNPRDPLLVSVRSGARVSMPGMMDTILNLGINDATVTGLGQSSGDERFALDSYRRFIQMYSSVVLEIEHGVFEAALDRIKEDRGVDEDIDLRVEDLRGVIATFKDLVLAHHGAAFPQDVQEQLWTAIEAVFRSWDSPRAKVYRRLNDIPGDWGTAVNVQAMVFGNLGETSATGVAFTRNPATGEKAYYGEWLANAQGEDVVAGIRTPQYLTRAAREAAGARLPSMQEAMPKAYAQLAEVFELLERHYRDMQDIEFTVERGRLYLLQTRSGKRTAKAALKIAVDMVEESLVDEVTALLRLDPASLDQLLHPSLDPNAPRVLLGKGLPASPGAASGGVVFDAETAARWAELGEKVILVRHETSPDDIHGMHVATGILTARGGMTSHAAVVARGMGRPCVAGTASLKIDPVARVAEIGGQRLEEGAFITIDGSTGEVFLGELPTILPKLSGDFATVMAWADKHRRLKIRTNAETPLDCEMARRFGAEGVGLCRTEHMFFDESRILAMRQMILADSEKERRSALDQLLPEQRTDFRRIFEIMEGLPVTIRLLDPPLHEFLPHTDSEFTELSRAMGIDVEQVRHRAIELAETNPMLGHRGCRLGVVYPEIYEMQARAIFEAALEVAGEAGMAVCPEIMIPLVGLPRELESLKDTLYRVAEVVFAEKGERIAFSVGTMIELPRAALVADEIAASGEFFSFGTNDLTQTTLGISRDDAARFLGAYVEKGIIAKDPFVTLDIEGVGKLIEMASRKGRETRPDLKLGICGEHGGDPATIAFCEEIGLDYVSASPFRVPIARLAAAQAALAPS

SEQ ID NO: 5052 - protein, 761 aa, Yersinia pestis CO92
MDEQLKQSALDFHQFPVPGKIQVSPTKPLATQRDLALAYSPGVAAPCLEIAADPLAAYKYTARGNLVAVISNGTAVLGLGNIGALAGKPVMEGKGVLFKKFSGIDVFDIEVDELDPDKLIDIIASLEPTFGGINLEDIKAPECFYIEKKLRERMKIPVFHDDQHGTAIICTAAVLNGLRVVKKDISDVKLVVSGAGAASIACLNLLVALGLKQHNIIACDSKGVIYKGREANMAETKAAYAIDDNGQRTLGDVMPGSDIFLGCSGSGVLTPEMVKTMAPNPLILALANPEPEILPPLAKAVRPDAIICTGRSDYPNQVNNVLCFPFIFRGALDVGATTINEEMKLACVHAIADLALAEQSDVVASAYGEQDLSFGPEYIIPKPFDPRLIVKIAPAVAKAAMASGVATRPITDFNAYVEKLSEFVYKTNLFMKPIFSQAKKEMKRVVLAEGEGEEERVLHATQELISQGLAYPILIGRPSVIETRLKKLGLQISAGKDFEVVNNESDPRFNEYWHEYYQIMKRRGVSQEQARRAVIGNPTLIGSIMVHRGEADAMICGTIGTYHEHYDVVEKVFGFREGAHVAGAMNALLLPSGNTFIADTYVNNDPTAEQLAEITLMAAETVRRFGIEPKVALLSHSSFGTSDCPAARKMRQTLALVNQMAPELEIDGEMHGDAALVESIRHNLMPDSPLKGSANILIMPNMEAARISYNLLRVTSSEGVTVGPVLMGITKPVHILTPIASVRRIVNMVALAVVEAITLRP

SEQ ID NO: 5053 - protein, 249 aa, Hordeum vulgare subsp. vulgare
MDMGLEVSSSSPSSSPVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 5054 - protein, 400 aa, Oryza sativa Japonica Group
MAGGDLRQRRAVAAADGEGDGKMGSGGEEAEVKGKGQGRKEALGWLEWGRGWMGIVGEFLFQRIAASNLSNPLELPPLDGVSFVVTGATSGIGLEIARQLALAGGHVVMAVRRTKLAQELIQKWQNDNSEIGKPLNAEVMELDLLSLDSVVKFADAWNARMAPLHVLINNAGIFSIGEPQRFSKDGYEEHMQVNHLAPALLAVLLLPSLLRGSPSRIVNVNSVMHTVGFVDAEDMNLTSGKRKFTSLMGYSNSKLAQIKFSSMLHRRIPAEAEINVICASPGIVHTNVARDLPKLVVAAYHLIPYFIFDAQEGSRSTLFAASDPQVPDYCEMLKSEDWPVCACISYDCNPMNASEESHNLETSQLVWEKTLEMIGLPPDAVDKFIEGESVQCRYGQQKAE

SEQ ID NO: 5055 - protein, 193 aa, Kokia drynarioides
HVGLNVNGEPFVACHECNLPICKSCFEYDLKEGRKACLRCGSTYDENLLDDVEKATGDQSTMPAQLSKSQDVGIHARHISSVSTLDSEMTEDNGNPIWKNRVESWKEKKNKKKKPAPTKVEREAEIPPEQQMEDKPVPDASQPLSTIIPIPKSRLAPYRTVIILRLIILGLFFNYRVTNPVDSAFGLWLTSVI

SEQ ID NO: 5056 - protein, 192 aa, Hampea appendiculata
HVGLNVNGEPFVACHECNFPICKSCFEYDLKEGRKACLRCGSPYDENLLDDVEKATGDQSTMAEHLSKSQDVGIHARHISSVSTLDSEMTEDNGNPIWKNRVESWKEKKNKKKPATTKVERKAEIPPEQQMEDKPALDASQPLSTIIPIPKSRLAPYRTVIIMRLIILGLFFHYRVTNPVDSAFGLWLTSVI

SEQ ID NO: 5057 - protein, 396 aa, Haemophilus influenzae R2846
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQANEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 5058 - protein, 684 aa, Oryza sativa Japonica Group
MDRTSPALIWHFGTHMVDDLLPVLCCVVIRGATAIGYRDIIGRLRDYCRVSRLNKVIGYGVYGRLDCANTGRHYGTSSEQENNNTMRLRLGGARRVPFPQLLEVKSCMKNPIPIIYNPSYIAPFTSQLGLFYRYLSVGPSLIQLQAELAEIFRDVRCETKGQDQNSEADSTDLPCQCRSTVGALAAAWKTSDKNLRSCAILQASLADSFLADLDELSDNEAYPEEENAEAVGTEEIGDDDMPDLESLNYDDLDSVSKLQKTQRYNDIMQKVENALQKGTDFSNQRSILEEDPEYQLIVDCNALSVDIENEIIIIHNFIRDKYRLKFPELESLVHHPIDYARVVQKIGNEMDLTLVDLEGLLPSAIIMVISVTASTTSGKPLSEENLVKTIEACERALTLDAAKKKVLEFVESRMGYIAPNLSAIVGSAVASKLMGTAGGLGALAKMPACNVQLLGAKRKNLAGFSTATSQFRVGYLEQTDVFQSTPPALRTRACRLIAAKSTLAARIDSIRGDPTGKAGRNLLEEIRKKIEKWQEPPPAKLPKPLPVPDFEPKKKRGGDGLGEGYGMLGQAGSGKLRVSTAPSKLSAKITKKFKEKSYGSSGATSGLTSSLAFTPVQVYSAMLLVIAQLRGFYVAILVRLISELICACIGIELSNPQAHGNLLGSGTQSTYFSETGTFSKIKRT

SEQ ID NO: 5059 - protein, 368 aa, Ralstonia eutropha JMP134
MKTRAAVAWGAGKPLTIEDVDLEGPRAGEVLVEIKATGICHTDYYTLSGADPEGIFPAILGHEGAGIVTDVGAGVTSLKPGDHVIPLYTPECRQCKFCLSRKTNLCQAIRATQGKGLMPDGTSRFSIDGQPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 5060 - protein, 517 aa, Triticum aestivum
MVEADPRGALLDWDEGHATPCSWFGVQCSDDGRVVGLNLSNLGLKGVLSPEIGQLINMHSLVLHKNLFYGTIPREIGDLRELKVLDLGYNNFNGSIPSELINILSLEFIFLKGNRLYGDLPLELNELISLCESQVHQGRALSNRMPTARGKDSATTRRLLAGKEIHSPKNEMLGSENSVLEPSDVSPFFKLHEPHKDPTPPVLPHALTPPPPSEPAPSLAPLVSPNKDQILSKGSKGKSGKSSSVTIYALIGAAICFVILSLSAAIFICYRRGKASSVVPMSSSRELQTTILGGIALFRRSELETACEDFSNVIGTLPGCTLYKGTLPCGAEIAVASTLIKHAYGWSAIAEAQFKNKVEMLSRVNHKNFLKLVGYCEDEEPFTRMMVFEYVSNGSLFEHLHVNEAEHLNWQSRLRMAMGVIYCLYHMYQQYPPVILRNLNSSCIYLTEDNAAKISDIGFGDDWKEGEDEFDEPEECTIVYRLPCFLLETISGRLRSPMTPAPDLWAHRYSRRKPLTV

SEQ ID NO: 5061 - protein, 132 aa, Zea mays
  misc_feature (91)..(91): Xaa can be any naturally occurring amino acid
MCVTLQKNKHDSDKTPISSHESLIFNAGFPQFTAIVLSSDNICCNTRKRERFLHHGCVSVASVYASISFLPLPLIAVKNRHGDESTIACVXSLKSVNPNRIILQNTALTRSACMHLSSQGNLRCAKLCWSLT

SEQ ID NO: 5062 - protein, 483 aa, Arabidopsis thaliana
MKKFKDSKRNLPPSPPKLPIIGNLHQLRGLFHRCLHDLSKKHGPVLLLRLGFIDMVVISSKEAAEEVLKVHDLECCTRPKTNASSKFSRDGKDIAFAPYGEVSRELRKLSLINFFSTQKVRSFRYIREEENDLMVKKLKESAKKKNTVDLSQTLFYLVGSIIFRATFGQRLDQNKHVNKEKIEELMFEVQKVGSLSSSDIFPAGVGWFMDFVSGRHKTLHKVFVEVDTLLNHVIDGHLKNPEDKTNQDRPDIIDSILETIYKQEQDESFKLTIDHLKGIIQNIYLAGVDTSAITMIWAMAELVKNPRVMKKAQEEIRTCIGIKQKERIEEEDVDKLQYLKLVIKETLRLHPPAPLLLPRETMADIKIQGYDIPRKTILLVNAWSIGRNPELWENPEEFNPERFIDCPMDYKGNSFEMLPFGSGRKICPGIAFGIATVELGLLNLLYYFDWRLAEEDKDIDMEEAGDATIVKKVPLELVPIIHH

SEQ ID NO: 5063 - protein, 193 aa, Escherichia coli
ALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMALHTGQSLEQIERDTERDRFLSAPEAVEYGLVDSILTHRN

SEQ ID NO: 5064 - protein, 153 aa, Triticum aestivum
  misc_feature (4)..(5): Xaa can be any naturally occurring amino acid
  misc_feature (12)..(13): Xaa can be any naturally occurring amino acid
  misc_feature (15)..(15): Xaa can be any naturally occurring amino acid
MATXXSVGTLGXXRXLKGKKVFVRADLNVPLDDAQKITDDTRIRASIPTIKYLLEKGAKVILASHLGRPKGVTPKFSLKPLVARLSELLENVRFYKEEEKNDPEFAKKLASVADLYVNDAFGTAHRAHASTEGVTKFLRPSVAGFLMQKELDY

SEQ ID NO: 5065 - protein, 307 aa, Roseovarius nubinhibens ISM
MRAAGYTPITYDNLSTGWQEAVKFGPFEQGDLLDRARLDEVFAAYQPSAVMHFAALSQVGESMVKPGLYWHNNVTGSLNLIEAAVAANCQNFVFSSTCATYGDQDNVVLDEDCAQHPINAYGASKRAIEDILRDFEAAHGLRHVIFRYFNVAGADPEAEVGEFHQPETHLIPLVLDAVAGKRDALTIFGTDYDTPDGTCIRDYVHVMDLVEAHVLGLKWLSEDKQSRVFNLGTGTGFSVREVVDQAGHVTNAPVPMIEGDRRPGDCTRLVSGSLRASQELGWRPDRSTMKQMVQDAWRWHQTGHYEK

SEQ ID NO: 5066 - protein, 300 aa, Vitis vinifera
MLVLGMNSKRQRRPNVRLGEIGDVSAAFASVSSQKTHKRWKHDLVNPMETECNSGYGFSDPGVSPRVTADLQQNRENKNPNSSKSGFELVSSEEIDMTKSELNFGKITRKCRLMKRRVRSTGGNNSVFGSVWGSKLSPEFSSEDGKEYGGKEFAGFTLNEFSDLDPIDGFKSYSDHETSGMSKEACENDMDEPNLPQHNPSESWKEDAWYEVNNGFPKSSGECDKMTIGGSNVNSVRGWLEDIGFGKYAGVFEMHEVDEEALPLLTFEDLKEMGVLSIGPRRRLYTAIQQLKEGGGGISA

SEQ ID NO: 5067 - protein, 283 aa, Roseovarius nubinhibens ISM
MGTRFLPATKSVPKEIMTLVDRPLVQYAIDEAREAGIKEFIFITSRGKGALEDYFDNAPALEAELRKKGKDDLLEILKSTNMDSGEIAYMRQHKPLGLGHAVWCARRLIANEPFAVILPDDVIAAEKPCLAQMVEAFEETQGNIVAAMEVPEDKASSYGILDIKEDMGSIVSTKGMVEKPAPGQAPSNLAVIGRYILTPTVLQKLNKKTPGAGGEIQLTDAIDAARADGEEVYGFRFRGQRFDCGSKAGFLQATVAFALARDDLRDELESYLCDIVHSRQAAQ

SEQ ID NO: 5068 - protein, 304 aa, Burkholderia xenovorans LB400
MNYASILEQIHGDLQPYLGSGKVADYIPELARVPADSFGMAIVTASGEVFRTGEADTRFSIQSISKLFACTMAFRLLGDALWQRVGREPSGNAFNSLVQLEAEQGKPRNPFINAGALVVTDVLCRRFVQAETALVEFMRRLTGEAGIDYDSRVAQSELQHAHRNRAMAHFMASFGNMEMPPEVVVDAYCRQCAISMSCVELAKAALFLTNHGVVPATGERILDTSSAKRLSALMLTCGTYDAAGDFVYRVGLPAKSGVGGGIVAVLPGEMAVCVWSPGLDSNGNSLAGVLALEWLTTCTGQSIF

SEQ ID NO: 5069 - protein, 331 aa, Clostridium acetobutylicum ATCC 824
MKKVAVIFNGGTISMKFDSRVKAAVPALSGEEIMSMVTGIEKFAEIESFNFSEEPGPHMTPEKMMELSNFIKDILKRDDIVGAVVTHGTDSLEETAYFLDLTIKNEKPVVVTGSMRNSSELGYDGPANLSAAICTAISEESRNKGVLVCFSDELNSASEVTKVHSMHLNAFESPDFGPLGIVDTNKPIFYRDKVYNDYIETSSVESKVALIKTAVGMNSDFIDFAVEKGYKGIVIEAMGRGNVPPYMVEGIERALKKNVPVVLVSRCYKGRVLDSYGYHGGGKELRNIGVIFGDNLPGQKARIKLMLALGKTKDLEKIRNIFEEDFYRIYK

SEQ ID NO: 5070 - protein, 300 aa, Brassica napus
  misc_feature (291)..(291): Xaa can be any naturally occurring amino acid
  misc_feature (298)..(298): Xaa can be any naturally occurring amino acid
SVLGEGGFGCVFKGWIDEKSLTATKPGTGLVIAVKKLNQDGWQGHQEWLAEVNYLGQFSHGHLVKLIGYCLEDEHRLLVYEFMPRGTLENHLFRRGLYFQSLSWKLRLKVALGAAKGLAFLHSSETRVIYRDFKTSNILLDSEYNAKLSDFGLAKDGPIGDESHVSTRVMGTHGYAAPEYLATGHLTTKSDVYSFGVVLLELLSGRRAMDRNRPSGERNLVEWAKPYLANKRKIFRVVDNRLQDQFSMEEACKVATLSLRCLTTEIKLRPDMKEVVSQLEHIQSLNASRGXNVDRTEXRV

SEQ ID NO: 5071 - protein, 384 aa, Clostridium acetobutylicum ATCC 824
MIKINNRLKSIDEYHFKKIEDKKRELIKKGKQIIDLGIGDPDLEVSNRVQNEIIKSLGIKDFNKYPPYSGIEKLKSRVIKYYRDIFQVNLDLDEIIITIGSKEGISSIIPSICDIGDYVIVPNPGYQVYTAASYLWGAVPYKIPLTDKNDYLPNLNVIPQNIALKSKLFFINYPNNPTGAEANKDFFKDIVEFCKKRNIVLVNDSAYNEIIKKESTPISLLQSDEDKKMIEIGSFSKTYNMTGFRVGYVVGNKGVIKALLKVKSNIDSGQFMPVQYAAAEAINLDRNEIKKSREIYDKRRSTAKKILSKKGIKYFDASAAFYIWCSVPKGYSTDEFCDKLLSEYGVVVTPGYCFGNLGYGFFRIALTTKIENIETALSKFEDFQ

SEQ ID NO: 5072 - protein, 176 aa, Clostridium tetani E88
MNIPNMLTLFRMFLIPIFIIIFFSNAENNLFYSICVFLLAGITDILDGYMARKYNLITKWGIVLDPLADKLMLLTVLFCLSKANIIPMWVLIIISLKELLMIIVGGILYNKNFVIPSNKFGKVSTLMFYISIFLLIFSKKLGRYLLNLSVIMAIITFLNYLLIYIKKKSNIKEHGI

SEQ ID NO: 5073 - protein, 343 aa, Klebsiella pneumoniae subsp. pneumoniae MGH 78578
MEGIKMRSVVVKEPGQLNIESRPVPVPGAHEVRVKIAFAGICGSDVHIYHGHNPFAKYPRVIGHEFYGIIDAVGEQVSPARIGERVAVDPVVSCGHCYPCSVGRPNVCTQLQVIGVHRDGGFSDYACVPAKNAWRIPEAISDRQATMVEPFTIAANITAQLQPTAQDIALVYGAGPMGLTIIQALKGVYGVKQVIVVDRIAERLQMARENGADLTLDNTDQPLAEQLAQRQLAPTLVIDAACHPAILQEAILLASPAARIGILGFSGEASTLTQQSITSKEISIFSSRLNSGRFPLVIDWMEKGLIRPEALITHCMPLEQVKEAMEIFANDRKTCCKVLLQLG

SEQ ID NO: 5074 - protein, 141 aa, Azoarcus sp. EbN1
MAIERTLSIIKPDAVAKNVIGKIYQRFEDAGLKIIASKMVHLSEREAGQFYAVHKERPFFKDLVSFMISGPVMIQVLEGESAIATNRDLMGATDPKKADAGTIRADFAESIDANAVHGSDAPETAAVEIAFFFPGMNVYTR

SEQ ID NO: 5075 - protein, 306 aa, Zea mays
  misc_feature (205)..(205): Xaa can be any naturally occurring amino acid
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKNSPGYQAPLHSDLKPQRYLQPQQYQQYQPRQHQVQTDSYGRGRGRSRGRGRGWGTRGGYGGGYGGYEYDNNQVGYGGYEHHGGDXGHQGGYGNQGGYGHNQGGYGHDQGGYGGYGYNQGGYGGYENGGWNYNRNRGGGGRGRGNWGYGGPGYDRGGRGAGGPGGRGYVRGRGRMGGGRGRGNQNYY

SEQ ID NO: 5076 - protein, 365 aa, Novosphingobium aromaticivorans
MDAYAAIIERQGGEFVLDNVSIEDPRDGEVLVKVAAAGMCHTDLTVRDQYYPTPLPAVLGHEGSGVVEKVGRGVTTVKPGDKVVLSFSYCGTCPSCLKGHQAYCPSLFPLNFMGRRLDGSTPITRNGQEVNACFFGQSSFATYSIASENNCVKVADDAQIELLGPLGCGIQTGAGSIHNALCPEPGSSIAIFGVGSVGLSAVMAAKASGCLKIIAVDRNAGRLELARELGATDVIDANTVNAQEAIVAMTGGGADYAMDTTAIPAVLRSAVDSTHNMGETAVVGGAKLGTEFSLDMNNMLFGRKLRGVVEGSSTPQVFIPQLIAMQKAGLFPFEKLCTFYDLDQINQAVEDTEKTGKAIKAILKM

SEQ ID NO: 5077 - protein, 386 aa, Azoarcus sp. EbN1
MKIHEYQAKELLRKYGVVTPRGFHTVSVDGAVKAAEELGGKIWVVKAQIHAGGRGKGGGVKLARSLDEVRQHASDILGMQLVTHQTGPEGQKVRNLLIEEGADIQKEYYVAALTDRATQKVAIMASSEGGMDIEEVAHSTPEKILKEFVDPLVGLTDAQAENLARGIGVPEASVAKAVDALKRLYTCYMETDASLAEINPLILEGNGNIKALDAKFNFDSNALYRHPEIVDFRDFDEEDADEIEASKFDLAYISLDGNIGCLVNGAGLAMATMDTIKLFGAEPANFLDVGGGATTEKVTEAFKIMLKNPKVKGILVNIFGGIMKCDTIATGVVAAAKEVNLSVPLVVRMKGTNEDLGKKILAESGLPIIAADTMAEAATKIVAAVK

SEQ ID NO: 5078 - protein, 306 aa, Nostoc punctiforme PCC 73102
MAALLGRDLLSLADISSTELQELLQLATQLKSQQLKLQCNKVLGLLFSKASTRTRVSFTVAMYQLGGQVIDLNPNVTQVSRGEPLQDTARVLDRYLDILAIRTFAQQDLETFAHYAKIPVINALTDAEHPCQVLADLLTIQESFNTLAGLTLTYVGDGNNMANSLMLGCALVGMNVRIATPDGYEPDSQIVEQARAIANNKTEVLLTHDPELAAKGSTVLYTDVWASMGQETEADNRMPIFQPYQISEQLLSLAAPEAIVLHCLPAHRGEEITEAVIEGSQSRVWEQAENRLHAQKALLASILGAE

SEQ ID NO: 5079 - protein, 472 aa, Klebsiella pneumoniae subsp. pneumoniae MGH 78578
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDLSDVKPTGKTVAIIGAGPAGLACADVLTRNGVKAVVFDRHPEIGGLLTFGIPAFKLEKEVMTRRREIFTGMGIEFKLNTEVGRDVQLDDLLKEYDAVFLGVGTYQSMRGGLDNEDAPGVYDALPFLIANTKQIMGFGETADEPYVSMEGKRVVVLGGGDTAMDCVRTSVRQNAAHVICAYRRDEENMPGSKREVKNAREEGVEFQFNVQPLGVEVNANGKVCGVKMARTEMGQPDAKGRRRAEIVPGSEHVVPADAVVMAFGFRPHSMEWLAKHSVEMDSQGRIIAPEGSENAFQTSNPKIFAGGDIVRGSDLVVTAIAEGRKAADGILNYLEV

SEQ ID NO: 5080 - protein, 128 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 5081 - protein, 478 aa, Acidovorax sp. JS42
MLLAIAFMPALPGLPQAGQMMLAILAFAVILWMTEALDYAVSAVVIGALMIVLLAISPVPGKEAAGAMMGTRAALPYALGGFSNSAVVLVAAACFIAAAMTATQLDKRIALQVLSYVPARANHVAMGAILVGFLLSFIVPSATARVACLMPIMLGFLSAFGADRRSKFAALLVITAAQTASVWNIGIKTAAAQNMVAIGFIEKQFGQTITWGEWFVAGAPYSIVLTFALYFIMTRMLKPEMDHIVGGREAIQRQLAELGAMTANQWKLLGITLVLLGFWATEGVLHDVDTTTSTIVAIALMLLPRLGVMGWKESQKGFPWGTVLLFAVGIAMGAALLKTEAAPWLARLIVDSLGLANATAFAIFMLLALFLIVIHLGFASATGLASTMIPIIISVLQAVQTPGINPIGMTMLLQFVVSIGFILPVNSPQGMLAYGTDTFDIKDYVRTGLVLTAVAIALLVVFALTYWPWMGYMTLPAH

SEQ ID NO: 5082 - protein, 249 aa, Hordeum vulgare subsp. vulgare
MDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 5083 - protein, 642 aa, Physcomitrella patens subsp. patens
MVGIEGKYVCLRRGRHKDGNSFYFQLEPSLDASLSDLAKRILPLCENYVVVSQFAEARSHFKHGLVNHAFASALRAILQDYHAMTAQLEHQYRLGRLSLQGLWFFCQPTVAAMQVLSTAVQRAIMQHASGAAMLNLLQKQQAIAMAGDNGARSLLQKLIHAASTPYFGILERWVYEGVIDDPYGEFLIDENKSLQKESLSQDYYATYWQQRYSLRQEIPGFLASYAETILTTGKYLNAVRECGHNVQVPSAENGTLVKGRVQQPVLERINVAHNFASAELLNLIVQKFDLIGRLRSVKHYFFVDQGDFLVHFMDTAKDELTRKPSAMSVEKLQSLLELALRTSVAASDPYHEDLACSIEELSLMAQLHNIVRNGNVTSQQIGSAESVNTPVLASGITTGLETFTLEYKVRWPLSLVISRKALTKYQLIFRHIFHCKHVERQLCATWQMHQSTVRTINTLGTAISRSYVVCQRMLHFLQTFQHYMTFEVLEPNWHLMHGQLLNAKSIDEVMQHHDAFLERCLRQCTLLWPQILKKVDKLKFICLKYATATQWLIPAIFRQHDHFQQSGTTGKKSKGSYKERRGPRENPIQARQAAEDSNFKLTIGKIDEEFFKELKLLVALLSNGSQSEPCFAHLAQGLQGVA

SEQ ID NO: 5084 - protein, 618 aa, Thiobacillus denitrificans ATCC 25259
MPASLLDTIESPADLRALPAAELPGLAAEVRAFLIDSVAGTGGHLASNLGAVELTLALHYVFDTPRDRIVWDVGHQSYTHKILTGRRDAMQGLRQRGGIAGFPRRAESEFDAFGTGHSSTSISAALGMAEAFHQLGSDQRAVAVIGDGAMTAGMAFEALNNAGATELPLLVVLNDNDMSISPNVGALNNYLARLMSGRFYAAARRAGDKVLSVAPPIRELAKRAEEHMKGMVTPGTLFEEFGFNYIGPIDGHDLDVLVNTLRNIRHLRGPQFLHVVTRKGKGYTPAETNPCLYHGVARFDPAAGVAEKRAGKPSYTEVFGDWLCDMAASDPRLVGITPAMREGSGLVRFSQEFPERYFDVGIAEQHALTFAAGLACEGVKPVVAIYSTFLQRAYDQLIHDIALQNLPVTLAIDRAGLVGADGPTHAGSFDLSFLRCVPDLVIAAPSDENECRRLLSTAFLHDGPAAVRYPRGCGTGAAIEPGLEPVEIGKGVCRRRGRDVALLAFGSLVAPALTAAERLDATVADMRFVKPLDVDLVGELAAGHRLLVTLEENAVAGGAGAAVAELLAQLGIVVPVLQLGLSDVFIEHGDAAAMLAACGLDAPGIERAVSERLAALPE

SEQ ID NO: 5085 - protein, 296 aa, Thiobacillus denitrificans ATCC 25259
MMSDFSAWTQACQARIEHVLAERLPPSDIAPKRLHEAMRYAVLGGGKRVRPLLAFAAGDVTGAAVEQVQHAAAAVELIHAYSLVHDDMPAMDDDALRRGKPTVHVEFDEPTALLVGDALQSLAFDILASPGLAQAASTQLAMVQLLARASGSRGMAGGQAIDLANVGKSLDLTELEFMHIHKTGALIRASVLLGAECGTLSEPARTALDHYAKCIGLAFQVVDDVLDAEASTATLGKTAGKDAANNKPTYVSLLGVQRARERALELRADACAALDPLGPSARRLRELADFVVERTF

SEQ ID NO: 5086 - protein, 192 aa, Thespesia lampas
HVGLNVNGEPFVACHECNFPICKSCFEYDLKEGRKACLRCGSPYDENLLDDVEKATSYQSTMAEHLSKSQDVGIHARHISSVSTLDSEMTEDNGNPIWKNRVESWKEKKNKKKPATTKVEREAEIPPEQQMEDKPALDASQPLSTIIPIPKSRLAPYRTVIIMRLIILGLFFHYRVTNPVDSAFGLWLTSVI

SEQ ID NO: 5087 - protein, 441 aa, Triticum aestivum
  misc_feature (297)..(297): Xaa can be any naturally occurring amino acid
MEKGQKVEGERAAAAAAATQRWVIGVGFWVQGFRLFPWLGVNFFLKDAMGVPSSSLQILQASATLPMVAKPLLGLLSDAVPIRGCRRLPYVAIGALLQAVSWLGIALWPSLSLPVLTIFLLLSNFGASICEVANDAIVAEAGKQATSSSGGQLQSFACMFGASAGALGNLLGGIALSYFSPKLMFLFFAIVLVLQFFTTVAIPESSLKLPKATTNTSVISSIRKQTKELSYALCMPEIFWSVIWFSVSYAAIPFLLGTMFFYQTEVLRLDSSIIGLSKVFGQVALLAWSMAYNKCFXKTTSARKVLSALQFITAVVMLSDVLFVQGVYRKVGISDSLYTIVFSGLLEGLMFFKVLPFSVLIASLCPSGCEGSVMAFVMSALALSIIISGYLGVALAEFMGVSGDDFSALPVCLLIEAACTMLPLFCSSWIKERKGKEKKEE

SEQ ID NO: 5088 - protein, 179 aa, Zea mays
KHTFLPFLIKSLSMALSKYPMLNSSFIEETNEVVFKGPHNIGVAMATTHGLVVPNIKKVQSLSILEITKELARLHEMASQNRLSAADIEGGTITLSNIGAIGGKFGSPLLNLPEVAIIALGRIQKLPRFDDDENVYPSSIINVTVGADPRVVDGAPVARFCNEWKSLVEKPELLLLHMR

SEQ ID NO: 5089 - protein, 419 aa, Bacillus thuringiensis serovar konkukian str. 97-27
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 5090 - protein, 214 aa, Hordeum vulgare subsp. vulgare
MDHCGVGLYGEYATVTSAPPKRPAGRTKFRETRHPLYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMVQEAAAAPYDSYATALYGDLTDLDMHSYYCYDGMSGGGDWQSIPRMDGADEDGIYGAGDVALWSY

SEQ ID NO: 5091 - protein, 512 aa, Francisella tularensis subsp. tularensis SCHU S4
MKKTTLLVILDGWGYSDSDYFNAIKNANTPTWDSIWQEFPKTLINASSLEVGLPRSQMGNSEVGHVNIGCGRVVYQELTKIDKAIEEKTFGDNKAICAAIDNAIKNDSNLHLIGLLSPGGVHSHEEHIFEMIKIAKQKGIKRLYLHAFLDGRDTPPRSAEKSIKKADKLLQDLNLGYIASVCGRYYAMDRDNRWDRVEKAYNAIVNANADFIYDSALEALEQSYARDQSDEFVIPTCIKKDGHLVKVQDNDSVIFMNFRADRAREISHAFTDESFDHFPRKKHLNINFTTLTEYDSKLKCAVAFPPEQPINTLGEVLMKNHKTQLRIAETEKYPHVTFFFNGGREEQFEGEDRILIPSPKVATYDLQPEMSAPEVTDKLVAAINSGKYDCIVCNYANSDMVGHTGNYEAAMQAIEYLDKCIARLKDAILEHDGNMFITADHGNADMMVNPETQKPHTAHTTNLVPFIYVGHKKAQVALEHGKLSDIAPTLLNVMGIAQPKEMTGKTIFNFEK

SEQ ID NO: 5092 - protein, 373 aa, Arabidopsis thaliana
MVPPELEFNKYLGKGSYGSVSLFKYSKPRTTLYTAVMTCNYKNAESLEKEFGILSEFKGCSRIVQCYENRVIENLDVEGNKEYMMLMEYAAGGSLRTFMKRSEDKKLPDPLIREFTRMILEGLATIHGQGYVHCDLKPDNILVFPRCVYKKRAWRSSYELKISDFGLSKRDGDSKWWHPHRPFVGTAIYMSPGSVSHGETGRGLDLWSLGCVVLEMYTGKKPWWHNNYDLKDLKNWYAPMIPSDLPCDAKHFIMACFALNTNERRDALTLLEHSFLRGVVNKITKPHVKNENPKEIALALGRVVRRPSKVLTSIFKRAGELMKIIKKQPRAPRSNLLPVHICHLAQPSQKICFFIYCSLCVVFIILTVVCMFR

SEQ ID NO: 5093 - protein, 193 aa, Thespesia populnea
HVGLNVNGDPFVACHECNFPICKSCFEYDLKEGRKACLRCGSPYDENLLDDVEKATGDQSTTAENLSKSQDAGIHARHISSVSTLDSEMTEDNGNPIWKNRVESWKEKKNKKKKPATTKVEREAEIPPEQQMEDKPALDASQPLSTIIPIPKNRLAPYRTVIIMRLIILGLFFHYRVTNPVDSAFGLWLTSVI

SEQ ID NO: 5094 - protein, 214 aa, Hordeum vulgare subsp. vulgare
MDHCGVGLYGEYATVTSAPPKRPAGRTKFRETRHPVYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMMQEPAAVPYDSYATALYGDLTDLDMHSYYCYDGMSGGGDWQSISRMDGADEDGIYGAGDVALWSY

SEQ ID NO: 5095 - protein, 192 aa, Lebronnecia kokioides
HVGLNVNGEPFAACHECNFPICKSCFEYDLKEGRKACLRCGSPYDENLLDDVEKATGDQSTMAEHLSKSQDVGIHARHISSVSTLDSEMTEDNGNPIWKNRVESWKEKKNKKKPATTKVEREAEIPPEQQMEDKPAPDASQPLSTIIPIPKSRLAPYRTVIIMRLIILGLFFHYRVTNPVDSAFGLWLTSVI

SEQ ID NO: 5096 - protein, 335 aa, Lactobacillus reuteri
MAFNLRNRSFLTLADFNTREMEYMLDLAEDLKKAKYAGYEGKNLEGKNIALIFEKSSTRTRCSFEVGAKDEGAHVTYLGPSGSHIGHKESVKDTARVLGGMFDGIEYRGFSQRNVEILAKYSGVPVWNGLTDEDHPTQVLADFLTAHEVLKKPYKDIKFAFVGDGQDNVSNALMLGAAVMGMEYHVVTPKELEPTKETLDKANEIAAKTGAKIVVTNDIKEGVKGMDVIYADVWVSMGESDDMWEKRINLLKPYQVTMDVMKATENPNVLFEHCLPAFHNLDTEVGKEIEKKFGLKEMEVTDEVFESEHSVVFREAENRMHTIKAVMVATLGEQN

SEQ ID NO: 5097 - protein, 392 aa, Candida glabrata CBS 138
MSQATFEIKNGPSFSGYSFGADKSISGEAVFTTSLVGYPESMTDPSYRGQILVFTQPLIGNYGVPSMEARDEYNLLKHFESSHIQVAGIVVADYAAQYSHWTAVESLGDWCKREGVAAITGVDTREIVQYLREQGSSQSRILVEGSDTPKFYDSMATHLVAEVSTKETLYVPAKNPVANIAVIDCGVKVNIIRSLVARGANVTIFPHNARIQDVAGQFDGVFLSNGPGNPETCHETIENLKELLANEDLQQLPIFGICLGHQLLALASGGKTHKLQYGNRAHNIPAMDLTTGQCHITSQNHGYAVDPQTLPQEEWKPYFINLNDQSNEGMIHTTRPIFSTQFHPEAKGGPLDTMPLFDKFFNNIECYKTHLSQSSYRMVSQIPAIDKKEIMA

SEQ ID NO: 5098 - protein, 193 aa, Cienfuegosia tripartita
HVGLNVNGEPFVACHECNFPVCKSCFEYDLKEGRKACLRCGSPYDENLLDDVEKATGDHSAVAANMSKSQDLGVHARHISSVSTLDSEMTEDNGNPIWKNRVESWKEKKNKKKKPATTKVEREAEIPPEQQMEDKPATDASQPLSTIIPIPKSRLAPYRTVIIMRLIILGLFFHYRVTNPVDSAFGLWLTSVI

SEQ ID NO: 5099 - protein, 346 aa, Zea mays
MQLSITGLETFCLSNKVLEPNWHLMHDRLQTARSIDEVIQIHDFFLQKCLKECLLLSPELLVKVEKLKGLCLQYATSIQILMPSIDVANSENTSKSRKSRSRIDKSQDRDQQLKLASENVVMSESILKFEAAFNSELQSLAPTLSNSSQAEPYAAKLNQGFWTQHASLLSRPCCLPEIRSGTPRALAIFALYLRTNHPRLVHFPHSPTPLFQCSPHHPSPTTSPPPPPARAPATTRRNQGWSRRATTRRRSRRGRRSPNPHCARVYARGSMVGGGGRRAALGRWCLVILAVASALGVSGPAFYWRYKKGFSSSSPSSTAAAVASSPSCPPCSCDCPAPLSLKSIAP

SEQ ID NO: 5100 - protein, 506 aa, Arabidopsis thaliana
MTSVNVKLLYRYVLTNFFNLCLFPLTAFLAGKASRLTINDLHNFLSYLQHNLITVTLLFAFTVFGLVLYIVTRPNPVYLVDYSCYLPPPHLKVSVSKVMDIFYQIRKADTSSRNVACDDPSSLDFLRKIQERSGLGDETYSPEGLIHVPPRKTFAASREETEKVIIGALENLFENTKVNPREIGILVVNSSMFNPTPSLSAMVVNTFKLRSNIKSFNLGGMGCSAGVIAIDLAKDLLHVHKNTYALVVSTENITQGIYAGENRSMMVSNCLFRVGGAAILLSNKSGDRRRSKYKLVHTVRTHTGADDKSFRCVQQEDDESGKIGVCLSKDITNVAGTTLTKNIATLGPLILPLSEKFLFFATFVAKKLLKDKIKHYYVPDFKLAVDHFCIHAGGRAVIDELEKNLGLSPIDVEASRSTLHRFGNTSSSSIWYELAYIEAKGRMKKGNKAWQIALGSGFKCNSAVWVALRNVKASANSPWQHCIDRYPVKIDSDLSKSKTHVQNGRS

SEQ ID NO: 5101 - protein, 139 aa, Brassica napus
  misc_feature (124)..(124): Xaa can be any naturally occurring amino acid
  misc_feature (131)..(131): Xaa can be any naturally occurring amino acid
MSTRPELLAPPEIFYDDSEARKYTSSSRIVEIQARLSERALELLALPEDDVPRFLLDIGCGSGLSGETISENGHQWIGLDISASMLNVAVEREVEGDLLLGDMGQGLGLRAGVIDGAISISAVXQWLCNAXKSLHEPRL

SEQ ID NO: 5102 - protein, 771 aa, Oryza sativa Indica Group
MAGVLRLAGAARSPLARALAPAARRMGASAAAAMEDEAYWTEWEEEEEKARARESAPVAEMCPTGGGGGGPQWVVMGRPGPQKHAHAARLAEVLAVPYISMGTLVRQELSPASSLYKKIANSVNEGKLVPEDIIFGLLTKRLEEGYNKGETGFILDGIPRTHMQAEILDEIVDIDLVLNFKCADNCFMKRRFGGDICPHCGQLFDFSKTASSDRNPSLGSCTWPSQVQHAAVLGLEDSRMEKMRAYAEQVTWALRIVVKQRLWSDYLHSSLVAVHDEPLFLSQLKVDAKRKPQHKKTKPQPRRRERQAKPPHFPAAAAAVTAAAMETVETLVAHIQGLSGSGEELAHLHNLLRQADGEPLRAHSAALLPFLAQLHPSAHSLGFLYLLEAFASSASNLRAQGGGDFLVTTADFLVSCSAEQIRLAPDKFLSVCRVFKNEVMQLNAPIRGIAPLRAAIRKIQTSSEELTPIHADYLLLCLLAKQYKAGLSVLEDDILEVDQPKDLFLYCYYGGMIYIGLKKFTIALDFLHNCLQCYAFLQAVTVPMSSLNAIAVEAYKKYILVSLIQNGQIPLLDKGESIFMVPSFPKYTSSTAQRNLKNHAQVYVDLSTCYSKGNYSELEEYIQLNAEKFQSDNNLGLVKQVLSSMYKRNIQRLTQTYLTLSLEDIASSVQLKTPKEAEMHVLRMIEDGEIHATINQKDGMVSFHEDPEQYKSCEMVEHIDSSIQRLMALSKKLSSIDENISCDPAYLMKTGRERGGRFDYDDFDSVPHKYF

SEQ ID NO: 5103 - protein, 277 aa, Zea mays
MGKDGIQYAVVDAFTADPFKGNPAAVCLLEDAAKAADERWMQSVAAEFNISETAFLLREKSSAAGAVPLFQLRWFTPVAEVELCGHATLASAHFLFTSVLAEHEKLVEFSTKSGILTAKKVPAPQSTGVSGEGKLFIELDFPTIDLVDCHPSELPAIPETLNGASIVSVHKSTTAGDLIVELSSGKEVADIIPNLHEIKKCSGRGIIVTGPAPAGSGYDFFTRFFCPKFGIDEDPVCGSAHCVLAPYWGGKLGKHKLIAFQVRSCTTLGLVRLHLDS

SEQ ID NO: 5104 - protein, 551 aa, Clostridium perfringens SM101
MYKPKLISLLDDKESGFSKEQFLKDLIAGIIVAIIALPLSIALGISSGVSPEKGLITAIIAGFIISLLGGSRVQIGGPTGAFVVIVFGIIQNHGVDGLIIATFMAGIILVLFGLLRFGSLIKYIPYPITVGFTSGIAITLLSTQVKDFLGLSITKTPSEFIPKWEAYISHMNTTNLYTLAIGLLALIILIFWPKINKKIPGSLIALIVTTLVVFIFNLPVATIGSQFGKISSNIPIPHIPNLNLNTLKALIGPAFTIALLGGIESLLSAVVSDGMIGDKHNSNAELIAQGLANMGSSLFGGIPATGAIARTAANVKNGGRTPISGMVHSITLLLIMLVFMPLAKFIPLTTLSAILIIVSYNMSEWRTFKAILKAPKSDIAILLITFFLTVLFDLVIAIGIGMIVSMCLFIRRVATSIEVNELNESDCSYKSNIDTDMENLKVGENVLVYDIRGHLFFGAVDTFMNTMKEINDDAKVLVLRMRHTKTLDVTGYKQIKNIALSCKSRNMTLIISELQEQPKKVMRLMGFIDTLGEDHFATNFDEALEKANSLI

SEQ ID NO: 5105 - protein, 175 aa, Oryza sativa
PRGSCGASARPHAGHSPVLVPRDISPLLKDPDSFRASIRLLASHLKSTHSGKIDYIAGLDSRGFLFGPSLAQELGVGCVLIRKQGKLPGPTVSASYSLEYGKAELEIQKDALEPGQRVVIVDDLLATGGTMFAACDLLHQLRAEVVECVSLVELTSLKGRERLGPIPFFSLLQYD

SEQ ID NO: 5106 - protein, 423 aa, Oryza sativa Indica Group
MAIAARLLSTAPCRSPSSWPLPPSKPYLRFPSAPLLLLLRSPAAASVIHLSPPPVTPLAVACDDRHALPDSDEPRNRNPPDHPAPLLAAAAAAAAAVASPHAALALSGGSMGGCSDTSSSYSSSFSSSSSSDSFSSWSSSSDSWRSSSSSSSSPPKKKKVVVVESADLETHESVGTAASPPPPPPVALTPWEKFWISVAVVPGVGGLVFGLIFLIKRSIPPPRTISVVKLQIALGGVAAAKSFQKDLNRIAERVQGSSRRWYKFILSDLFKKYYYQVIAFFAEINLFVHRTQFSIKVMVDIKDSDSWNGHFKKISLEERGKFDEETLSNLEGVKRNKEYSTKMDGSKNEYIVLTILVATDGTMDFPKLITNAADLKVALTKLYSTPETGLEGIHVLWAPQDKDDILSKERMQKDYPYLKPLSV

SEQ ID NO: 5107 - protein, 441 aa, Roseovarius nubinhibens ISM
MKIAMIGTGYVGLVSGVCFSDFGHDVVCVDKDPNKIAMLERGEVPIFEPGLDRLMEKNVEAGRLSFTGDLKSAVDGAEAVFIAVGTPTRRGDGHADLSYVMAAAEEIAQAASDYVVIVTKSTVPVGTNRRVKQVVKKANPGLDFDVASNPEFLREGAAIDDFMKPDRIVVGVQSDRAAEVMAEVYRPLYLRDFPILTTDLESAEMIKYAANAFLATKITFINEIAALCERTGADVKKVSHGIGLDGRIGNKFLHAGPGYGGSCFPKDTRALARIGQEHGLPMQITEKVISVNEEMKRRMIDKLLDLCSGSFNGKTVAVLGVTFKPNTDDMRDAPSLTIVPAMVGAGAKVRVCDPQGHHEGEALLPGVQWVDDPYKAAQKADLLVILTEWNEFRALDLKRLAKRMQTPRMADLRNIYSPKDAKRAGFEAYDSVGRAGFFPEA

SEQ ID NO: 5108 - protein, 494 aa, Oryza sativa Japonica Group
MPLRPPPPPQGFLTAYPSAAFPPVKRPHEDDLGAGDVLTFRFHSLAVLKLFDRIREYRLHDYRYQATRGWYSSGTAPEDALLPCAVARPPRMYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREGIVPRDERYTRAEIMEFIDFIIAAPENRSRTLSFLRRIEAASIDDSPPPPSLPGGMGVSLLKRLRLDWITVCCLGCAVALYPFYRRV

SEQ ID NO: 5109 - protein, 306 aa, Mannheimia succiniciproducens MBEL55E
MKKLTVLGSINADHVISVPHFVKPGETLTGSNYHIAYGGKGANQAVAAARLGADVDFIACIGDDDIGKAMKAAFERDGIHTHTISTIPHQTTGIAMIQVAESGENSIVISAGANAHLTEELLAQHQESIAHADCLLMQLETPISAVEKAAVFAKRNGTKVVLNPAPAQPLSDHLLAHIDMITPNETEAEILTGVQVTDEQSAAEAAQVFHHKGIETVLITLGSKGVFFSSRGVQRIIPGFRVKAVDTTAAGDTFNGALITALLEDKSMEEAIRFAHGAAAISVTRKGAQPSIPSREETLAFLNEQH

SEQ ID NO: 5110 - protein, 82 aa, Glycine max
MVLSHAASAGSSDDSVHSTFASRYVRASLPRFRMPENSIPKEAAYQIINDELMLDGNPRLNLASFVTTWMEPECNKLMMDSI

SEQ ID NO: 5111 - protein, 638 aa, Xanthomonas campestris pv. campestris str. ATCC 33913
MIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDAALTTLPIGKAQLRHSGARIALLGFGATVDAAEAVGRELGLTVVNMRFVKPLDKAMLLELAKCHEAFVSIEDNVVAGGAGSGVSELLNAEGVLMPMLHLGLPDSFQHHASREDLLAEAGIDQAGIRAAVLKRWPQLMAKGQQALNAAAG

SEQ ID NO: 5112 - protein, 727 aa, Rhodococcus sp. RHA1
MTSPELALTVRLNTSAADTRRGVVRLHPEALAALGLREWDAIALVGARRTAAVAGRAPAGTPTGTALLDDVTLSNAGLTENSTVVVTPVTVYGGKTVTVSGSNLAVNSVSDVTLRHALLGKVLTVGDTVSLLPRDLGPGTSTAPATQALSRTFGVAWTSELLTVTGVDPAGGPVSVQPNTAVGWGEGVRATVSAAPTRLPAPPVRPAEEVPPVPVEDLVGAHTQAAKLTEWLGLALDEPELLRKLGASPHLGVLVTGPAGVGKATLARAVLASRRLVELDGPSAGALEADSRLQRVTAAVDAIRSGGVLLITDIDALLPATPEPVSALIVEQLRRAVDTVGVAFVATSAHPESVDARLRGQDLCDRELTLTLPDGSTRRALLELLLRKVPTDGIALEAIAARTPGFVVADLAALCREAALRAASRAARKPVDPALTQDDLLGALDVIRPLSRSGSEELAIGTLTLDDVGDMVETKQALTEAVLWPLQHPDSFARLGVDPPRGVLLYGPPGCGKTYLVRALASSGHLSVHAVKGAELMDKWVGASEKAVRELFQRARDSAPSLIFLDEVDALAPRRGQSSDSGVSDRVVAALLTELDGVEPLRDVVVVGATNRPDLIDPALLRPGRLERLVFVPPPDGEARRAILRTSGKSVPLADDVDLDALADDLDGYSAADCSALLREAALAAMRRNIDAADVTAADVAEAREKVRPSLDPEQVAHLESYALSRP

SEQ ID NO: 5113 - protein, 129 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMD

SEQ ID NO: 5114 - protein, 179 aa, Glycine max
MVTKLVQPPMTDSHVSPLIYRTMNVMKLQNFVPARNHPRINTSRFGERPLWFRPITIIKVAEHNSGSGLVELEALAQKKRELYQAVEGINRGIFGIPSTKKSEIESLVKQLESLNPTPFPTLELEKVAGCWRLVYSTISILGSKRTKLGLRDFISLDDFFQSIDISKVPKQCSSQFCMI

SEQ ID NO: 5115 - protein, 157 aa, Geobacter sulfurreducens PCA
MRIGHGYDVHRLVAGRKLIVGGVDIPHELGLLGHSDADVLLHAISDAILGALALGDIGKHFPDTDPRYKGADSRALLRHVMELATRKGFHLGNLDATIVAQRPKMAPHIPLMREHIAADLMADPDRVNVKATTTEELGFAGRGEGIAAYAVVLMEEK

SEQ ID NO: 5116 - protein, 398 aa, Pyrococcus abyssi GE5
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 5117 - protein, 194 aa, Malva sylvestris
HVGLNANGEPFVSCHECNFPICKTCFEYDIKEGRKACLRCASPYDENLLDDVEKASGEQSMMAAQSNKSQDVGVHARHISSVSTLDSEMTEDNGNPIWKNRVESWKEKKNKKKKPTATTKADIEAEVPPEQQMEDKPAPDASQPLSTIIPIPKSKLAPYRTVIIMRLIILGLFFHYRVTNPVDSAFGLWLTSVI

SEQ ID NO: 5118 - protein, 131 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 5119 - protein, 92 aa, Triticum aestivum
MAGKARVFMCVALVVLLLLVETTAPTGQAHAVDCGGACSYRCSKSSRPNLCNRACNTCCRRCNCVPPGTAGNEDVCPCYAHMTTHDGRHKCP

SEQ ID NO: 5120 - protein, 514 aa, Francisella tularensis subsp. tularensis SCHU S4
MLNYKESFIGRNIKSDVLSGFVVAVAIIPEAIDFSFIAGVSPTVGLYTAFILGLVTALIGGKPGMISGATGAVAVVLVSLGIQVKASLSPEMLNSLTQSGELSSYILQYILLCAIMAGVIQVIIGILRLGKLIRLVPQPAMYGFVNGLAIVIALAQIPLFKGEGIAMYVLVGVTMLIVYFLPKFTDKVPSGLVAIIVITAVVVFFKLQTKNVGDLADISGAFPSFALPNIHLTMQSFLIVLPYAMIVALVGLIESLLTLSVLDEMDNKHGNGNQECIAQGTGNIVCGFFGGMAGCTMIGQSIINFTNGGRGRLSSLTAALLLISFVVALSGYISYIPVAVFAGIMFMVCINTFEWESVNRIRYMPNSDKVVLVAVTVITVFSDLAIAVISGVIISALVFAWKSSQVHSRTHREDDNTKVYEFFGPLFFGSTSSFKSLFNVNYDPENVILDFANSRVMDISGAEAIDDITKKYLDLGKKVTLKHLSEDCRKILKNAGPYCIFEEIDPTYKLVRDV

SEQ ID NO: 5121 - protein, 327 aa, Burkholderia xenovorans LB400
MAVFDVDDIVLALQTVRQQWREVQKRSLEPGGRELPGREALSQVVDTLKGVLFPMRLGPPDLRQESENFYVGHALDAALHALLSQARLELHYRSRHAPPAADVIEREASVAVRAFAARLPAIRTLLDSDVLAAFHGDPAAGSVDEVLLCYPGVLAMIHHRLAHELYRLGLPLLARIVAELAHAQTGIDIHPGARIGAGFFIDHGTGVVIGETSIIGERVRVYQAVTLGAKRFPRDAEGHLEKGHARHPIVEDDVVIYAGATILGRVTLGRGAVIGGNVWLTQDVAPGSHVTQAVSRSEGIGVVSAAPHKPVPPNTLAEEPAVAGGAR

SEQ ID NO: 5122 - protein, 480 aa, Oryza sativa Japonica Group
METLVCVAVWAVAMAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMVCPPAVHLNPEIYEDPLAFNPWRWQDKVEITGGSKHFMAFGGGLRFCVGTDLSKVLIATFIHHLVTKYRWKTVKGGNIVRTPGLSFPDGFHVQFFPKN

SEQ ID NO: 5123 - protein, 362 aa, Candida albicans SC5314
MKGLILVGGYGTRLRPLTLTLPKPLVEFGNRPMILHQIEALAAAGVTDIVLAVNYRPEVMVSTLKKYEEEYGVSITFSVEEEPLGTAGPLKLAEEVLKKDDSPFFVLNSDVICDYPFKELADFHKAHGAAGTIVATKVDEPSKYGVIVHDRDTPNLIDRFVEKPVEFVGNRINAGLYILNPSVIDLIEMRPTSIEKETFPILVEQKQLYSFDLEGYWMDVGQPKDFLSGTCLYLTSLSKKHPEKLCKEKYVHGGNVLIDPTAKIHPSALIGPNVTIGPNVVVGEGARIQRSVLLANSQVKDHAWVKSTIVGWNSRIGKWARTEGVTVLGDDVEVKNEIYVNGAKVLPHKSISSNVEKESIIM

SEQ ID NO: 5124 - protein, 509 aa, Clostridium perfringens SM101
MRDLVLVVDFGGQYNQLIARRVRECGVYCEIIPYTYSIEKIKEKNPKGIIFTGGPNSVYGENTPTLDKEIFNLNVPILGICYGDQLMAHLLGGKVATAPVREYGKTNVTLDNSSKLFAGIEADETCWMSHTDYIAEAPEGFKIIAHTDVCPVAAMENEERRLYGVQFHPEVEHTPFGQNMMRNFLYNICGLENSWSMASFAEEKIAEIKKIVGDKKLICALSGGVDSSVAAVMVHKAVGKQLTCIFVDHGLLRKDEGDQVEKIFKEGFDMNLIRVNAQDRFLGKLKGVSDPETKRKIIGEEFIRVFEEEAGKLGDIKFLVQGTIYPDVVESGTDTSAVIKSHHNVGGLPEDMEFSLIEPLRELFKDEVRAVGEELGIPHHLVWRQPFPGPGLAIRVLGEVTEDKLEVVREADAIFREEIALAGLESEIWQYFAVLPNIQSVGVMGDERTYCHTVGLRAVTSSDGMTSNWAHIPYEVIDKVSRRIVNEVKGVNRIVYDVTSKPPATIEWE

SEQ ID NO: 5125 - protein, 739 aa, Arabidopsis thaliana
ILICFTYIPKVFNFLELQKVPPMASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAIGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQVAAKVDVYARGMISGTGSSLFEELGLYYIGPVDGHNIDDLVAILKEVKSTRTTGPVLIHVVTEKGRGYPYAERADDKYHGVVKFDPATGRQFKTTNETQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 5126 - protein, 328 aa, Coprinopsis cinerea okayama7#130
MVRRIGRIVLRNALEKQDIEVVAVNDPFIDLDYMVYMFKYDSVHGRFKGTIEAKDGKLVINGKDVIVFAERDPANINWASAGAEYIVESTLSPTRASAHLKGGAKKVIISAPSADAPMFVVGVNLDKYDPSHKVISNASCTTNCLAPLAKVIHDKFGILEGLMTTVHATTATQKTVDGPSAKDWRGGRSVNNNIIPSSTGAAKAVGKVIPSLNGKLTGMAFRVPTLDVSVVDLVVRLEKPAKYDEIKAAVKAASEGEYKGILEYTEDALVSTDFIGHTASSIFDAKAGIQLSDTFVKLIAWYDNEWGYSRRVCDLITYAAAKDKEAGV

SEQ ID NO: 5127 - protein, 371 aa, Vitis vinifera
MEIEGTPALHGYHMPAEWEPHSQCWMGWPERPDNWRDHAGPAQRVFAEVASAISKFEPVTVCASAAQWANARSLLPQHIRVVEMSMDDSWFRDTGPTFVPTPSSAAPVQKIAGIDWNFNSWGGYDDGCYNDWSLDLLVAKKILEIERVPRFPQSMILEGGSIHVDGEGTCLTTEECLLNKNRNPHLTKEQIEAELKSYLGVKKVIWLPRGLFGDDDTNGHIDNMCCFAKPGVVLLSWTDDELDPQYERSVEAFSVLSNATDARGRKLQIIKLHVPGPLYMTDEEASGILQDDNAKLRVAGTRLAASYVNFYIANGRIIAPVFGDQKWDDEAVRVLSLAFPNHEVVGIKGAREIALAGGNIHCITQQQPAIA

SEQ ID NO: 5128 - protein, 298 aa, Coprinopsis cinerea okayama7#130
MFKYDSVHGVFKGTVESKDGKLVVNGMHIAVFNEKDPAAIPWAKCSAHYIVESTGVFTHADKASAHLKGGAKKVVISAPSPDAPMYVCGVNLDKYDPNHAVVSNASCTTNCLAPLAKIIHDKYGIAEGLMTTVHATTATQRTVDGPSHKDWRGGRSVGNNIIPSSTGAAKAVGKVIPSLNGKLTGMAFRVPTLDVSVVDLVVRLEKGATYEDICKTMKAAAQSPDYKGIMGYTDDQVVSTDFITSTWSSIFDSRAGIMLSPNFVKLIAWYDNEYGYSRRVCDLIVYMSKKDAEAGMKL

SEQ ID NO: 5129 - protein, 219 aa, Clostridium perfringens SM101
MDIKENLTKFTKKIPSNVQLIAVSKTRTIEEMEEAYEFGIRKFGENKVQEIIRKFDEFHKDVEWHLIGHLQTNKVKYIVDKVHLIQSLDSIKLLKEIEKVYGRHNKIANTLIQVNIGREEQKYGILEEKLDELIEAIEACNNVNVLGIMTIIPKGTEEECRKYFSKTHKLFCELKEKKFKNIKMDILSMGMSGDYEIAIEEGSNMVRIGQGIFGKRLYK

SEQ ID NO: 5130 - protein, 410 aa, Bacillus anthracis str. Ames
MKIIVQKFGGTSVRDENGRKHALHHIKKSLDAGYKVVTVVSAMGRKGEPYATDTLLSLVNQEESHISNREQDLLLSCGELISAIVFSNMLNENGIKAAALNGAQAGFVTNDDFTNAKIIEMNCDRIHEELENVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLIAAYDGATKGQDVEERPVTGIAHVSNVTQIKVLAKETAYDIQQHVFKEMANEGISVDLINISPTGVAYTVNDNVSARAVEVLKQLGYEPIVTEHCAKVSIVGAGMAGIPGVTAKIVTALAEKGIQILQSADSHTTIWVLVKETDLVEAVNALHSAFELSKEKQLEQ

SEQ ID NO: 5131 - protein, 437 aa, Gloeobacter violaceus PCC 7421
MTFNLWFVIVGALFIVMALSNSILRRLPLTTSLLYLLVGLVLGPVGLGLIRLDAIEQAGLLERITEVAVIISLFTSGLKLRTPLSKKRWQLPVRLAFISMTVTVALIACAGVFWLGLPLGAAILLGGVLAPTDPVLASDVQLEDPFDSDRLRFSLTGEAGLNDGTAFPFVMLGLGLLGLHELGEGGWRWVAVDVLWATAAGLGVGWLCGLLVGRLVLYLRSRREEAVQLDDFLALGLIALSYGAALLVAGYGFLAVFAAGLALRSIELQAAGEKPSEDVQAMARQGAKEEVPPGSESAPLFMAQAVLEFNEQLERIGEVVIVVLVGGLLATFLPPPAALLWFVPLLFLVIRPISVWIGLLGSNTSGLQRRLMAWFGIRGIGSIYYLMFAITHGLPGDIARTLTAITLMVVAISIVVHGISVTPLMSLYGRRSEGKPA

SEQ ID NO: 5132 - protein, 339 aa, Acidovorax sp. JS42
MTERISLTRYLVEQQRVHGRIPPQLRLLVEVVARACKRISFAVNKGDLGDVMGTAGTENVQGEVQKKLDIIANEVLIEANEWGGHLAAMASEEMDGIYVVPNRFPQGEHLLMFDPLDGSSNIDVNVSIGTIFSVLHKHHDDPTTDEPVTEADFLQPGHQQVAAGYCIYGPQTTLVLTVGDGVAMFTLDREQGSFVLTRENIRIPEDTKEFAINMSNMRHWDAPVRRYIDECLQGKEGPRGKDFNMRWIASMVADVHRILMRGGIFMYPWDKREPNKPGKLRLMYEANPMGWLVEQAGGAATNGRQRILDIQPAQLHERVSVILGSKNEVDRVTSYHSGI

SEQ ID NO: 5133 - protein, 435 aa, Coprinopsis cinerea okayama7#130
MSTNKSSSKKRKRDASPSSTLTFELSSSKQTKGGPFLVNYPVVKAPEKTAFNCYANKKQKTSGDAEDERQNDILLAGETETVEFMTNEDETYRVAQGGCHYFIALHNKKTGKVAVLPQSTSPHILVHTVKALKSIAPAPAPSKTQFREAKNALGETFGTKKAKAAIRAQERNHVDVGAMEGVMGYVMDSIDKGAEGLMTTEEAKVASDTNRLIPPFSTEATSPDDIYPLYSIIPEAEWKALSISALDSTKNEKERLALLPYRYSEWLRQHLRNSGTAESPKTRKRNLKILLYISAMLAFRQATSRKEINKDQIYEKLAPLPSIVADSLLSRFTEVARGSTSYQSTSTTKTNLLTHIFALCLKVDQFATDTEMLAQDLSMKTAEVNQLFRSLGCKMVKLGDRERTRLGLSDESAEKKRAVLTAPVEFPKPRLRRKT

SEQ ID NO: 5134 - protein, 413 aa, Bacillus anthracis str. Ames
MIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELINSKEQLKGNLMLSLESTNSRMSRNGKNELLLRKHRSLDEIIESVNTVTKENVDELIRNMFTDEFSAALISPDGKLPKGIKL

SEQ ID NO: 5135 - protein, 371 aa, Medicago sativa
MARVNQNGVAEFPAVQTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQILRGLRYIHSANIIHRDLKPSNLLLNANCDLKIIDFGLARPTMESDFMTEYVVTRWYRAPELLLNSSDYTSAIDVWSVGCIFMELMNKKPLFPGKDHVHQMRLLTELLGTPTDADVGLVKNDDARRYIRQLPQYPRQPLNRVFPHVHPLAIDLVDKMLTIDPTRRITVEEALAHPYLEKLHDVADEPICMEPFSFEFEQQHLDEEQIKEMIYREALALNPEYA

SEQ ID NO: 5136 - protein, 373 aa, Acidovorax sp. JS42
MTTPLTPAPISPVQDIVAELRAGRIVILVDEEDRENEGDLVIAADHVTPEAINFMARFGRGLICLTLTRERCERLRLPPMVARNGTKMGTAFTVSIEAAEGVTTGISAADRARTVQAAVAANAQAADLVQPGHIFPLQAVDGGVLMRAGHTEAGCDLAAMAGCSPSAVICEVMKDDGTMARLPDLQLFAAEHGIKIGTIADLIEYRSRTESLVHKVASRQITTAFGEFIMHAFRDEPSQAVHLALVKGQWDTAESVPVRVHEPLSVLDLLEVGRGMHSWSLDASLQYIHHHGQGVAVLLNCGESAEQLLEQFEGTARAAQAPERGRMDLRTYGVGAQILREVGVAKMQLMGQPRRMPSMVGYGLEITGYIPKE

SEQ ID NO: 5137 - protein, 154 aa, Acidovorax sp. JS42
MFGADKGTADKLDGKKLHIGIVQARFNENITNTLAAACRAELLRLGVQEKHIRHVLVPGALEVPVALQAMAERDEYDALIALGCIIRGETYHFELVANESGAGVTRLALDYQVPIANAIITTENLEQALARQTEKGVDAARVAVEMANLLEELS

SEQ ID NO: 5138 - protein, 221 aa, Geobacter sulfurreducens PCA
MKKIAPSILSADFSRLGDEVRAVAAAGADYIHVDVMDGHFVPNITIGPLVVEAVRRVTELPLDVHLMIEHPDRYIPDFAAAGSDIIVVHAEASTHLHRTIQLIKSLGKKAGVSLNPATPLNCLDYVLEDLDLVLLMTVNPGFGGQSFIEACIPKIQSLRAMLDRRGCEAELEVDGGVKIDNIARIAHAGADVFVAGSAIFGSPDYEATIKELKRRAKEPIL

SEQ ID NO: 5139 - protein, 688 aa, Burkholderia xenovorans LB400
MDSVLPHDVPSGPPAGLPDPALLATLANAFFSALPGSAPQPDGGGVVGGAPSLAGTLPLSAPVLGELSNPVPAGSPLAGPGGAGTGVPGAALPQGRLPGGNLLPSAPTHVLSLGNRAPALAPHAAAQNGLPDSAVTVAPALAPRFGGAALGVSEGHGAQRPSAGGAPAPSAVSSPSASPFYFLGDAGPAHPAAGASSDIVVPGWSEVTAQSLGLPGVDEPLSGQRFSYDRPDEPASAANTHTARAAQPAGSSHYFLNEAQASRLPGQKSGMADAVPHAGASAHPPFDVNAIRRDFPILQERVNGRQLVWFDNAATTHKPQAVIDRLAYFYAHENSNIHRAAHALAGRATDAYEAARSKVQRFIGASSPDEVIFVRGTTEAINLIAKTWGAKNVGEGDEIIVSHLEHHANIVPWQQLAAQTGAKLRVIPVDDSGQVLLDEYRRLLNDRTKIVSVTQVSNALGTVVPVKEIVELAHRAGAKALVDGAQSVSHMRVDVQALDADFFVFSGHKVFGPTGIGVVYGKRAILEDMPPWQGGGNMIADVTFERTVFQPPPNRFEAGTGNIADAVGLGAAIDYVQQVGIENIARYEHDLLAYATSVLQPVPGVRLIGTARDKASVLSFVLKGYETEEVGHALNEEGIAVRSGHHCAQPILRRFGVEATVRPSLAFYNTCDEVDALVSVVRRLSARR

SEQ ID NO: 5140 - protein, 383 aa, Pyrococcus abyssi GE5
MEFEDAFKEVYEMVKPKYKLFTAGPVACFPEVLEIMKVQMFSHRSKEYRKVHVDTVERLRDFLEVKKGEVLLVPSSGTGIMEASIRNGVTKGGKVLVTIIGAFGKRYKEVVETNGRKAVVLEYEPGKAVKPEDLDEALKKNPDVEAVTITYNETSTGVLNPLPELAKVAKEHDKLVFVDAVSAMGGADIKFDKWELDVVFSSSQKAFGVPPGLAIGAFSERFIEIAEKMPERGWYFDIPLYIKYLKEKESTPSTPPMPQVFGLNVVLRIIEKMGGKEKWLEMYEKRAKMVREGVKEIGLGILAEPGYESPTITAVLTPEGIKGDEVYEAMRKRGFELAKGYGSVREKTFRIGHMGYMKFEDIQEMLDNLKEVIEELKKQKGIN

SEQ ID NO: 5141 - protein, 439 aa, Ralstonia eutropha JMP134
MNGKATRIQLLSLRSPQMRAFHLTWMAFFVCFFAWFACAPLMPVIKGEFGLTPAQIANINIAAVAVTILVRLVIGPMCDRFGPRKTYTGLLVLGALPVIGVAFAQSYETFLAFRLLIGAVGASFVITQYHTSVMFAPNVVGTANAAAAGWGNAGGGAAQALMPLLLGAVLMLGVDHAMGWRVALLVPGVLMLVMAVVYWCFTQDCPEGNYSDMRARGQAITGKDGGKGGGWASFRAASANYRVWLLFVTYGACFGVEIFIHNIAATFYVDHFGLSLKAAGLAAGSFGLLALFARALGGWLSDKAARRRGLDARSTLLFVLILGEGLGLLWFAQAGNVVMAVTAMLLFGLFTHMACGATYALVPFIDRKALGGVAGIIGAGGNVGAVAAGFLLKGLGDLQQTLTVLGVLAALAALCAIAIRFSAEHKAQEQALYDSALAN

SEQ ID NO: 5142 - protein, 334 aa, Haemophilus influenzae R2846
MKTLSEFIVERQAEYPNAKGELSGILSSIRLLAKIIHRDINKAGLTNILGQSGVENVQGESQMKLDLFAHNTMKAALMAREEVAGFASEEEESFIAFDTERGRNAKYIILTDPLDGSSNIDVNVSVGTIFSIYRRVSPIGTPVTLEDFLQPGNKQVAAGYIVYGSSTMLVYTTGNGVNGFTYDPSIGTFCLSHENMQMPKTGRIYSINEGQYLKFPQGVKKYIKYCQEEDKATNRPYASRYIGSLVADFHRNLLKGGIYIYPSATNYPNGKLRLLYEGNPIAFLAEQACGVATDGYRRILDIQPTELHQRVPLFVGSEDMVKKAQEMMEEFKEE

SEQ ID NO: 5143 - protein, 427 aa, Glycine max
MASELKEKLRELVKAIVDSDDYSLQAADEAIATLSSLKHLKSPDDFPLPPQFRCPISTQLMSDPVILSTGQTYDRPFIQRWLNEGHRTCPQTQQVLSHTILTPNYLVRDMILQWCRDRGIDLPGPGKDIDEAVTNADRNHFDFLLRKLQLSVPDQKEAAKELRLLTKRMPSIRTLVGESSDTIPLLLSPLAAASTDPDLHEDLITTVLNLSIHDDNKKSFAEDPALISLLIDALKCGTIQTRSNAAAAIFTLSAIDSNKHIIGESGAIKHLLELLDEGQPLAMKDAASAIFNLCLVHENKGRTVRDGAVRVILNKMMDHILVDELLAILALLSSHPKAVEEMGDFDAVPLLLGVIRESTSERSKENCVAILYTICFSDRTKLKEIREEEKANGTLTKLGKCGTSRAKRKANGILERLNRSPSLTHTA

SEQ ID NO: 5144 - protein, 487 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVA

SEQ ID NO: 5145 - protein, 421 aa, Vitis vinifera
MIFNLIVNYIHLTFRVKRHTISVFVGDESGIINRIAGVFARRGYNIESLAVGLNEDKALFTIVVSGTETVLRQVVEQLNKLVNVLKVKDLSREPQVERELMLIKLNADPSKRAEIMWLVDIFRAKIVDISEHSLTIEVTGDPGKMVAVQRNLSKFGIKELARTGKIALRREKMGETAPFWRFSAASYPDLEETIPVNALVRNVKRPLNGNPSTSPGGDVYPVEPFNDFSVNPVLDPHWGALNDEDSSGLRSHTLSMLVNDTPGVLNIVTGVISRRSYNIQSLAVGPAEMEGRSHITTVVPGTDESISKLVQQLQKLIDLHEVRDITHMPFAERELMLIKIAVNTAARRDVLDIASIFRAKAVDVSDHTITLELTGDLNKMVALQRLLEPYGICEVARTGRVALVRESGVDSTYLRGYALPL

SEQ ID NO: 5146 - protein, 531 aa, Oryza sativa
  misc_feature (123)..(123): Xaa can be any naturally occurring amino acid
MDRVLLSSQLSSQTVVNTRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGXDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 5147 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 5148 - protein, 394 aa, Acidovorax sp. JS42
MKFSTRAERIEPFYVMEVAKAAQALAREVAGTREPMIFLNIGEPDFTAPPLVVEAADRAVRSGVTQYTNALGLEALRERISGWYAERFGVDVPARRIVVTAGASAALQLACLALIDAGDEVLMPDPSYPCNRHFVSAAEGKAVLIPTTAEERFQLSAAKVEAAWGTKTRGVLLASPSNPTGTSIAPNELRRIHDVVRGKGGLTIIDEIYLGLSYDDAFGQTALALGEDIISINSFSKYFNMTGWRLGWMVVPEAMVPVVERLAQNLFICASTVSQHAALACFEPDSIAEYERRRAEFKARRDYFIPALDALGLTVPVQPDGAFYAWADCTQAAERLGVAGSWDFAYELMRRAHLAITPGRDFGTADTQRFVRFSTANSMAQLQEAAARLQRLIG

SEQ ID NO: 5149 - protein, 141 aa, Vitis vinifera
MTGCSRIIFRLELKIFISFICLIKIKAKRFWSCISPRKSVCGFISKQEMSCTAVVNQIGTVTESIQAALDSKAAGWGVMVSHRSGETEDNFIADLSVGLASGQIKTGAPCRSERLAKYNQLLRIEEELGHVRYAGEAFRSP

SEQ ID NO: 5150 - protein, 458 aa, Vitis vinifera
MALAPTSSFSLPSRSSIAHPPRRPFTVRCSVAVAPAAARASKEHLVKSVKARQIIDSRGNPTVEVDLVTDNLYRSAVPSGASTGIYEALELRDGDKNVYGGKGVLNAVSNINHLLAPKLVGLDVRNQAEVDAIMLEFDGTPNKSKLGANATLGVSLSVCRAGAGAKGVPLYKHIQELSGTKELVMPVPAFNVINGGSHAGNNLAMQEFMILPVGATSFAEALRMGSEVYHTLKGIIKAKYGQDACNVGDEGGFAPNVQDNREGLVLLMDAIEKAGYTGKVGGLLLFFSFAKQPNDGAHVRSAQSLCELYKEFVKDFPIVSIEDPFDQDDWSSWASLQSSVDIQLVGDDLLVTNPKRIAEAIEKKACNALLLKARVDIVLLQSLLSPARSYFSPMLCSSGFCNQSVISFMNFNLKIYLSLRHLWKWGGIDSLGIIQRTWREIDGKAWNGDAACWILKGY

SEQ ID NO: 5151 - protein, 245 aa, Myxococcus xanthus DK 1622
MKKPIQTTSQAHPWHGITPGEDAPEIVTAYIEIVPTDAVKYELDKESGILKLDRPQRFSSQCPTLYGFIPQTYCDELVAKRCAERTGLKDIKGDGDPIDICVLTEKVISSGNLLVRAIPIGGFRMVDGDEADDKIIAVLESDLVYGELQHLAQLPRALLDRLKHYFLTYKQIPGEGKRSVEIAEVYDQPEALEVIKRSMKDYERIYGPQVTTKARAVRTRGAAVEAKIAKPAKAKTKAARKSRAS

SEQ ID NO: 5152 - protein, 656 aa, Azoarcus sp. EbN1
MHNTLELVLLLLAACVVVVAVFRSLSLPPVLGYLLVGAGVGPHALDLVEASDGASHLAEFGVVFLMFSIGLEFSLPRLFAMKRIVFGLGAAQVLGSLLFTMLAGAIFGLEWGASFALGATLAMSSTAILSKLLSDRLELDRPHGRETIGVLLFQDIAVVPLLILIPALSQPAGELAGTLGIAALKAAVLLALVLVAGQRVMRWWFTVVARRRSGELFMLNVLLITLGLAWLSAAVGLSLALGAFLAGMLISETEYRYQVEEDIKPFRDVLLGLFFVTVGMFLDVGLIMANFAAVLGLLVGLLVFKGVIVFAASRAFGSSSGTALRTALWLCAGGEFGFVLISHIDDVSLIPEALLQVTVAALVLSMLVAPLIVQLSDRLVLRFVASEWLQRSMELTRVAAQTMNTSKHIIVCGYGRSGQYMARFMEQENVSYVALDLDPERVREAGAAGDTVVYGDAARHETLMAAGIMRASALVISFGEVEAALRVMHRAHLLRPDLPIVVRASDEKDMARLSHAGATEVVPEAFESSIILASHALALIGVPLNRIVRRIRDIRNQRYALMRGFFHGASDAADGPDANQARLRSVTLPGGARAVGMTIGAIGLGEIGVGVSAVRRRNIRGLSPGPETQLEEGDVVVLIGIQADLEQAERRLLGGA

SEQ ID NO: 5153 - protein, 157 aa, Zea mays
  misc_feature (28)..(28): Xaa can be any naturally occurring amino acid
  misc_feature (40)..(40): Xaa can be any naturally occurring amino acid
  misc_feature (51)..(51): Xaa can be any naturally occurring amino acid
  misc_feature (73)..(74): Xaa can be any naturally occurring amino acid
  misc_feature (90)..(90): Xaa can be any naturally occurring amino acid
  misc_feature (105)..(105): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
YSLNGPKEVDPPFILVKGPGGFLLRKRXVEGASKKFRVIXVDESKLVKHLXGSGLAVPVRFVPACWDSTRGSXXGAFQRSGCKAKLRVRXGGETAAVTDTGNFVXDLYLERDMEDLEPAXEXILRXPGVVEHGMFLGIATTLIVAGKSGVTVKDRFG

SEQ ID NO: 5154 - protein, 580 aa, Vitis vinifera
MGNNCVGSMVPEHGLFESISNSIWWTRASECMTSHSTGEGVSETQSKEQKSPPPVQNKPPEEVELINPPEVMKITKEETKPTPTPKRPLLMKRLPSAGLEVDLVLKDKTDHLKEHYNLGRKLGHGQFGTTFLCVEKETGKEYACKSIAKRKLLTRDDIEDVRREIQIMHHLAGHSNIISIKGAYEDAVAVHLVMELCTGGELFDRIAKRGHYTERKAAQLARTIIGVVEACHSLGVMHRDLKPENFLFVNEQEESLLKTIDFGLSVFFKPGEIFTDVVGSPYYVAPEVLRKCYGPEADVWSVGVIIYILLSGVPPFWAESEQEIFQEVLHGDLNFSSDPWPHISESAKDLIRRILVRDPKKRLTAHEVLCHPWIQVDGVAPDKTLDSAVISRLKQFSAMNKLKKMALRVIAENLSEEEIAGLKEMFKIIDTDNSGQITFEELKAGLKRFGANLNEAEIYDLMQAADVDNSGTIDYGEFIAATFHLNKIEREDHLFAAFSYFDKDGSGYITPDELQKACEEFGMEDVHLEEMIQEVDQDNDGRIDYNEFVAMMQQGNNNDFGKKGLQNGISFGFRQPLPVY

SEQ ID NO: 5155 - protein, 241 aa, Hordeum vulgare subsp. vulgare
MDMGLEVSSSPPSSSNENASGRSSTAKRPAGRTKFRETRHPVYRGVRRRGNAERWVCEVRVPGKRGARLWLGTYATAEIAARANDAAMLALGGRSAARLNFPDSAWLLAVPSAHSDLADVRRAAVEAVADLQRREAAGGSISATVDEEASCGAPAESSSESDGAGSSETSKPSADGDLAVPVGMDIEMFRLDFFPEMEFGSYYASLAEALLMDPPPVANSTGAYWDNGEFGEVATEFALWS

SEQ ID NO: 5156 - protein, 341 aa, Physcomitrella patens subsp. patens
MATVSPWRQGMSGKFQNEAEVAALLLEREALEVACEGFSNIIGSSSECVVYKGTLSNGTEISATSIQTVATNWSSQNEMSFRYKVKALARMKHPHLVNLTGYCTHEDPWTRIFVFEYASNGILYDHLHNKDNEHLNWAARMRIVLGAAYGLKYMHHELVPPATHLNFGADSVFLTDDHAAKLSNFGLMSVPISSNSSQKTSSFTLKSIKHVNAESPDLQSPGFDFDIHSFGVFLLEVITGRAPQREGAASLVEWAGEYLSDPEMMWYMVDPTLKYYNHDELVGLCKIVAQCLSTETQRPSMLQICDKLGELLRLTPALVAAKSTAALWAQLELQDTVSSEM

SEQ ID NO: 5157 - protein, 241 aa, Hordeum vulgare subsp. vulgare
MDMGLEVSSSPPSSSNENASGRSSTAKRPAGRTKFRETRHPVYRGVRRRGNAERWVCEVRVPGKRGARLWLGTYATAEIAARANDAAMLALGGRSAARLNFSDSAWLLAVPSAHSDLADVRRAAVEAVSDLQRREAAGGSISATVDEEASCGAPAESSSESDGAGSSETSKPSADGDLAVPVGMDIEMFRLDFFPEMEFGSYYASLAEALLMDPPPVANSTGAYWDNGEFGEVATEFALWS

SEQ ID NO: 5158 - protein, 618 aa, Zea mays
MSGPLDRFARPCFEGFVHNDERKESRSDADNSEGDKKTKIGSFKKKAINAGNKFRHSLRRRSKKKTERGDSIKDIRDVKELQDVETFRQCLIDEDLLPPQHDDYHMMLRFLKARKFEVEKAKSMWSDMINWRKEFGVDKIEEFDYTELDEVTEYYPQFYHGVDKEGRPVYIELVGKVDANKLIQVTTLDRYVKYHVKEFEKCFQMKFPACTIAAKKHIDSSTTILDVQGVGFKNFSKSARELITRLQKIDSDNYPETLCRMYIINAGQGFKMLWSTIKSFLDPKTASKIHVLGNKYQHKLLEIIDECELPEFLGGKCNCIEGCQRSDKGPWKDPNIIKRVLNDEANYGRQIVTISSIDGKIIRYARPDHPTRKGSDASAESGSEVEDVTSPTASRNLITHPILTPVHEESKLSPHGSTFVAHASIEENIPVVDKVVDDGWGTPRGSLQASSGSLPSRNTHGTFEGLRVQAVAWLTFLITALFATLCSVPSKMARRISSQSSKHDDYRGEYPQEEEEHKEEFRPPSPAPSYTEKDVLSSMLRRLGELEGRVQVLETKPSEMPFEKEELLNAAVRRVDALEAELISTKKALYDALMRQDELLAYIDRQELIKFRKKKFCF

SEQ ID NO: 5159 - protein, 398 aa, Sinorhizobium meliloti 1021
MHSETKSQALQGRRTIRMRTFEVKGSTKQSRSAIETVLRELRRSPLLALIFFVPVVILLERMAPKAHTLLFFVAIAAIVPLAALLSRATESVAAKTGDAVGGLLNATLGNLTELIITLAALQAGQYLLVKASIAGAIVTNSLFMFGGAFLIGGLKHHLQEFNRVNARFQAILLFLATIAILVPSLTSGLDRTPAAEFSQQLSLGLAILLIVVYGLGMVFSLKTHKELFASVGQAEAGEEPWPLSIGIVVLIVVTLLVAMVSEIFVGSVQAAAQHLGLTPAFVGFIVIALVGGAAEMTTAFSAARANRLDLSVGIALGSAAQIALFVAPVLVLVSYFIGPQPMSLEFWPGAVAMMLVATMAATLLSNGGHAAWYAGVMALAVYAIFALTLFLLPPGVTQ

SEQ ID NO: 5160 - protein, 452 aa, Sinorhizobium meliloti 1021
MTEHSLNVAMEAASKKKMNLVQLTFIVAVNMMGSGIIMLPANMAQVGAISLLSWLVTAVGSMAIAYGFAQAGLFNQRPGGMSAYAEDAYGKPGYFLVFLLYFLSLAVGNVAIGISAVGYLAGFFPWLTSTPIATCVSLIILLWLTTVANFGGPRVTGRIGSITVWGVILPVGLLCIIGWAWFSSEVFAAAWNPNGLTLVQGMGSSISLTLWAFLGMESAAQNSDAVENPKRDVPLACLFGTLGAAIIYILSTTVIQGIVPNAELAASTGPFALAFATMFNPAIGSVVMALAVLACVGSLLGWQFTIAQTARAAADERMFPSLFSRVNEMGAPVTGMIVMGVVQSLLALMTISPTLNEQFAALVNLAVVTNVLPYIISLSALFVMMRAAGVSESKFRLNSSIAIVGMLYSVFAIYASGKDAVLGGMLVTGIAFIIYGLIAPRFTPRPGIVRTA

SEQ ID NO: 5161 - protein, 241 aa, Hordeum vulgare subsp. vulgare
MDMGLEVSSSPPSSSNENASGRSSTVKRPAGRTKFRETRHPVYRGVRRRGNAERWVCEVRVPGKRGARLWLGTYATAEIAARANDAAMLALGGRSAARLNFPDSAWLLAVPSAHSDLADVRRAAVEAVADLQRREAAGGSISATVDEEASCGAPAESSSESDGAGSSETSKPSADGDLAVPVGMDIEMFRLDFFPEMEFGSYYASLAEALLMDPPPVANSTGAYWDNGEFGEVATEFALWS

SEQ ID NO: 5162 - protein, 401 aa, Synechococcus sp. WH 5701
MAKRSLTSLSAADLQGKRVLVRVDFNVPLDESGAITDDTRIRAALPTIHDLISKGAKVILAAHFGRPKGEVNEAMRLTPVAARLSELLGKPVVKTDSCIGPDAEAKVAAMADGDVVLLENVRFFAEEEKNDTEFAKKLAALAEVYVNDAFGAAHRAHASTEGVTEYLKPNVAGHLMEKELQYLQGAIDEPKRPLAAIVGGSKVSSKIGVLEALIDKCDKVLIGGGMIFTFYKARGLAVGKSLVEEDKLELAKELEAKAKAKGVQLLLPTDVVLADSFSPDAKTLTTSVNVIPDGWMGLDIGPDSLKAFQAALADCKTVIWNGPMGVFEFDKFAAGTNGVAHTLAELSGKGCCTIIGGGDSVAAVEKVGVAEKMSHISTGGGASLELLEGKVLPGVAALDDA

SEQ ID NO: 5163 - protein, 483 aa, Ralstonia eutropha JMP134
MNALTMLIGGQDRPAANGATFERRNPVTDVVASRAPAATPEDAIAAVEAAAAAFPAWAALGPGERRKRLLRAADMMDSRTDEFIAAGAAETGAMPNWIGFNVMLAANMLREAAAMTTQIDGSVIPSDVPGSLALAVRQPCGVVLGIAPWNAPVILATRALAMPLACGNTVVLKASEACPALHRMIGTVLEEAGLGSGVVNVVTHAPEDAATIVETLIAHPAVRRVNFTGSTHVGRIIAQHAAKHLKPALLELGGKAPVIVLDDADLDAAVEAVAFGAFFNQGQICMSTERVIAQRAVADLFVEKLAAKARTLRAGDPSDPSSVLGALVSTQAAQRIRALVEDARSKGARLPVGLHGDGAILQPAIVDGVTPEMALYREESFGPVVTVARVDSDEAAIQMANDSEFGLSAAVFSRDVPRALAVAKRIESGICHINGPTVHDEAQMPFGGVKGSGYGRFGSKASVDAFTELRWITIQSGPRHYPI

SEQ ID NO: 5164 - protein, 191 aa, Glycine max
  misc_feature (184)..(184): Xaa can be any naturally occurring amino acid
MSNLLRHSLSKFTFSPNGTPTGREKVTPKHKHLRPFQCVLTQDNRSIAVKNGNDSLVICRVVNGMWQTSGGWGRIDRDDAVDAMLKYADAGLTTFDLADIYGPAEDLYGIFIDRVRRERPPELLEQVRGLTKWVPPPVKMTSSYVRDSINVSRKRMDVESLDMLQFHWWDYSNPGYLDALKHLXTDLKEEG

SEQ ID NO: 5165 - protein, 262 aa, Bacillus anthracis str. A2012
MGGIMLKFLSVRVEDHIAVATLNHAPANAMSSQVMHDVTELIDQVEKDDNIRVVVIHGEGRFFSAGADIKEFTSVTEAKQATELAQLGQVTFERVEKCSKPVIAAIHGAALGGGLEFAMSCHMRFATESAKLGLPELTLGLIPGFAGTQRLPRYVGKAKACEMMLTSTPITGAEALKWGLVNGVFAEETFLDDTLKVAKQIAGKSPATARAVLELLQTTKSSHYYEGVQREAQIFGEVFTSEDGREGVAAFLEKRKPSFSGR

SEQ ID NO: 5166 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 5167 - protein, 441 aa, Sinorhizobium meliloti 1021
MSAPSSGKSLGLAACTAIVVGNMVGSGFYLSPAAVAPYGNLAIVIWIVMGAGAICLGLTFARLAKLSPAVGGPYAYTRLAYGDFPGFLIAWGYWISIWASLPVIAVAFAGVVIDFFPFLRGRGTATLLTLSVIWLVVLVNLRGVHAAGLFSEITTYAKMIPFGAVALLGLFYIDFSHFADFNPSGQPLLQASAALAPLTMFAYLGLESATVPAGDVRDAERTIPRSTVLGIAIAVTLYVLGTIVVMGLVPREELVHSVAPFSEAARRMWGPAGELAISLAVVLSSIGALNGWTLLMGQVPMAAARDGLFPPLFSRLSARHVPATGIVVSATLATILVLVQAAGSEGFSSIYRLFVGLSTMTAVIPYAFCALASSLVSARVSGGTLIPRVTLIELVGFTFAIFTLYGCGAEPVLYGLVLLLLSIPVYIWQRRRSFVPGDFGQ

SEQ ID NO: 5168 - protein, 547 aa, Physcomitrella patens subsp. patens
MSMDHELNVLKDDVKTGSEIFVKNKKAMEELLLDLQQKVEKVRLGGGVKAVERHKSRKKYLPRERIDYLLDPGSPFLELSQLAGHELYTDDLPSGGIVTGIGSVHGRLCMFVANDPTVKGGTYYPITVKKHLRAQEIASQCNLPCIYLVDSGGANLPRQAEVFPDRDHFGRIFYNQARMSEEGIPQIALVLGSCTAGGAYVPAMADESVIVKGNGTIFLAGPPLVKAATGEEVSAEDLGGAALHCKISGVSDHFATDELHALAIGRKIVKNIHFAGITNRSSPSNVMSEESRDPLYSPDELHGIVPADARISYDIRSVIARIVDGSEFDEFKKLYGSTLVTGFARIMGQPVGIVGNNGILFTESALKGAHFIQLCAQRHIPLIFLQNITGFMVGSRSEASGIAKAGAKMVMAVACAKVPKITIVVGGSHGAGNYGMCGRAYSPNFLFMWPNARISVMGGAQAAGVLAQVERDKRRRDKTEWSEEEEEKFKEKVMQGYDREGHPYYASARLWDDGIIDPADTRRVLALCLSASLQTSPKETKYGVFRM

SEQ ID NO: 5169 - protein, 601 aa, Gloeobacter violaceus PCC 7421
MGLIVQKYGGTSVGSAERMRSVAERIARTHRQGHDLVVVVSAMGHTTDALVKMACEMHGEPDPREMDMLLTTGEQQSVALLTMALHALGCKAISLTGAQVGVVTEPNHTRARIRRVQTGRINELLAAGYVLVVAGFQGICHSRFWEITTLGRGGSDTSAVALAAVLKANRCEIYTDVPGVLTTDPRLVGDAALLEEITSEEMLELASLGAQVLHPRAVEIARNYAVPLVVRSSWSDAPGTIVLSPRLPVDRAIDNLETERPVDAVYIDNHQAKIALLRVPDRPGVAAALFGHLAKAGIDVDLIIQSIHHPNAPEPTNDIAFTVQRSDLAAAVATSETAAAALGGCAVVVDPVPTKVSIRGAGIIGRPGVVAQMFKALAEARINIQMISTSETSLSCVIAGEQAEKAGEVLCGQFGLRAPVYEEPPVVSGARPVAQAVRGVALDTNQAQVAILQIPDRPGVAAEIFQCLAQEGIAVDMIVQSQRGADTNDIGFTVSRSAVRAAQRALASLCMGFAGCGGVVVRESVAKLSLVGAGIVGTPGVAARMFETLASLGTNIEMISTSTIKVSCIVEAACCEASLQAVHRAFGLGSGAMVAVEGRSS

SEQ ID NO: 5170 - protein, 461 aa, Vitis vinifera
MVEEDAFFNEQADQPEGTSFGTLAAEITSTTSEFFYNNDELDLDCPTEGFSSVAEAIEDIRQGKFVIVVDDEDRENEGDLIMAGSLVTPHAMAFIVKHGTGIVCVSMKGEDLERLQLPLMVTQKENEEKLCTAFTVSVDAKHGTTTGVSAHDRATTILALASKDSKPQDFNRPGHIFPLKCREGGVLKRAGHTEASVDLAVLAGLEPVAVLCEIVDDDGSMARLPKLRQFAEVENLKIISIADLIRYRRKRDKLVEKAAGAPIPTMWGPFKAYCYKSMLDGVEHIAMVKGEIGNGQDILVRVHSECLTGDIFGSGRCDCGNQLALAMQQIEAEGRGVLVYLRGHEGRGIGLGHKLRAYNLQDDGRDTVEANEELGLPVDSREYGIGAQILRDLGVHTMKLMTNNPAKYHGLKGYGLAIVGRVPLLAPITMENRRYLETKREKMGHIGLDIAGHVNGSHQQK

SEQ ID NO: 5171 - protein, 699 aa, Vitis vinifera
MKLVLLLIICLLCLCLCLTAEASTPLEYLVKPNCQSQCGNVVIPFPFGIGESCYLNEWYSVNCSNTSGAAKPFLNPTKLNLELLNVSLEYQTVTVYSPIASYDQQKGSSELQTSINLDQSPFLFSTLDNIFVVLGCGHAKLMEHEKIWAGCTSINCSDSFPDQGCYGINCCQTTIPTIDSYYLSTYSVKFTLDDEGNNHSTSTHAFLVDRDWFSRNFTELEDVSVKYAALSLLWMIKEGDNADSSCNGSNYYSLSIGSYVRSSCGCPPRYEGNPYLHDGCDHDNKVFFFLFNLSPTTAGFSIGGGSLLLLLGSFGLYKVVKKKKEIRLKKRFFKRNGGLLLEQQISSDKVAVEKTKIFTSKELEKATDNFNLDRILGQGGQGTVYKGMLTDGRIVAVKKSKIVDESQIEHFINEIVILSQISHRNVVGLLGCCLETEVPLLVYEFISNGTLFQHIHNQDSDFPLSWKMRLQIAIEVAGALAYLHSACSIPIYHRDIKSTNILLDDKHRAKVSDFGTSRSISIEQTHLTTLVHGTFGYLDPEYFQSSQFTEKSDVYSFGVVLVELLTGQKPICSTRSQEEKSLATHFILSLQESRLFDILDAGVVKEGEKEEIMALAYLAYQCLNLSGRKRPTMKEITMELEHIRMSLPPLKVEQNFEENACIEMEIIGPLDSTSSFRRSCLNYPKASSSDEQPLLFNAL

SEQ ID NO: 5172 - protein, 467 aa, Pseudomonas aeruginosa
MEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 5173 - protein, 597 aa, Oryza sativa Japonica Group
MGGEAPEARRLDRAMSFGGAGSIPEEALHLVLGYVDDPRDREAVSLVCRRWHRIDALTRKHVTVPFCYAASPAHLLARFPRLESLAVKGKPRAAMYGLIPEDWGAYARPWVAELAAPLECLKALHLRRMVVTDDDLAALVRARGHMLQELKLDKCSGFSTDALRLVARSCRSLRTLFLEECSIADNGTEWLHDLAVNNPVLETLNFHMTELTVVPADLELLAKKCKSLISLKISDCDFSDLIGFFRMAASLQEFAGGAFIEQGELTKYGNVKFPSRLCSLGLTYMGTNEMPIIFPFSALLKKLDLQYTFLTTEDHCQLIAKCPNLLVLAVRNVIGDRGLGVVADTCKKLQRLRVERGDDDPGLQEEQGGVSQVGLTTVAVGCRELEYIAAYVSDITNGALESIGTFCKNLCDFRLVLLDREERITDLPLDNGVRALLRGCTKLRRFALYLRPGGLSDTGLGYIGQYSGIIQYMLLGNVGETDDGLIRFALGCENLRKLELRSCCFSEQALARAIRSMPSLRYVWVQGYKASKTGHDLMLMARPFWNIEFTPPSSENANRMREDGEPCVDSQAQILAYYSLAGKRSDCPRSVVPLYPA

SEQ ID NO: 5174 - protein, 422 aa, Pyrococcus abyssi GE5
MDPLKFHKGGKIGVISKVPLKTREHLSLAYTPGVAEPCKAIAKDPEKVYEYTSKGNSVAVVSDGSRILGLGNIGPLAGLPVMEGKALLFKRFGGIDAFPIMIGEQDPDKFIEVVKAISPTFGGINLEDIASPKCFYILDKLREELDIPVFHDDQQGTAAVVLAGLINALEVVGKRLDEISVALFGAGAAGFATLRILVKAGVKPGNVRVVELVNGKPMVLTKDLDLEKLFPYRGWLLEKTNDEGIEGGPEEALKGADVLISFTRPGPGVIKPEWIREMSDDPIVFPLANPVPEILPDEAKKAGARIVATGRSDYPNQINNLLGFPGIFRGALDVRARSITDDMIIEAAKAIASVVEEPSEENIIPSPFNPIVYAKEARAVAEEAMKEGVARVKVKGEEIEERTLKLISLWDDILGEVADKLS

SEQ ID NO: 5175 - protein, 340 aa, Burkholderia mallei ATCC 23344
MSTKGTILVTGGAGYIGSHTAVELLAHGYDVVIADNLVNSKREAIARIEKITGKTPAFHETDVSDERALARIFDAHPITAAIHFAALKAVGESVAKPIEYYRNNLDSLLSLLRVMRERAVKRIVFSSSATVYGVPERSPIDETFPLSATNPYGQTKLMAEQILRDVEAADPSWRVATLRYFNPVGAHESGLIGEDPAGIPNNLMPYVAQVAVGKLEKLRVFGSDYPTPDGTGVRDYIHVVDLARGHIAALDALERRDASLTVNLGTGRGYSVLEVVRAFEKASGRAVPYELVARRPGDVAECYANPAATAETIGWKAERDLERMCADHWRWQENNPRGFV

SEQ ID NO: 5176 - protein, 435 aa, Physcomitrella patens subsp. patens
MGKRVYEVWNGSNRFFLCGRLIFGPDVRSLLVTVFLIVAPSTCFCIFVGRHLLHHFSGGGGVAIIAVTAVYTAYVLVLLLLTSGRDPGIIPRNTHPPEPEEEFEPNTSPGEWGGQTPRLRLPRTKDVMVNGVVVKTKYCDTCMLYRPPRCSHCSICNNCVLRFDHHCPWVGQCIGQRNYRFFFMFVSSTSLLCVYVFAMCALYIKILMDEGDRTVWKALSKSPASIVLMAYTFICVWFVGGLTVFHLYLIGTNQTTYENFRYRYDNKVNPYNQGCPLNFNEIFCSKIPASKNQFRSRVPEAVPGQMGAVQHTRDMGEAHGAPKGPDLEQGYKATWPNAEDMVGEGGELEMAGGRVSTGSELGLEMKDSFDPRPLEQGRPAVSNRRTSRGRQSGSWEITSDILALSSGEGGEGHNIPGRGHVQSRYNGETMAISKR

SEQ ID NO: 5177 - protein, 334 aa, Sinorhizobium meliloti 1021
MSFNLRNRSLLTVQDYTPREFRYLVDLARDLKRAKYARTEQEHLKGKEICLIFEKTSTRTRCAFEVACSDQGANVTYLDPAGSQIGHKESFKDTARVLGRMYDAIEYRGASQAGVETLAKYAGVPVYNGLTDEYHPTQMIADVMTMREHSDKPISEIKYAYIGDTRSNMGHSLLIVGCLMGMDVRICGPRSLWPSEEYQTIAKRLKAQSGARLMITDNPREAVEGVDFIHTDVWVSMGEPKEVWKERIQLLTPYQVNAELMAASGNPQTKFMHCLPAYHDTETTIGKQISDDYGMSDGLEVTDEVFESQANIAFEQAENRMHTIKALLVATLGD

SEQ ID NO: 5178 - protein, 218 aa, Hordeum vulgare subsp. vulgare
MEWACCGSGYSSSGTQSPAAGDGEEGSYMTVSSAPPKRRAGRTKVRETRHPVYKGVRSRNPGRWVCEVREPQGKQRLWLGTFDTAEMAARAHDVAAMALRGRAACLNFADSPRRLPVPPQGAGHDEIRRAAVEAAELFRPAPGQRNAATVAAATAPPVALGNAELVADSPYYPMDGLESEMQGYLDMAHGMLIEPPPMAWPSTWIEEDYDCEISLWNY

SEQ ID NO: 5179 - protein, 698 aa, Candida albicans SC5314
MKDINATENNLASKFQRFNDKTLENLINQISKIYSSNNLLVLDAVLSPLINSLTNFTKLKELGKFQNIVWLDNELVSIGSSVLAKYASLIVVVPTSSLENINILNKLIHSQPDLHSLKLNIIVKDLKMSFMYQINKVFNGIVNFESILSPEKYQKPISVTSRIKIYNWKTSPIYTDEILVTEINKFNGIDDYFSKPLKQVNQLSEALMQLLFMGIQNGKHDHLFKLRNIYGKGNHSKLLIDQLQNSKIPEFMNENMTTLEIDFYSDVLHSNTDLVVLERNLDFTSCIFNQLNYHGIIDDMFSIKFENIEQLSSNEISKSLANDKLYSQDLKHLNFSSIGLRLNKLAKYIQQQFKTSSAQKNSSSSEPNISDIKQLVSNLGTLSIQQELVKKHTIIGEEVMEKINKNYEQFLTFQNDIFEMDYKSQVAKLREFVNCNYPIEFVLSAILLIGYLNDGISNKEIDWLSLEMQDNYGLEAVFTLEKLIKFKMIRVIHGSSVDFFSSLGFTSQKKKPTTHSQSEFEDDKNVGISGSGDVFRNNYTLINKFWNLHPLDDDESLSQNLTESGSNESTNLLDLYSNPSFTLPGNTVPLIYRFVEALYFRDFLKHKPINNLKRRPNWDNLGVNTMFAGKTIDLNLDNVNDDRSKYLVIVVIGGVTRSELTCFKYLQERFRKQGKTKEIIIVSNGIVNSSKLMQFMSN

SEQ ID NO: 5180 - protein, 141 aa, Synechococcus sp. WH 5701
MERVELVARLAAEWMAAGFTHGVLNTDNMSLVGESFDYGPFAFLEGWDPGFTAAYFDAVALAAMDPERPDPVPLTLQLLAAWPVAYGEFFAALADRLKRIWAAIDERDDWQPLHDWLDRCGSSHSAGSGCSALQLPPQDSV

SEQ ID NO: 5181 - protein, 386 aa, Mannheimia succiniciproducens MBEL55E
MALDLSEIRQQITQIDRSLLKLLSERHRLAFDVVRSKEITQKPLRDEKREQQLLQELINFSENENYQLEPQYITQIFQKIIEDSVLTQQVYLQKKLNEQREQSIHIAFLGKRGSYSHLAARSYATRYQEQLIELSCSSFEQIFEKVSSGEADYGVLPLENTTSGSINEVYDLLQHTDLSLVGELTYPIKHCVLVNGQDDLSKIDTLYSHPQVIQQCSQFIRSLNKVHIEFCESSSHAMQLVSSLNKPNIAALGNEDGGHLYGLTVLRSNIANQENNITRFIVIARKAITVSPQIHTKTLLLMTTGQEAGSLVDALTVFKKYQIKMTKLESRPIYGKPWEEMFYLEIEANTNHPDTQAALEELRQYSTYLKVLGCYPSEIVKPVDVR

SEQ ID NO: 5182 - protein, 269 aa, Rhizopus oryzae
SDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSILDHLSYFDINEGSCL

SEQ ID NO: 5183 - protein, 619 aa, Clostridium perfringens SM101
MSEILQKITDPKEIKDLDEKELEMLAKELREFLIESVSNTGGHFASNLGVIDLTVALFKNFDFSENRIIWDVGHQSYAYKILTGRKDKFNTLRQYGGLCGFPKRTESEYDFFATGHSSTSLSSAAGMARAQKILGKDNKVIAVIGDGALTGGMALEALNDIGYRKDNLIIILNDNQMSICKNVGGLATYLNKLRMGVGYNKLKSDIGSTLDTTSLGKRVKNSLSKLKDGIKKIVVPSMYFEDIGLKYFGIVDGHNIRELNEVLSIAKSIKGPVIIHTVTKKGKGYELAEKNPNKYHGVSPFDLGEGVISKFANRNYSSTFGEEMIKLAKNDDKVVAITAAMPDGTGLKDFREEFPDRFFDVGIAEQHAVTLAAGMAAEGLKPFFAVYSTFLQRAYDQVLHDVCIQNLPVTLCLDRAGLVGEDGETHQGIFDISFLSPMPNMTIVAPKCIDEMEVILKWASNFNAPLAIRYPRGGDIDVNLKPLSKIEYGKWEKVQEGEKIAIVATGKMVQHAMIAAQKIKEEKNIDILIINATFIKPIDKELLNSLSKDGFKIVTIEDNIKKGGFGEGVLEYLNEIGHEEKIVTLAFNDKFIEHGKPDILYRINGLDAEGIKNTLIELL

SEQ ID NO: 5184 - protein, 3510 aa, Magnaporthe grisea 70-15
MHQATLGALVGIVAQIQADDLSMAASVTRELLPLLSHWWQPHSSKNDKLLNSVRDEILRAVFILLPHMDAILRAADDGPLLDEILELMDALWLEYSRRDDRLHLQLTDLDFSSLKVDYFKTEIFGLRPFDMSSERKWAILEAMAQLELLYSRKVRQQRCPPADPDQDQPRKRRRVECGQDRIHQKLNSPDDGLKLVALQLLSFTFKNERPSQENYFSDMNDIVRLLSHKQSTIASWAMIACASYSLHPQAKATDISALWSQAWQVAVRSVSHQGTSRAASFLLYSILKSDILALHETADSITTMVTAADISGPAVVADSSLILMLHLLHLRNTMLPGAGQITCNHVIRWVFSKWNPSDGAYAMSNSTFTSVIDLANLLRACCGSQNVPEKPLIPVPGGPVYQYWSQQRNDHDLMRYLLLSESTSTCDRSESPKSQAYTSDSEEARHVTDAADANAARKLIAELLHPKLSDSVTMSESWAQSKAKVSTDRLRSVLQCALSSLVIIPELNQMKISLSQEVETSTQTLVEILLDLIMTADDTQDFSDIHEGFHWDIKMRLRLLSFFLDDEEHIGILPTDFVGTLVQLSEEEFLYSTRLLKECLRSDFTVRTADASRIIETVGSVIGEDNAACEVVLVVCIDMIELLIPVWSDDQELSGPIGDLYLFLVDKGSPGNNLSQRAQARLADLLLTLLEKKPDYGTSLNYKSCRSSLFSLIKEGALWLKFNIGSKLPKIFELYVFKVHDELFLDILDCLPTDSDHREGIAFRLYLLAEIARQWPTTLRRGIYTIFETSGHILTSVYHAQRCLSSVAEYLDLESPKELFRLFTPQLLYTWLESSALETIPYGIFGFSSLEELLKQAKSEAISLMMMRGQEDQAENLAQTLRTTTAKLIQENFARAIAYSVAHDICGQKNASRDKHVTSESIVKRIMGKESFYQHVNLEFVDIIGILFDIIDQEDPIEAKCFAKNPSLKYAADISAKIKGFGHSEVILPPNQQPLFRARHLTQELEHICGRTQHELQSLWSPALVVSVCRKLLNTIQAAMGPLHACAVIRKVRILVCLAGDHAVSLYPLEMILHSIRPYIGDPECADDALGITRYLILSGANHLARVPAFLAGYALSTLASLRLFLESSQSSTTQESQFKATKSNAQTFHKWFTDYLTSYESSGFRNESQRQAFRKITQAAAQIGTSGNAEKETHESSLLLEILKDGANRHRLLNQSSRDLALAMLCGDFKPPPPGPKDVIDTDDGAIKHSTMVWESCKAQSLHANYLTWAGRVVGKSFAASGEVQEKLLRESRLADYARLAGRDLGSEEGILEAIEALITDRDCATAGLAEAALRKIVTETTAAQDNSLSMACQHSLSEAVHASSDWAPYSIPPSDYVEVSQMKDAELFSRGRIDALDWSQSMAVFLAKSVPSYTILAQLPPLLLKSKSFADRVFPFIVHLVLFLQLDTQQTVRRKLSDSLKEWLVMDTPVARENIKLLINTVLFLRTQPLPSETSIADRSTWLEIDLAALSTASTRCGMYKVALVFAEIAFSEASQKTSRRSSAARDLDTTDSTEILLEIFENIDDPDAYYGLPQISNLDNVLSRLEYEKDGMKSLAFRGAQLDDHVRRRDSSATKDGQSMVRTLGELGLSGLAHSLLQTQQGLDGQSSSIGSTFETARRLAIWNLPVPPNQDHRAVTMYKAYQSIHQATDLISAQQAVHQGLSSTIRYLTGSSLKAFHLRQHLGALAALTEIDESLTIQGSVDGLCRRFEGRSEWMMSGRYDDVRQILSCRESTLGLLSQHSHFQKSQKLTAAMTRTLEVQALLLSAGIFRYHDATQESLNISTSLNNLIQPCEAMGLNVDAAIKVEVANSFWDYGEMIPSIRMLQSIEGECALKKQTIDVNRADLLASIGHQVSVAKLESSEEIQRKYLQPALKELRGNNEGKAAGKVYHQFAVFCDEQLQNPDSLADLNRLKGLEKGKSDEVTQLSAIVSKTKDQMLKQRYTGMLNKARTWLDLDRQELRRIEQTRSQFLQLSLENYLLALSASDEHHDDALRFTALWLERSEEQATTQAVQTHLHKVPSRKFAPLINQLTSRLQEAETSFHKLLQNLVFRICCEHPYHGMYQIWSGMKSKINKDDEIAVLRSKAMVRISEHLGKHKKVYSIWQAVNYTNAKYYALAIDRGPEKGYKQGQKVAIHNHAQAKPLQDSLFKYRIPPPTMQMELRADCDYSTVPVIAKLEPEMSIASGLSAPKILTAVGSDGVRYKQLVKGGNDDLRQDAIMEQVFAAVSSVLKLHRTTRQRNLGIRTYKVVPLTTSTGLIEFVPNTIPLHDYLIPAHERYYPKLWRGSQCRKEISNAQGKPVEERIRAYRKATERFPPVMRYFFMEHFPDPDEWFVRRLAYTRTTAAISMLGHVLGLGDRHGHNILLDSRTGEVVHIDLGIAFEMGRILPVPELVPFRLTRDIVDGMGITKTEGVFRRCCEFTMDALREETYSIMTILDVLRYDPLYSWSISPVRLAKLQDTTTSRDNETGAPGVDVKAVVENRKVVNEPSEAERALEVVRKKLSKTLSVTATVNDLINQATSERNLACLFSGTYFKVELMAGLIAYRAVMDHWQPSSCQTGKDPKANKNRKNPYYDFTTSISPPFRSIQDLTGFMLPTYNIGDGAAAATSSPPSQGQPKRRHRVDSNPLAYWGGPPADHDPDPKRIRPEQPGSTTMSAKAFGKRPATDGNMAGFGGHTGFALPQAAPALKTYLGARKLVVKNLKQQQTPAVDDYYTRAYNDLESALQDIFQGRQPRQPLDRLYRHVESICRRDESAKLFKILQSRCDGYVREEVLPKVMAKDNGSEIDMVRIVHQYWKDWSRKAVVIRSLFSYLDRTFIVKQGKDHDLNDVTITSFRRVIYGPRHSDGPLAGRKDELPGLKVMRGMLQLVTLDRAGDRTFDGPLLKDAVKMLHVFNVYGKEFEEPLLADSVRYFEAFALEKSENYDLKDYVASVRALINREDMRCNVYNFDSTTKRELMSDIQRIAIQDHTDKLLDVTEVGRLIGEADIESLKGLYELLRMTGQHMDLRGPWEEYAIASGSKIISDTERGDEMVVLLLELQRKLLNIIRDAFGGNDDFRKNMRDAFCRFMNDKAAKNTSTDVGERVAKYIDMLLRGGLKALPPSLMGDYKDRTETERADVASAGDEDAELNRQLDNGLELFRFIQGKDVFEAFYKRDLARRLLMARSASQDAERTMLAKLKVECGSQFTHNLEQMFKDQEVGKEELAAYKEWRRSSDRANKLSKIDLNVNVLSASAWPSYPDDPAVALPAGVLENLQHFEQYYKNKHEGRKLTWKHSLSQCVIKATFPRGTKELVMSAHQAAVLAIFNSVEIDEPLSYEEIEKASGLSGDLLQRTLQSLACGKARVLAKAPKGREVGKEDTFTVNKGFTDPKIRIKINQIQLKETKAENKETHERVAADRQFETQAAIVRIMKSRKTLPHAQLVAEVIEQTRRRGALEPAEIKANIEKLIDKEYIEREGGNYVYMA

SEQ ID NO: 5185 - protein, 174 aa, Roseovarius nubinhibens ISM
MTIYALKDTAPQLAEDVWIAPSAELIGKIVLEEKTSIWFGAILRGDNEEIVVGAGSNLQEQVMCHTDPGYPLRIGANCTIGHKAMLHGCTIGENSLVGMGATVLNGAQIGKNCLIGAGALVPEGRIIPDGSLVVGVPGKVIRELDTAAIDGLKASALSYQRNAARFREELRRLG

SEQ ID NO: 5186 - protein, 171 aa, Gloeobacter violaceus PCC 7421
MFENLTEDIKVFRQHHGGSWLSFLYYPMFTAVVLYRFSSWCYRHRLKPVAYLTVRLNDFLHGVWIGPRVKIGPGLFLAHARGLIVNPDTVIGSRCVILQNVTLGGPNIVVGDDVLLGAGALIISREHRVGGLAIGDNAKIGAGAVVLEDVPEGAVMVGNPARDVSKKEVNC

SEQ ID NO: 5187 - protein, 250 aa, Magnaporthe grisea 70-15
MARKFFVGGNFKMNGTSESIKKIVENLNDAKLDANAEVVISPPHVYLSHTRSLAKKEIEVAAQNVFDKADGAYTGETSVSQLKDLGINWVILGHSERRTILGESDEVVASKTKYAIDNGLKVIWCCGESLEERESDKTVEVVTRQLEALKAKVGTSGWENIVIAYEPIWAIGTGKVATPEQAQDAHAAIRGYLKSKVSDKVAEETRILYGGSVNEKNCGELSQKPDIDGFLVGGASLKPAFVDICTCKSA

SEQ ID NO: 5188 - protein, 617 aa, Oryza sativa Japonica Group
MHRFLVTALLFSLLNYGAVMATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPYTSNQGRKDYNASASTEFNESAKRITTFSEITFTWSAPNITDVCIDCERQQRLCGFSSQRRTAFCKPHGSKSPAKVIIVAVSVPTIVVLTLVVASALYLSLKTKNDDEIQLKVEMFLKTYGTSKPTRYTFSEVKRITRRFKHKLGTGGFGSVYKGELSKGVPVAVKMLENSKGEGEEFINEVATIGRIHHVNVVRLLGFCSEGTRHALIYEFMPNNSLEKYIFSRDYISSQEVLVPDKMLKIALGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 5189 - protein, 239 aa, Vitis vinifera
  misc_feature (97)..(97): Xaa can be any naturally occurring amino acid
  misc_feature (102)..(102): Xaa can be any naturally occurring amino acid
  misc_feature (109)..(109): Xaa can be any naturally occurring amino acid
  misc_feature (134)..(134): Xaa can be any naturally occurring amino acid
  misc_feature (165)..(165): Xaa can be any naturally occurring amino acid
MASSRPLDIDITVVSAKHLKNVNWKHGELKPYAIFWVDPDRRLATKPDESGSTCPVWNERFTLSVNLPLHDSVLTLEVFHSKPSETPKPLVGSLQVXLKDLXDSDDSNXIKTFQLRRPSGRPQGKIRVKLAIRXRPSPPAPDYYLTPPVSFYYSSAPPPPAPNPXGYSHLSHTIPLPPPVPQSPSPHPYGTFCNPYPGYYGYYSRAPPPPRPFFDWSGEFTVGHLRRLIIRPMIRSKWG

SEQ ID NO: 5190 - protein, 717 aa, Vitis vinifera
MAAVTLLLQLIVSLLWLNEASAAPSLAKQGCVAYCGDVSIPYPFGIGKDCYFNDYFSINCNDSSSPPKPFLNHTELNLELFNVSLEYKTVMVNSPIPSLCADNGTWKSNDFGGSPFRFSSVHNIFMVVGCDTNAVLATGDEILAGCTSNCDNRIARTRRRCYGIKCCQTTISYNSQSTHLGMYNVSYVKTGEGCAYAFMGGRDWYANNNSDPANTTNSGYAPLVMFWEMETTSLGSCYLQDLDWQSGKTIEICSCEHRYEGNPYLPNGCQVVEACANCSLLDCGMIGTEYHCFASNRMAKQLKAMILGLSIGGGSFLLLVGSFGLYKGVKKRREFIRKQKFFKRNGGLLLQQQLSSSEIVEKTKIFTSKELEKATDNFNKSRILGHGGQGTVYKGMLNDGRIVAVKRSNLVDESQLEPFINEIMILSQINHRNIVGLFGCCLETEVPLLVYEFISNGSLLQLIHDQNNEFPFSWSMRLQIAVDAAGALAYLHSSSSVPIYHRDIKSSNILIDEKYRAIVSDFGTSRSISIDQTHLTTHVQGTFGYLDPEYFQSSQFTDKSDVYSFGVVLVELLTGKKPVAWSSSEEEKSLVVHFILSLEENHLYDILDDRVRKEGEKEKIMAMANLAKRCLNLSGKKRPTMKEVTFELERIRMSSLPINSQQDILDEDKYGIVDEYGIVETMGPLDGATTSISIASNLSCGKSFSSSDSQPFMYNIR

SEQ ID NO: 5191 - protein, 503 aa, Oryza sativa Japonica Group
MENLEPSCGYLAMIPVSWTPASGKKYQYFAELMRKGFSVRFPFVLDHPTAFELIKQCLNRSIRGFREEPFSTTAHVKNRIADIVFMDLIFWACIIGKTSQTSDYFETPLYMVEMLHGKRIFYSGFVLQFVMWTVKWIYVICRFVLAPLALLTFLAQRYWKTRITIDAVEKFLRMQLMLGPTRYTYTDIIAMTSHFRDKLGQGGYGSVFKGVILPGDVYVAIKMLDNYNCNGEEFISEVSTIGSIHHVNVVRLVGFCAEEMRRALVYEYMPHGSLDKFIFAPEKSFSWDKLNEIALGIARGINYLHQGCDMQILHFDIKPHNILLDSNFVPKVADFGLAKLCPRDNNYVPVSAARGTVGYIAPEMISRSFGVISSKSDVYSFGMLLLEMAGGRRNSKQNMSSSTQVYYPSLVYNQLIQQEMGEITNTLNMHELERKLCVVGLHCIQVKPPDRPTMSEVIEMLEGDVDGLQLPSRPFFCDDEPLPLLVDSYRFSSELTEISEEDG

SEQ ID NO: 5192 - protein, 706 aa, Rhodococcus sp. RHA1
MAMAAPATPSPVNPPARSQPSSVYIASPEGDTGKSTIALGVLQMLCASAARVGVFRPIARSTQETDYILELLLEHTTADVGYEEALGVTYEHVHADPDGALSEIVSRYHQVAAQCDAVVVIGSDYTDVASPSELGYNARIAANLGAPVLLAVKGARRTPEEVAQLAHLAIGELTSHHAHPLAVVANRCDPDELDAVTAALASTGVPAWSLPEIPLLVAPTMAELLESIDGSLFSGDPELLHREALRVMVGGMTAEHILERLTEGTVVIAPADRSDVLLAMVNAHEAEGFPSLAGIIMNGGLMPHPAIAKLMAGLKPRLPILTTGLGTFDTASAAAQTRGRVAVGSQRKIDTALSVMELRVDAPTLLERLKLPIPSVVTPQMFEYQLIDRARRDRKHIVLPEGDDDRILRAAGRLLQRQVAALTILGDEVQVRRRAAELGVDLGDAQVLDPRTSDHAGPFAEEYARLRAHKGMTVERAREVMADISYFGTMMVHLGIADGMVSGAAHTTAHTIRPSFEIIKTQPGVSTVSSVFLMCLSDRVLAYGDCAVVPDPTAEQLADIAISSAQTAAQFGIDPRIAMLSYSTGDSGSGADVDKVRSATKLVRERRPDLLVEGPIQYDAAIEQSVADKKMPDSAVAGKATVFIFPDLNTGNNTYKAVQRSAGAIAVGPVLQGLNKPVNDLSRGALVEDIVNTVAITAIQAQGAEK

SEQ ID NO: 5193 - protein, 701 aa, Vitis vinifera
MIGSLLLHLISILCLTQASAAAPSSAKPGCEDRCGNYSIPYPFGVGKDCYYNEWFAISCNSSSSFPTPLLSHPRINLEVQQISVEYQTVSVQTPMPAYCQNQEETNRTWDSIDLKETPFFFSAERNSLRVIGCGNAVLVTRSGVTLAGCSSFCQNTSNNFVGNGGCFGINCCQATIPSNLNFFRLNTTATSYLSSESPCTFAALGNGFSTDQASPQQSWASIELTWMIEEAVEGSQCQKNTLNGAEVGNYTYYNCSCLPYEEGNPYRPHALCKNCAECRKEADGSFSCVVRGSTSTSSTSPKPLILGLSFGIGGSVFLIIGSCWLYKFIKKQRVIKRKEHFFKRNGGLLLQQEMSSDRIAVEKTKIFSSEELAIATENFNKNRILGQGGQGTVYKGMLIDGKIVAIKKSKIVDEDQLEQFINEIMILSQINHRNIMKLLGCCLETEVPLLVFEFISNGTLFQLIHDKNNEFPFSWEMRLQIAAEVADAITYLHSASSVPIYHRDIKSSNILLDDKYKAKVSDFGISRSVSLGQTHLTTLVQGTFGYLDPEYFVTNHFTEKSDVYSFGVVLVELLTGQKPIPSTRSEEERSLVAYFTSSLEQGRLFDIIDNRVMKEGGKDEILAVANLASRCLHFKGKERPTMKEVTKELEHFRTSFLPFSHVPQNIHKGESMVTEMTGPLDSTSTSTEWFQHDKKSSSYDV

SEQ ID NO: 5194 - protein, 386 aa, Bacillus anthracis str. Ames
MNIHEYQGKAVLRSYGVSVPNGKVAFTVEEAVEAAKELGTDVCVVKAQIHAGGRGKAGGVKVAKNLDEVRTYAESILGTTLVTHQTGPEGKEVKRLLIEEGCDIKKEYYVGLVLDRATSQVVLMASEEGGTEIEEVAEKTPEKIFKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDKNVKGIFVNIFGGIMKCDVIAEGVIEATKQVGLELPLVVRLEGTNVELGKKILNESGLNIVAAESMTDGAQKIVSLVG

SEQ ID NO: 5195 - protein, 1369 aa, Oryza sativa Japonica Group
MSKVIATTLLLSVISHGAYPAMGSAWEEEDFARNCPPSWCSDSGPEIRFPHQLESSNSSSSSSCSASCARLACSGPDTILHHPFLGPCKVTAIDYKKAVFQIIPLVDSLSSYPLQKLIIDNLPEPDYHSSRCSLYNAQPGKIVCCSKVLTPSMSPTNDYDGNIADHAVVGPISCLSDPSHFSYLVDAYEDIYSLPLDCKAVSKGIVPISGAVTADGPTFKQLAERILNFAETTVHVSKSLQLSYNEEVHLKVEMFLRTYGTSKPTRYTFSEVKKIARCFKEKVGQGGFGTVYKGKLPNGVPVAVKMLENPTGDGEEFINEVATIGTIHHTNIVRLLGFCSEGTRRALVYELMPNESLEKYIFLRDPNTQELLSPDKMLDIALGIARGMEYLHQGCNQRILHFDIKPHNILLDYNFSPKISDFGLAKLCPRDQSIITLTKARGTMGYIAPELYSRNFGEISYKSDVYSFGMVVLEMVSGRRSWDPSIENQNEVYFPEWIYEKVITEQDFILSREMTEEEKQMSQGSHAQWRWEPGSRVDFGAGTGGAAAVCWSAAAARRSPPVRDQQHQLGDRHRPALHQDCTIVTCNFWADSTNYAAGATLNITNRCSFTVWPAAVPVGGGMRLDPGESWALDVPANSGAGRVWARTGCSFDANGNGSCQTGDCGGVLKCKNSGKPPQTLAEFTVDQTSVQDFFDISLTDGFNVPMDFLPVPAPEQRHGAPPCSKGPRCPANITSQCPSELKAPGGCNSACNVFKQDKYCCTGTTGTKTCEPTTFSLPFVRMCPDAYSYSLDDSSSTTFTCPSGTNYQIIFCPPTDLTSSSPVPPPAPIAIGPSGLDSSSKRGGRLVATIVVSVIGSTSVLTIIIASIIIIKRRIRRHQEMQEEEQEFEELPLQGMPRRFTFQQLQEATDQFRDKLGQGGFGSVFLGQIGGERVAVKRLDQSGQGMREFMAEVQTIGSIHHINLVRLIGFCAEKSQRLLVYEHMPKGSLDRWLYHQQGSPAPALDWWTRYKIITQVAKGLSYLHEECMMRIAHLDVKPQNILLDDNFNAKLSDFGLCKLIDRDKSQVITRMRGTPGYLAPEWLTSQITEKADVYSFGIVVMEMISGRKNLDTSRSEQSIHLITLLQEKVKGDQLADLIDKHSNDMQVHRQEIIEMMKLAMWCLQIDCKRRPQMSEVVKVLEGTTSIETDIDHDFVATNPVSFGVAGIVDSDPPVASNLSGPSIFLWHIDNSDVNMVPKLRGQCRDGLNSDGSVKNKIKQWRMGTVSPPLYKIFFGGSIQTIFPPPPPPAAGSTAEVAMVDDGVESEEEEEDAPVRVSAHTTRKAACFGCEKRYHFYKFLHACIKTSKGDIASHQHTDHAVCLADRLVKT

SEQ ID NO: 5196 - protein, 184 aa, Klebsiella pneumoniae subsp. pneumoniae MGH 78578
MSAQLRPYKAFFPQIGLRVMIDASSVVIGDVRIADDVSVWPLVAIRGDVNYVSIGQRSNIQDGSVLHVTHKSSYKPEGNPLIIGEDVTVGHKVMLHGCTIGNRVLVGMGSILLDGVVVGDDVMIGAGSLVPQNKQLESGYLYFGNPVKQIRPLTEAEREGLKYSANNYVKWKNEYLDQDNQIQP

SEQ ID NO: 5197 - protein, 492 aa, Synechococcus elongatus PCC 7942
MPSTNPFLTLPYEPAFASLGSEFSDPVEAATFPAHQLRFRNDRLLPILGLDPATVTDEHFIEAFGRFQGRSPLLAMRYHGYQFGIYNPDLGDGRGFSTAKYVDATAGSTTLALRDRPNTPYSRGGDGKLTLKGGVREVLASEFLQRLGVRTGRCLSLIETGEELWRGDEPSPTRSSVMVRFNRTHIRFGTFERLHYFKRADLVRQLLDHVIATYYSHLLGDPEADAKFYAELTERTADLAAQWMAAGFCHAVLNTDNLSIVGESFDYGPWAFLDRFDPKFTAAYFDHSGRYRYENQPGICQLNLELLQVPLGMVMSAADLEAGIAGFGDRYQATYSRLMLRRLGFEADQLHSAIADDLIITTLQLLLRAPIGYNEFFARLRAQFQPSWRSDLSAILPDWITTDLEALPEAQWQGWRDRYHQLLTHLPESQLPLIQQQLAQANPEIAPIRPVVESVWDPIAIDDNWEPLEALLNRWRHDGDGAADGVVVPNAN

SEQ ID NO: 5198 - protein, 561 aa, Shigella flexneri
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 5199 - protein, 602 aa, Listeria monocytogenes str. 4b H7858
MDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAALSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYILGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKIAADHTTDIVLLRDIVQQLQAYKTDENTVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQHYFEKGTITRKEMKVYRDNLLAIEANMQLEF

SEQ ID NO: 5200 - protein, 501 aa, Vitis vinifera
MELQIALLLLCITLFCFCLRHFLLPSYTAKLPPGPTGLPILGSLLQLGEKPHHTLAKFAESHGPLISLRLGSITTVVASSPQTAKLILQNHADNFLDRPVPDAIMAMPNPECTLAWIPGDHVWRNRRRVCASHMFTTQRLDSLQHLRQKKVDQLLQHITKHCVLGTPVYITDLASATILNLMSNTMFSVDLVDPRFESAQEFRELMWRIMEGVGKPNISDYFPIFRSLDLQGVKRGTVPSYKRLHEILDGIIQERMKLRASSSTTSMNDFLDVLLDQCQVDGSDFSSDTIKTLLVELVFGGSDTSSVTIEWAMAELLRNPHVMQKVRIELSEVISPGQSIKESDIDRLPYFQAVVKETMRLHPPAPLLLPYKAKNDLEICGFTIPKDSHVLVNIWAIARDPGYWEDPLSFLPERFLSSNIDFRGQDFEYLPFGAGKRICPGISLGLRMVHLVLASIIHSFSWKLPQGITPESLDMKEQFGVTLKKVVPLCAIPFIEEKCSP

SEQ ID NO: 5201 - protein, 310 aa, Vitis vinifera
MASQLIREWTGIQQFPPVTQTKLIELLGKLKQENVSTLTILVMGKGGVGKSSTVNSIIGERAVAVSAFQSEGPRPVMVSRSRAGFTLNIIDTPGLVEGGYVNDQALEIIKRFLLNKTIDVLLYVDRLDAYRVDNLDRQVVKAITDSFGKEIWRRGVVVLTHAQLSPPDGLNYEDFFSKRSEALMKVVRSGARLRKQDIQDSGIPVVLVENSGRCHKNESDEKILPNGTAWIPNLVKTITDAVSNGSKGILVDKKLIEGPNPNERGKLLIPFILAFQYFFIVKRIQRAIKSDMAKERKAPWESREANRYEP

SEQ ID NO: 5202 - protein, 457 aa, Vitis vinifera
  misc_feature (446)..(446): Xaa can be any naturally occurring amino acid
MVCRFSTKLLNICIASLCKVGQLEKAEAVVIDGIRLGLLPDVVTYNTLLSAYSRFVGIDAAYSVIHRMKEAGISPDVITYNSLIAAATKRCLLSRSLDLFEEMLRTGIRPDVWSYNSLMHCFFKLGKPDEANRVFQDIILTNLLPSSSTFNIMINGLCNNGYTGYALSLYRYLQRQGFVPELVTYNILINGLCKSRKLNAARRILRELGESGNVPDAITYTTVMKCCFRSRQFEQGFEIFSEMKSKGYAFDAFSYCAVIAALTKTGRLEEANDIMEQMARSDIDLDIVSYNTVMNLYCRNGKLEATYKLLDEIEEHGLECDEYTHTILIDGLCKAGNVEGALRHLKNMTKMGFDSTLVAQNCVIDGLCKVGQLDHAIKMFASMEVKDSFTYSSMVHNLCKARRYRHASRLLLACLRGGMKILRANQRSVIDGHLVDILETSSDVIXGFLSASQMEIF

SEQ ID NO: 5203 - protein, 166 aa, Oryza sativa Japonica Group
MATTRPARSDPHLPPEEAARVEAEVRGYFDSMAPRRPSKPPRSDPSDAGEGGAEADADADLPELRRLRDLEAKPQKLVLDGGDVNGEEYVETQYYNGLNCIDKQHHTTGTGFIKVERPNGSSFNVTTVAYSSDSIIRCMSNPATNDWIPSSETVIPVSNKPSRSDS

SEQ ID NO: 5204 - protein, 526 aa, Synechococcus sp. WH 5701
MSVDLLVIGAGATGATIALEAARRGLSVALVEAGDIAGGTSSRSTKLLHGGVRYLELAFRRLDWRQLQLVREALSERGHWLEAVPFLARRLELLLPSEGLLQQAYYGLGLAVYDLLAGRRGIGSSRWLCREAVQELLPELKAGQLGVAYGDGQFDDARLNLLIVRTAARLGAEVFTRTEVVELLRQGDRLSGAVLHDLATGQRRRLEARVVLNATGIGADRIRQLAQPDLPPTLQVSRGVHLVLAADLCPGGTGLLIPSTDDGRVLFVLPFHGRTLVGTTDTPCASSESERPSEVEEAYLLDYVRRWFPGHGEPVVSSRWAGGRPLLLGNGDSASAGTATVVREHQVETLPCGLISVMGGKWTTCRPMAFDGLQAVAQLLGGPLPAPSAEAAAVPIHGAADTGAATIAGLDRLRLELSQRLPGGDLALLEHLLACHGLEVEAVLACAASPAELEPLSAVIPLTAAEVRHGVRHEWARSADDLLARRCRLAFVDSAEAERLRPVVQALLDQELASLESSPTSHQKNP

SEQ ID NO: 5205 - protein, 470 aa, Yersinia pestis CO92
MLMLLPVIMAGGAGSRLWPLSRALYPKQFLALTSDLTMLQETLLRLDGLPHLAPLVICNEEHRFIIAEQLRQKNLVHSGIVLEPVGRNTAPAIALAALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 5206 - protein, 139 aa, Brassica napus
MAPIGVGSTLPDGHLAWFDENDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGLRSRRFALLADDLKV

SEQ ID NO: 5207 - protein, 224 aa, Vitis vinifera
MQSNEPATSMEVENVLSEPNPTSGTFPSKPKFEPLKAHEMSEGRVQFRKVSVPPHRYTPLKKAWMEIYTPIYEQMKIDIRMNLKARKVELKTRADTPDISNLQKCTDFVHAFMLGFGVVDAIALLRLDELYVESFEIKDVKTLRGEHLSRAIGRLSGKGGKTKFAIENATRTRIVIADTKIHILGSFSNIKIARDSLCSLILGSPAGKVYSKLRAVTARLAERF

SEQ ID NO: 5208 - protein, 307 aa, Nitrosomonas europaea ATCC 19718
MQIRHFLQFKDFDRQEYEYLFDRTRWIKNEFKQYRRYWPLTDRTLAMIFEKHSTRTRLSFEAGMHQLGGSAIYLSTRDTQLGRGEPVEDAARVISRMVDIITLRTHEHGVIERFAENSRVPVINGLTDEYHPCQILADIFTFMEHRGSIAGKTVAWIGDSNNVCNTWLQAAEVFDFNVHVSTPPGYEVEPERAGLYGTDHYEQFVSPHDAVKDADLVTTDVWTSMGFEDEADTRKNDFADFRVDAEMMACAKEEALFMHCLPAHRGEEVDAEVIDGPQSVVWDEAENRLHTQKALMEYLLLGRIGVR

SEQ ID NO: 5209 - protein, 458 aa, Gloeobacter violaceus PCC 7421
MRVGVIGTGYVGLVTGACLAAVGHRVRCMDNDALKIERLRRGVIPIHEPGLEDIVQRTSANGSLEFTADLAEVARGSEIIFITVGTPSRADGSPDLTAVRAVARGIGSHLDGSYRVIVNKSTVPVGSGNWVRMLVEEGARQLEGATVVGAPGVSTAHPVEPAFDVVSNPEFLREGSAVWDTFNPDRIVIGAECEQAVAVMRELYAHWIAPEPLGRALPLVVTDLASAEMIKYAANAFLATKISFVNEMANICERVGADVQQVAEAIGLDKRIGRAFLNAGAGWGGSCFPKDVSALVSTGREYGYECALLKATLSVNEAQKQSVVEKLQRELRILKGRTVAIWGLAFKPHTDDIRCAPALEVAEQLVALGCRVVAHDPVVPSERAREQLPEMQVAADPLAAAAQADALVVMTEWPLYSEIDLSVLRRRLRQPILIDGRNCLDAAAARAAGLTYIGVGRP

SEQ ID NO: 5210 - protein, 458 aa, Streptococcus agalactiae A909
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 5211 - protein, 118 aa, Vitis vinifera
  misc_feature (2)..(2): Xaa can be any naturally occurring amino acid
MXNSSAFVLICAIMAVHMVLTSSAVDFSGDHLQFQLGWIPARSACQGSIAECLAGEEFEMDSEINRRILASKRYISYGALSRNSVPCSRRGASYYNCRPGAQANPYTRGCSAITRCRR

SEQ ID NO: 5212 - protein, 396 aa, Vibrio parahaemolyticus RIMD 2210633
MFEKVVAAPADPILGLTEEFKKDPRAEKINLGVGIYKNEQGETPVLATVKKAEAALIETEKTKSYLTIEGTAEYGLAVQKLLFGADAEIVAEKRAKTAQAPGGTGALRVAGEFIKRQLGNVKIWISNPTWANHNGVFTAAGLETAQYTYYNAETKDKDFDAMLNDLQAASEGDIVLLHGCCHNPTGIDPTAEEWETLAKLIAEKKLLPLFDFAYQGFAKGVEEDAAGLRIFAKYNKEILVASSFSKNFGLYNERVGAFTLVAESEEVATTAFSQVKAIIRSIYSNPPAHGSAVVTHILNNKELRAEWEAEVQEMRDRIQEMRELFVATLKEEGVDADFSFIERQNGMFSFSGLSKEQVNRLKDEFAIYIVGSGRISVAGMTKSNMGPLCKGIAAVL

SEQ ID NO: 5213 - protein, 376 aa, Cladophora rupestris
LDTYRSIFKYKYRTMQTSMVGNMRVAQPTGRRTATVANAKKLKVAINGFGRIGRNFLRCQFLRENSNLEVVVVNDSGGVKQAAHLLKYDSILGTFERTVEKIDDSTMAVDGKNIRIVSNRDPTKLPWADMGVDLVIEGTGVFVSEEGAGKHLQAGAKKVIITAPGKGDIPTFVMGVNSDDYKHEYPIISNASCTTNCLAPFVKVIVEKFGVVKGTMTTTHSYTGDQRLLDASHRDLRRARAAALNIVPTTTGAAKAVALVLPQLKGKLNGIALRVPTPNVSVVDLVVQVEKKTLAEEVNQAFRDAAAGPLKGVLGVADIPLVSMDFKKSDVSTTIDSALTMVMGDDMVKVVAWYDNEWGYSQRVLDLAELCAEKWE

SEQ ID NO: 5214 - protein, 91 aa, Glycine max
  misc_feature (21)..(21): Xaa can be any naturally occurring amino acid
  misc_feature (61)..(61): Xaa can be any naturally occurring amino acid
KIGEESGYIQFEEPEAAQKAXRAAAVLSEKEGLVVKNYIATLDPVTGEAEREYWTLLRGNXGKIRGCTNNRGRGGKHGRGGKYSRSRENES

SEQ ID NO: 5215 - protein, 457 aa, Fulvimarina pelagi HTCC2506
MAPLPNSIEARDIAHHFHPFTNARRHEEIGPIVMAKGDGVFVEDIDGKRYIEAMSGLWSVAVGFSEKRLVDAAVKQMAELPYYHSFTHKSHAPVVDLAEKLINIAPVPMAKVHFTNSGSEANDLIVKLLRYRANGMGEPRRKKIISRLRGYHGITLAAASLTGLPNNHASFDLPIEGILHTICPHYWREGREGESEEAFATRCAAELEAMIEAEGPETIAAFIAEPVMGAGGVVIPPVTYWEKIQAVLSRYPEIVFVADEVICGFGRTGEMFGSVTYDLKPDIITVSKGLSSSYLPISAVIMNDRVYQPIADETARIGTFGHGFTTTGHPVAAAVALENLKIIEERDLVGNARARGPRLQDGLRRLADHPLVGEVRGVGLIAGVELVTDKEKKVAVQPPGALAAKAFGLIQERGVISRAIGDTLAFCPPLIIEDEHIDTILATTREGLDALAAEMGM

SEQ ID NO: 5216 - protein, 500 aa, Vibrio fischeri ES114
MGFTSLGLSAPILKAVEEQGYSTPSPIQLQAIPAVIEGKDVMAAAQTGTGKTAGFTLPLLERLSNGPKRKFNQVRALVLTPTRELAAQVHESVEKYSKNLPLTSDVVFGGVKVNPQMQRLRRGVDVLVATPGRLLDLANQNAIKFDQLEILVLDEADRMLDMGFIHDIKKILAKLPKNRQNLLFSATFSDEIRQLAKGLVKDPVEISVAKRNTTAETVEQSVYVMDKGRKPKVLTKLIKDNDWKQVLVFSKTKHGANRLAKTLEEKGVSAAAIHGNKSQGARTKALANFKSGQVRVLVATDIAARGLDIEQLPQVINVDLPKVPEDYVHRIGRTGRAGATGKAISFVSEDEAKELFAIERLIQKVLPRHVLEGFEPVNKVPESKLDTRPIKPKKPKKPKAPRVEHKDGQRSGENRNGNKQGAKQGQKPATKRTPTNNPSGKKEGTDSDKKKRPFSGKPKTKGTGENRGNGSNFGKSKSTPKSDVKPRRQGPRPARKPKAN

SEQ ID NO: 5217 - protein, 401 aa, Fulvimarina pelagi HTCC2506
MAFLADALDRVKPSATIAVTQKARELKAKGMDVIGLGAGEPDFDTPDTIKEAAIAAIARGETKYTPVSGIPQLREAIAAKFKRENGLDYKPEQTIVGTGGKQILFNAFMATLNKGDEVIIPAPYWVSYPEMVAICGGTPVFVEAGIETNFKLTPEKLEAVITPRTKWFLFNSPSNPSGAAYTKDEIKALTDVLMRHGHVWVLTDDIYEHLVYGDFTFHTPAEVEPGLYDRTLTMNGVSKAYSMTGWRIGYGAGPIQLIKAMDMIQGQQTSGAASISQWAAVEALNGTQDFIPKNREIFQGRRDLVVSMLNQATGLKCPVPEGAFYVYPSCAGLMGKTTPDGKVLKTDEDFVTSLLETEGVAVVQGSAFGLGPNFRISYATSEALLEEACSRIQRFCGSLKD

SEQ ID NO: 5218 - protein, 659 aa, Oryza sativa Japonica Group
MRVIYVLCVLGVLVPDAAGGRRHHRRHDCPPFTCGHLSDVSFPFRRRGDPPECGVQSYELTCADDKATIQIDKETYSVSDINYGDSTLWVVDASFLDSRSSCLLPRWNPLLRDPRLQAKSHHIIELAPPVGVTWASFVNCSQEIRNSSWMYMPVACLSTSRSFVYVFTGQQSAYIQNLEPSCGYLATTPLGGSKLNSTSALQNVSYQDVVKLMMTGFAVRFPFTVSGWNFKECLALSIRQTGTGSKERIANIAIIDFYFWSCFLLGDRSHNNLIYTYMVVDTALLILKWTAVLCRFVLAPLAVFIFLAHKYWRNKITIDAVEKFLQMQLTLGPTRYAYTDLTAITGHFGEKLGQGGYGSVYKGVLPGYVNVAVKVLENANCNGEEFISEVSTIGRIHHVNVVRLVGFCSEELRRALVYEYMPRGSLDKYIFSSKRSFSWDKLNEIALGIARGINYLHQGCDMQILHFDIKPHNILLDDNFVPKVADFGLAKLYPRDNSFVPLNALRGTIGYIAPEMISRSFGVISSKSDVYSFGMLLLEMAGGRRNSDMHAGNSSQAYYPSWVYDRLIEQQVGVGEISAATVANMHELERKLCIIGLHCIQMKSHDRPTMSEVIEMLEGGVVGLQMPPRPFFCDDESMSPMMDSYQFSSGLTEILEEDE

SEQ ID NO: 5219 - protein, 515 aa, Fagopyrum tataricum
MSTKLILSFSLCLMVLSCSAQAAQLWPWRKGQDSRPHHGHQQFQQQCDIQRLTASEPSRRVRSEAGVTEIWDHNTPEFRCTGFVAVRYVIQPGGLLLPSYSNAPYITFVEQGRGVQGVVIPGCPETFQSDSEYPQSQRGQHSRESESQESSRGDQHQKIFRVREGDVIPSPAGVVQWTHNDGDQDLISVTLLDANSFHNQLDENVRSFFLAGQSQQGREERRSQQQTREEGGDRQSRESDDVEALIGANILSGFQDEILHELFRDVDRETISKLRGENDQRGFIVQAQDLKLRVPEDSEEGYERQRGDRKRDERGSGRSNGLEQAFCNLKFRQNVNRPSHADVFNPRAGRINTVNSNNLPILEFLQLSAQHVVLYKNAIIGPRWNLNAHSALYVTRGEGRVQVVGDEGKSVFDDNVQRGQILVVPQGFAVVVKAGRQGLEWVELKNNDNAITSPIAGRTSVLRAIPVEVLANSYDISTEEAYKLKNGRQEVEVFRPFQSRYEKEEEKERERFSIV

SEQ ID NO: 5220 - protein, 440 aa, Oryza sativa
MAWPGGHTKGEKGLKGNNASSYDNLNFARILQQIVQENPGNLVAQRCAKAEMSFPQLSESVQSIFLSETKVFNALEFEKKAKVKSHFSANNSAEAGNLGETRHGAMDYMGSEAEVKNSQSRKVTAGPDDGDKQSDKPSVPVLPLRDCGRRGGASATHIIIVSTSGLLTRANVGILGGEMAVVASRCTGLLLPDLGASLAGFRRRRSTPASSLSFRPRRARRRLGSLSCIAPPDSAEPQTDEPAAKDDSTEDKAEASSASQDAGNPTFPNKDLSRRIALASTIGAVGLFAYQRLDFGGVSLKDLAANATPYEEALSNGKPTVVEFYADWCEVCRELAPDVYKVEQQYKDRVNFVMLNVDNTKWEQELDEFGVEGIPHFAFLDKEGNEEGNVVGRLPKQYFLDNVVALASGEPTVPHARVVGQFSSAESRKVHQVADPRSHG

SEQ ID NO: 5221 - protein, 549 aa, Vitis vinifera
MGRRLEETVLHSEPVALQIPTNREIKAEKKKKKKHKQSKIASNEVVEIGRKKKNEDYIIEEETEANRKRKLEETPTVTEAKKKKKEKEKKEKKEKEGEEEGLKDEDDKESRGACVAVTGKDAKESKYAAFKSFAESKLPDDVLECCRNFSQPSPIQSHAWPFLLDHRDFIGIAATGSGKTLAFGVPAMMHVLSKRKSKTSKGVNPLCLVLSPTRELAQQISDVLCEAGKHCGVKSVCLYGGTSKGPQISSLKSGVDIVIGTPGRLKDLIEMGVCCLTEVSFVVLDEADRMLDMGFEPEVRSILSQTCPARQMVMFSATWPLPVHQLAQEFMDPNPVKVVIGSEDLAANHDVMQIVEVLDDRSRDERLLTLLGKYHKSQRNRVLVFVLYKKEAARVENMLQRRGWNVVSIHGDKAQQARTAALSLFKKGSCPLMIATDVAARGLDIPDVEVVINYSFPLTTEDYVHRIGRTGRAGKKGVAHTFFMQENKGLAGELVNVLKEAGQIVPADLLKFGTHVKKKESKLYGAHFREIAADAPKSKKITFDDSDED

SEQ ID NO: 5222 - protein, 322 aa, Glycine max
  misc_feature (25)..(25): Xaa can be any naturally occurring amino acid
  misc_feature (35)..(36): Xaa can be any naturally occurring amino acid
  misc_feature (39)..(39): Xaa can be any naturally occurring amino acid
  misc_feature (52)..(53): Xaa can be any naturally occurring amino acid
  misc_feature (55)..(55): Xaa can be any naturally occurring amino acid
  misc_feature (65)..(65): Xaa can be any naturally occurring amino acid
  misc_feature (74)..(74): Xaa can be any naturally occurring amino acid
QLDIFGIIGCWKHAENDTSVPDAAXKAENFAQRYXXEYXEDFKKDPASQGRXXDXSLFLCRLREXVLREQGFRXDIFKKIKDVENANAISLFQNVVHLNDAIEDEGKRLENLVRGIFAGNIFDLGATQLAEVFSRDGVSFSTTCQNLVPRPWIIDDLETFRIAWSKKSWKKVIIFVDNSGADVILGILPFARELLRRGSQVILAANDLPSINDVTYSDLIEIIPKLKDEEGRLTGVSTSNLLIANSGNDLPVIDLTRVSQELAYLANDVDLVILEGMGRGIETNLYAQFKCDSLKIGMVKHPEVAEFLGSRLYDCVIKYDEV

SEQ ID NO: 5223 - protein, 374 aa, Burkholderia sp. 383
MKVVVAGGSIAGLSAALTLDCIGHDVEIYERSPTPLRGQGGGVAVLRRMMAFLEQHGHHCRAMISVPTRRRQWIDRDGVVTRDEPEMLPFSSWDAVYRSLCSTLPHGQIHYGHAVTGFEQDADGVNIHIDGRQVRADVLIAADGMGSALRAHIFPDYVPSFAGYIAWRGIVDEADFDAAAIATLVENMTLHKAPGELFMAFLIPALDGSLEPGARRFNWLWYRNETNPDALRRHLTDQTGTIHHGSIHPGQLSNDSVASLRQLASERLPAVFSQLVLATRAPFVQAIFDALSPHFAHGRVALVGDAACTVRPHTASGTSKAARDAVSLAESLPADATDVVARLARWSIERRADVTSLLRKGPELATAFGLGHPI

SEQ ID NO: 5224 - protein, 432 aa, Bordetella petrii
MKTVRFPVVKKIAVCGLGYVGLPVAVAFSKRFDVIGFDVDKRRIARLKEGHDWTGEIERDVLLASSMRFTDQVTELQGCDFFVVAVPTPVDERNNPDFSLLVRACQSIGPVLRPGCIVVFESTVHPGATEEICGPELEKASGLRCGVDFKLGYSPERINPGDRQHPLEKIVKIVSGQDEASLEIIAGVYEKIIDAGVHRASSIKVAEAAKVLENTQRDINIALMNEMSKICDLVGIRTSEVLSAAGTKWNFLNFTPGLVGGHCIGVDPYYLTSKAQELGYHPEVILSGRRINDGMASHVAARVVQTLARNGRLNASTRVGILGMTFKENVPDIRNSKVVDLYNALGDYGITPVACDPMVDADQMEHEYGIKLVKRDEFRDMDVLILAVPHRETMDSIWDDMPNLVKSGGMVCDLKSVLDSKRLQSDLVYWTL

SEQ ID NO: 5225 - protein, 442 aa, Burkholderia mallei ATCC 23344
MTEHVSQTPDLSAFWMPFTANRQFKEAPRLLVAAKGMYYTSHDGRRILDGTAGLWCVNAGHGRDEIVAAVQAQAEEMDFAPTFQMGHPKAFEAATKIARHTPGDLKHIFFTNSGSEAVDTALKIALAYHRARGEGQRTRFIGRERGYHGVGFGGISVGGIAPNRNAYSGALLPSVDHLPHTLNLKEAAFSKGQPAWGAQLADELERLVALHDASTIAAVIVEPVAGSTGVLIPPRGYLERLRELCDKHGILLIFDEVITGWGRLGAPFAAQFFGVTPDLLTMAKGTNNAAVPMGAVAASGAIHDAIVGGAPAGIELFHGYTYSGHPLAAAAAVATIDLYEREGLLTRAARIAPIFEREIHKLKDARHVIDVRNLGLVGGVELTPRDGKPGARAYEVFVKCFEKGAMIRYTGDILAFSPPLIVEEAQIVELFSIVAQALKETE

SEQ ID NO: 5226 - protein, 1617 aa, Populus trichocarpa
MHKDRGYDVADTELTRSLMEFRSIFGNCPDLDSLRFSISLRSNPYNKNLVIFMGTDEIRTANIRAVYGQILSKESRQGLILILQSKMNHFAKKEPEKFPFKVKVFQKMFSVDRKVFPLTGKCFPLTNFPNGKQTQESLESGFPESEFRKTNMAKVKSSSALLAHHHPQPTHTKAHTHTFFFYSRKPHLPESVFCGSRALSELYISCFHASPALFVFALVFFLFYRNFVKFGYKVFLRLIYRRRYCLQVYERPGWGYDVFLSFRGEDTRKNFTDHLYTALHHARIHAFRDDDELRRGEEISLQLLKAIQESKISIVVFSKGYASSTWCLAELEKILDCRHTTGQIVLPVFYDIDPSDIRKQTGSFAEAFDRHEERFKEEMEKVQKWRKALMEAANLSGLDLRSFANGHESKLIQKIVEEVSSKLNPRFLFDDMPLKRLKTTMISGGGLLDDAEEKQITNRAVRDWLAEYKDAVYEADDFLDEIAYEALRQELEAEAQTFIKPLEIMGLREIEEKSRGLQESLDYLVKQKDALGLINRTGKEPSSPKRRTTSLVDERGVYGRGDDREAILKLLLSDDANGQNLGVVPIVGMGGAGKTTLAQLVYNHSRVQERFGLKAWVCVSEDFSVSKLTKVILEGFGSYPAFDNLDKLQLQLKERLRGKKFLLVLDDVWDEDYAEWDNLLTPLKCGAQGSKILVTTRNESVATVMRTVPTHYLKELTEDSCWAVFATHAFRGENPNAYEELQEIGRAIARKCEGLPLAAITLGGLLRTKRDVEEWEKILKSNLWDLPNDDILPALRLSYLYLLPHMKQCFAYCAIFPKDYSFQKDELVLLWMAEGFLVHSVDDEMEKAGAECFDDLLSRSFFQQSSASPSSFVMHDIMHDLATHVSGQFCFGPNNSSKATRRTRHLSLVAGTPHTEDCSFSKKLENIREAQLLRTFQTYPHNWICPPEFYNEIFQSTHCRLRVLFMTNCRDASVLSCSISKLKHLRYLDLSWSDLVTLPEEASTLLNLQTLILEYCKQLASLPDLGNLKYLRHLNLQRTGIERLPASLERLINLRYLNIKYTPLKEMPPHIGQLAKLQKLTDFLVGRQSETSIKELGKLRHLRGELHIGNLQNVVDARDAVEANLKGREHLDELRFTWDGDTHDPQHITSTLEKLEPNRNVKDLQIDGYGGLRFPEWVGESSFSNIVSLKLSRCTNCTSLPPLGQLASLEYLSIQAFDKVVTVGSEFYGNCTAMKKPFESLKTLFFERMPEWREWISDEGSREAYPLLRDLFISNCPNLTKALPGHHLPSLTTLSIGGCEQLATPLPRCPIINSIYLRDASRTLGWRELDLLSGLHSLYVSRFNFQDSLLKEIEQMVFSPTDIGDIAIDGVASLKCIPLDFFPKLNSLSIFNCPDLGSLCAHERPLNELKSLHSLEIEQCPKLVSFPKGGLPAPVLTQLTLRHCRNLKRLPESMHSLLPSLNHLLISDCLELELCPEGGFPSKLQSLEIWKCNKLIAGRMQWGLQTLPSLSHFTIGGHENIESFPEEMLLPSSLTSLTIHSLEHLKYLDYKGLQHLTSLTELVIFRCPMLESMPEEGLPSSLSSLVINNCPMLGESCEREKEQYAQDKIDLLAPSGF

SEQ ID NO: 5227 - protein, 329 aa, Yersinia pestis CO92
MSLNVKLHPSGIIFTSDGTSTILDAALDSNIHIEYSCKDGTCGSCKAILISGEVDSAENTFLTEEDVAKGAILTCCSKAKSDIELDVNYYPELSHIQKKTYPCKLDSIEFIGEDIAILSLRLPPTAKIQYLAGQYIDLIINGQRRSYSIANAPGGNGNIELHVRKVVNGVFSNIIFNELKLQQLLRIEGPQGTFFVREDNLPIVFLAGGTGFAPVKSMVEALINKNDQRQVHIYWGMPAGHNFYSDIANEWAIKHPNIHYVPVVSGDDSTWTGATGFVHQAVLEDIPDLSLFNVYACGSLAMITAARNDFINHGLAENKFFSDAFVPSK

SEQ ID NO: 5228 - protein, 465 aa, Glycine max
  misc_feature (14)..(14): Xaa can be any naturally occurring amino acid
  misc_feature (80)..(80): Xaa can be any naturally occurring amino acid
LRSKTRANIKVTAXVRKDAADPTHTCAMEFDNFVLITGESEAVKRALFAVSSIMYKFGPREDISLDTAVPEAPPRIIIPXPDVPVYPPGGLYPASDPIVTPRAVPQIIGATNVPDLQGYADAENSWPLYTSALPVVSGVGASRSEELIIRMLCPSDKIGRVIGKGGSTIKSMRQASGAHIEVDDSKANFDECLIIITTTESPSDLKSMAVEAVLLMQGKINDEDDTTVSIRLLVPSKVIGCIIGKSGSIINEIRKRTKADVRISKGDKPKCADARPELVEVGGSVDCVRDALIQIILRLRDDVLRERDTGHNPSIGAESLYPGSAGLSLPSMMHSVPPVAAPMVYDHRAESGAGLGMLSSSSLYGGYGSLSMGDNGYGSMSSYATKLYGGLPPPSTLDMLIPANAVGKVLGKGGANIANIRKISGASIEISDNKSARGDRIALISGTPEQKRAAENLIQAFIMAT

SEQ ID NO: 5229 - protein, 499 aa, Aeropyrum pernix K1
MAKASAESLGGTVASEESIASYIGAGILSSGGNAVDAAVATSLALTVLIPHLGGVGGDFFMLYRSPEGRVFFVNGSGFAPRRLTREEVLGRGLQEIPESGPLSPTTPGYLAGLYHSWRSFGTMEWASLVKPARLLASRGFPLPPSTARSLKLRRECLEADPGSREAVLKTLPREEGSPARLPGLAALLSGVEEDPLYLYQGEPAEALEEYLASIGGVMGAEDLAGTRGFTAEPLYSEYRGWKVWEMPPNTQGVTTLHLLMLLEEEELPEPFSPERVDILAGLARMAYSIRDRYVGDPRYMPIDPHELARKETLLKLLGQEESNGSKATGDTTFFAVADREGGIVAGIQSLFYPWGSCVTEPRFQVTLNNRARGFTLKEGLPSTLRPGAFPLHTLSSVIMEQRERVIALGASGGHLRPQQHALFVTNIVDYGMNVLDAINAPRAVWDPGRGEILCEEGFGCRPSWRKVERIGVANAVEVAGSVKRGYTDMRGDGLPAVAP

SEQ ID NO: 5230 - protein, 393 aa, Nitrosomonas europaea ATCC 19718
MSHVMNTYARLPVTFVKGEGVWLWDDQGNRYLDALSGIAVCGVGHCHPVLVKALCEQVSTLIHTSNVYHIQHQERLADRLTSLSGLEKAFFCNSGAEANEAAIKLARLYGHNQGINLPTIIVMERSFHGRTMATLTATGNRKTQAGFEPLLTGFVRVPYDDLEAVNKVAANNREIVAILLETYQGEGGVNFPQANYLQGLRRICDQNGWLLMLDEVQCGLGRTGKWFAFQHSEVMPDAMTLAKGLGSGVPIGACLAGGKAAEVFKPGNHASTFGGNPLACRAALTTLDIIEQEGLMDNAVTIGNFMWEEFGRRLQAWQDVLKIRGQGMMIGIELPVPCSELVPEALKRRVLVNVTSEKVVRLLPALNMQKAEAEQVVTEVSALITWFLESRVK

SEQ ID NO: 5231 - protein, 187 aa, Yersinia pestis CO92
MTVSASKTAQQLKYIKDSIKTIPDYPKAGILFRDVTSLLENPKAYSASIKLLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 5232 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 5233 - protein, 650 aa, Listeria monocytogenes EGD-e
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVMQKLQDLDSNEYNPEIISLYLMNFERALGRGKNKKESNDEALQTTIDLASQIERETIQRYFEKGTITRKEMKVYRDNLLAIEANMQLEF

SEQ ID NO: 5234 - protein, 303 aa, Physcomitrella patens subsp. patens
MAMALRWRGCARLWHRGVYRGLHLGPLEQPESPQPSPDSKFTNFGFREVPEQEKSKLVGEVFSNVASNYDLMNDLMSGGLHRLWKDRLVSQLAPFPGMQHLDVAGGTGDVAFRVVNAIQKAEQRVPGNTLGSVDEEDRTKVYVCDINPNMLEVGKKRAKERGLGNAACLVWMQGDAEALTLNDESMDGYTIAFGIRNVTHIDRALKEAYRVLRRGGRFLCLELSHVSTPGFREVYDAYSFNVIPRIGEVVSGDRASYQYLVESVRKFPNQEKFASMIADAGFKDVQYENLVGGVVAIHSGFKL

SEQ ID NO: 5235 - protein, 295 aa, Nitrosomonas europaea ATCC 19718
MHNTIENFIGHTPLVRLKRIPSETSNTILAKLEGNNPAGSVKDRPAYSMIMRAQQRGDIRPGDTLIEATSGNTGIALAMAAAILGYRMILVMPENLSLERRQVMSAYGAEIVLTPKEGSMELARDTAEQLCNAGKGIILDQFSNPDNPLAHYETTAPEIWQDTAGTVTHFVSSMGTTGTIMGCARYFREQEQKVEIIGVQPQENAQIPGIRKWPEAYLPKIYQPELVDRILLVSQQEAEEMARRLAREEGLFTGISSGGALAAALKVSAQVQNAVIVFIVCDRGDRYLSTGVFPS

SEQ ID NO: 5236 - protein, 186 aa, Nitrosomonas europaea ATCC 19718
MPKIAEIEGTPNPNALKFVLKEPLTWGVAKSYDHAEQAVDDPLAAALFDIDHVTNVFYVDRWITITQDGGADWQDLAREVADPIRAAPAATDQSAAVVAAASRTLADLSEEDQQRLERINILLDEEVRPFLQHDGGDLHVLALEGNILRIHYQGACGTCPSSISGTLRGIEQLLRTIEPDIRVVSA

SEQ ID NO: 5237 - protein, 363 aa, Vibrio parahaemolyticus RIMD 2210633
MGFKCGIVGLPNVGKSTLFNALTKAGIEAANFPFCTIEPNTGVVPVPDLRLDALAKIVNPQKVLPTTMEFVDIAGLVAGASRGEGLGNKFLANIRETDAIGHVVRCFENENIVHVAGKVSPIEDIEVINLELAMADLDSCERAIQRNAKKAKGGDKDAKFELTVLEKLLPVLTEGGSARTVELSKEELAAVGYLNFLTLKPTMYIANVNEDGFEDNPYLDAVREFAAKENNVVVPVCAAIESEMAELEDDEREEFLADLGIEEPGLNRVIRAGYELLSLQTYFTAGVKEVRAWTIPVGATAPKAAAKIHTDFEKGFIRAEVVGYEDFIQYNGENGAKDAGKWRLEGKDYIVKDGDVVHFRFNV

SEQ ID NO: 5238 - protein, 318 aa, Chara vulgaris
KVGINGFGRIGRNFLRCWHTRKDSPLEIVAINDTGGVKQASHLLKYDSMLGVFSGNVKIEAEDVISVDGKSIQIVSNRNPLNLPWGEMGIDLVIEGTGVFVDREGAGKHLQAGAKKVLITAPGKGDIPTYVVGVNDADYDPSETIISNASCTTNCLAPFVKVLDNKFTIVKGTMTTTHSYTGDQRLLDASHRDLRRARAAALNIVPTSTGAAKAVALVLPQLKGKLNGIALRVPTPNVSVVDLVVQTAKKTFAEEVNNAFRESADGPLKGILAVCDEPLVSVDFRCTDVSSTVDSSLTMVMGDDMVKVVAWYDNELGY

SEQ ID NO: 5239 - protein, 422 aa, Nitrosomonas europaea ATCC 19718
MKMVDALLTPSVRQTIASGMERLRADFPILDIKVGDKPLVYLDNAASSQMPQAVIDRLVHYQKTQHANIHRAVHHLSDLATQEYEAARRKLQHFIGAREEREVIFTSGTTDSINLVMHGYGRKFIQNGDEIILTALEHHSNIVPWQMLAEEKGARIRVVPINDAGELLVDEYEKLFNSRTRFVGLSHVSNALGSINPIKRMIATAHQHGVPVLIDGAQAAPHMKIDVQDLDCDFYAFSAHKMCGPTGVGILYGKAHLLESMQPFKGGGDMIASVSFEKTTYNDIPYKFEAGTPPIAAVIGFGAAIDYLEQIGLDAIAAYEHELLVYASEQIRMIPGVRIVGDCPDKVAVISFVVDGIHPHDVGTLLNQDGIAVRTGHHCAQPIMQRFNVAATSRASFSFYNTKEEIEVLVAGIRSVQKVFAQ

SEQ ID NO: 5240 - protein, 77 aa, Bacillus anthracis str. Ames
MADVLERVTKIIVDRLGVEETEVVPAASFKEDLGADSLDVVELVMQLEDEFEMEISDEDAEKIATVGDAVTYIESHL

SEQ ID NO: 5241 - protein, 371 aa, Oryza sativa Japonica Group
SFFICPGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPTVESQNEFYFPEWIYERVINGQDLVLTMETTQGEKEMVRQLAIVALWCIQWNPKDRPSMTKVVNMLTGRLQNLQVPPKPFISSQNQLVI

SEQ ID NO: 5242 - protein, 416 aa, Shewanella sp. MR-4
MSLVAIGINHKTATVDLREKVAFSPDKIHDAMKSLASRTRSGEAVIVSTCNRTELYCNNGDEADIIEWLEEYHGLDHQDVAPCLYNYHGQAAVRHLMRVASGLDSLILGEPQILGQVKQAFVKAKEAGTVALTIDRMFQNTFSVAKKVRTETEIGAAAVSVAFAAVSMAKHIFSSLSTTKVLLIGAGETIELVAKHLKDNGVASMVVANRTLERAQSMCEEFNATAITLAQIPDFLPKADIVISSTASPLPILGKGMVEKALKQRRHQPMLLVDIAVPRDIEPEVADLDDAFLYTVDDLHSIIEQNKASRKEAAEQAELITEEQSHLFMEWVRSLESVDSIREYRSQSMAIKDELVERALNKLAQGGDTEQVLIELANRLTNRLIHAPTQALTVASRQGDLNTLGQLRTVLGLDKN

SEQ ID NO: 5243 - protein, 531 aa, Bradyrhizobium sp. ORS278
MRTKSMIVRIGDGRRELPSADEVGAKAANLARMAALDLPVPPAFVLPVQLCADVVAGKGQATRQLAEGLKEGIAYLEQATGKTFGCSRNPLLVSVRSGAARSMPGMLDTVLNVGCTSRAVRGLVRATGRPRLAWDCRRRLLESYAETVIGLEAAALAERLNQLIAAEGVSNERELDSEALERLAAEERRLLEDNDDDGWLEDAAVQLERAAFAVYRSWTSERAKTYRRLEALEHLTGTAVTVQAMVFGNGGTSSGAGVAFSRDPSTGVDEPVIDVLFDSQGEDVVSGRRTPETEAALSRSLPRVAQQLRATLKRLEAEFRDVQDIEFTIEEGRLWILQTRAAKRTPRAALRIAVGLVHEGVISQDEALARLQGIDLEALTETSLVAVGEPAAVGVAASGGVAAGRAAFDSASAERLAAAGDPVILIRPDTSTADVAGFAAAVGIATAVGARTAHASLVARQMGKPCVVGCAAIRFDEDGHQACIGDTIIAPGDWITIDGNAGRVYLGRGEIVARRPEAELAELSTWRSAAA

SEQ ID NO: 5244 - protein, 315 aa, Shewanella sp. MR-4
MPDIKLFAGNATPSLAKKIADRLFCKLGDAVVGRFSDGEISVQINENVRGADVFIIQSTCAPTNDNLMELIVMVDALRRASAGRITAVIPYFGYARQDRRVRSARVPITAKVVADFLSSVGVDRVLTCDLHAEQIQGFFDVPVDNVFGSPVLLEDMLAKKLDNPVVVSPDIGGVVRARAVAKLLDDSDLAIIDKRRPQANVAQVMHIIGDVQGRDCIIVDDMIDTGGTLCKAAEALKEHGANRVFAYATHPVFSGKAAENIENSVIDEVIVTDTVPLSPEMLKVAKVTQLTMSAVLAEAIRRVSNEESISAMFSH

SEQ ID NO: 5245 - protein, 184 aa, Arabidopsis thaliana
  misc_feature (38)..(38): Xaa can be any naturally occurring amino acid
  misc_feature (82)..(82): Xaa can be any naturally occurring amino acid
  misc_feature (95)..(95): Xaa can be any naturally occurring amino acid
  misc_feature (154)..(154): Xaa can be any naturally occurring amino acid
MASSMLSSTAVATSPVQDTMVRLHCTGLKSSASFPVTXRKANNYFTSITRNGGKDICMKVCTPVGKNKCETLSYLPDLTDVXELAKEVDYLLRNXRIPCVEFELEHGFVYREHCNTPVYYDGRYWTMCKLPLVGCTDSAQVLKEAEECKKEYPXVFIMIIGFDNARIVQCIRFIVQKPPRFPKA

SEQ ID NO: 5246 - protein, 408 aa, Burkholderia sp. 383
MNNSTSANRKAVIVGGSLGGLFAANLLLRNGWDVDVFERVPEELSGRGAGIVTHPELFEVMLAAGVRLDETIGVKVESRITLGQDGTIVSEHRLPQTLTAWSKMYHVLRSALPDQHYHSGAVVTSVTDGSDRASVMLSDGSVVHADLVIAADGFRSAVREKFLPGTPLQYAGYVAWRGLADELSLSDSTHAALFENFAFGLPPREQILGYPVAGHGNSTKPGERRYNFVWYRPASEEEDLPNLLTDATGKLWEGGIPPTFIRREVIADVEEAAQALLAPQFAEVVSRATQPLFQPIFDLEVPQMAFGRIALLGDAAFVARPHCGMGVAKAAGDAMALVTALATRTDTLDALSEYSQIRTQFGIAIVQHARHLGAYMQAQLKNDTEREMAERYRTPEVVMRETAVPPHF

SEQ ID NO: 5247 - protein, 335 aa, Robiginitalea biformata HTCC2501
MEYASNILGTIGNTPLVRINRITSDLPCLVLAKYETFNPGNSVKDRMALKMVEDAEADGLLSPGGTIVEGTSGNTGMGLALAAIVRGYRMICVISDKQSREKIDILRAVGCEVHICPTDVAPEDPRSYYSTARRLAEEIPGAWYVNQYDNPGNTRAHYESTGPEIWQQTDGRVTHFVVGVGTGGTISGVGRYLKEQNPDIRIWGVDTYGSVFKKYHETGIFDPDEIYPYVTEGIGEDILPENVDFEIIDGFTKVTDRDAALYTRRLAREEGMFLGNSAGAAVKGVLQLAEHFGPEDVVVVLFHDHGSRYVNKIYNDQWMRDQGFLDPESGPPVKE

SEQ ID NO: 5248 - protein, 329 aa, Ananas comosus
MALSMSGIVAVLMVLSLAPLSLGGGYLCPEYYDKSCPQVKEIVWSMVAKAVAKEPRMAASLLRLHFHDCFVKGCDASILLDSSGSIVSEKGSKPNKNSARGFEVIDDIKAAVEQACPKTVSCADILALTARYSTVVAGGPNWEVPLGRRDSLGASLSGSNNDIPAPNNTLPTIITKFKRQGLDVVDVVALAGAHTIGFSRCTSFRQRLYNQSGNGLADSTLDESYAMQLRWGCPRSGSDDNLFPLDYVSPAQFDNYYYKNILVGKGLLNSDQILFTKSATTRQLVELYAANIGIFYDHFAKSMIKMGNITPLTGLEGEVRTNCRRINSS

SEQ ID NO: 5249 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 5250 - protein, 346 aa, Oryza sativa Japonica Group
MENGGGDVPENANDHCPGTQSEAAGKADACAGCPNQQICATAPKGPDPDLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 5251 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 5252 - protein, 145 aa, Physcomitrella patens
  misc_feature (66)..(66): Xaa can be any naturally occurring amino acid
  misc_feature (74)..(74): Xaa can be any naturally occurring amino acid
  misc_feature (138)..(138): Xaa can be any naturally occurring amino acid
MAAAAMTSIVPVASIAPVSKVANVRPSSVSVAKAFGLKSRSMGRLTCMATYKVTFLDGETGAENVXECSDEEYXLDAAERAGMDLPYSCRAGACSSCAGIIKAGEVDQSDQSFLDDSQIDDGFVLTCVAYPASDCIIXTHQEENM

SEQ ID NO: 5253 - protein, 527 aa, Triticum aestivum
MVAMAPAAGLVLASLAVVLATTLWKAAVHLVWRPYAVARAFRRQGIRGPAYRFFVGNNEEVMAMRAATADDVLDLGSHDIIARVMPQYKAWVASYGKIFLSWSGYTPSLCVGDHDMVKQILSNKTGLYAKPNPGPNFLALLGKGLVFSDGDDWARHRRIVHPAFTMDKLKMMTRTMAECAGDMVRPWEALAEASDGGVARVDDVGQQFVELTADVISHTAFGSSYREGKEVFVAQRELQYIAFSTMNNVRVPGLENLPTKTNLRRRQLTGKVRGTLMAIIRERQAAAKEAKGYGNDLLGLMLEANASVGAGGQKAAAISMDEIIDECKTFFFAGHDTTSHLLTWAIFLLGTHPEWQQKLREEVLRECGGTGTPLHGDALNKLKLTTMVLYETLRLYGAVIMIARETTADTELGGVKIPRGTTTMIPMAIMHRDEEVWGADAGEFKPDRFRNGVGRAAKHPSAMLAFSAGPRSCIGQDFAMLEAKATLAVILRRFEFEVAPEYVHAPAEFLTLQPKCGLPVLLKLLDQ

SEQ ID NO: 5254 - protein, 522 aa, Pyrococcus abyssi GE5
MGMMEKVEDLYQRRKKILQMGGEEAIKKQHDKGKLTARERIELLLDPGSFVEIGMFVKHRATEFGMDKRDLPADGVITGYGTINGRLVFVYAQDFTVMGGSLGEMHAMKIKRIMELALEAGAPVIGLNDSGGARIQEGVDSLKGYGEIFKMNTILSGVVPQITAIMGPCAGGAVYSPAIGDFILMVDNPSTFMFITGPQVVKAVTGVDVTPVQLGGALVHAQKSGQAHLIGKSDEEVIGLIKRLLSYLPSNNMEKPPRVKPKDEPFRRTPELYDIVPDDPNKAYDVRQVIYAIVDRDENGNPDFLELQPYFAPNAVIGFGRINGQTVGIVANNPIHLAGVLDIDSSDKIARFVRFCDAFNIPIVTFVDVPGYLPGVDQESRGIIRHGAKVLYAYAEATVPMVTVILRKAYGGAYLAMGSKHLGADFVFAWPTAEIAVMGPEGAANIIFRKEIAKAENPEEFRKQKIQEYREKFANPYVAASRGYIDDVIDPAETRAKIVMALEALENKRVKLPPKKHGNIPL

SEQ ID NO: 5255 - protein, 1912 aa, Oryza sativa
IHSRFSTNTFPSWDRAQPMRVLGHNGEINTLRGNKNWMKAREGLLKCEGLGLTRDEMLKLLPIVDATSSDSGAIDNVLELLIQSGRSAPEAVMMMIPEAWQNDVNMDPERKALYEFFSALMEPWDGPALISFTDGRYLGATLDRNGLRPGRFYVTYSGRVIMASEVGVVDVPPQDVSRKGRLNPGMMLLVDFENHCVVNDDELKKEYSKVRPYGEWLKRQRIQLTDIIESVNEAERIAPSISGALPITKENKADMGICGILTPLKAFGYTREALEMLMLPMAKDGQEALGSMGNDTPLAVMSNREKLTFEYFKQMFAQVTNPPIDPIREKIVTSMECMIGPEGDLSETTERQCHRLTLKSPLLNTNEMEAIKKMNYRGWRSKVLDITYPKKNGRMGLKQTLDKICAQAREAIHEGYTILVLSDRERVAVSSLLAVGAVHQHLVSHLERTRIGLLVESAEPREVHHFSTLIGFGADAICPYLAIEAIWRLQIDGRIPPNDGKPYTQEQLIEKYFYASNYGMMKVLAKMGISTLASYKGAQIFEALGLASEVVSKCFEGTPSRVEGATFEMLAQDALRLHEIAFPSRTLPPGSADANALPNPGDYHWRKNGEVHLNDPFSIAKLQEAARINSREAYKEYSRRIYELNKACTLRGMLKFREIPNQISLDEVEPAKEIVKRFCTGAMSYGSISLEAHTSLAEAMNTLGGKSNTGYITIKNGSKGQLTTQTLTFFRGTVEPFALGRWCCENFVPFNLNTNDAQSLCAFPKKNNPRISAIKQVASGRFGVSIYYLTNAVEVQIKMAQGAKPGEGGELPGHKVIGDIAVTRNSTAGVGLISPPPHHDIYSIEDLAQLIHDLKNANPGARISVKLVSEAGVGIVASGVVKGHADHVLISGHDGGTGASRWTGIKNAGLPWELGLAETHQTLVANGLRGRAVLQTDGQMKTGRDVAVACLLGAEEFGFSTAPLITLGCIMMRKCHTNTCPAGIATQDPVLRAKFAGKPEHVINYFFMLAEEVREIMAQLGFRTVNEMVGRSDMLEIDPKVLEGNEKLENIDLSRLLKPAAEISPGAVQYCVEKQDHGLDMALDNKLIASSTAALRKGVRVFIETPVRNINRAVGTMLSHEVTKRYHIHGLPSDTIHIKLNGSAGQSFGAFLCPGITLELEGDSNDYVGKGLSGGKIVVYPPRNSRFNPQDNIVIGNVALYGATKGEAYFNGMAAERFCVRNSGAQAVVEGIGDHGCEYMTGGTAVILGKTGRNFAAGMSGGIAYVYDVDGKFSSRCNYELVDLYAVVEEDDITTLRMMIQQHRLHTQSDLARDVLLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKALSLSRDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 5256 - protein, 143 aa, Triticum aestivum
MGTVAIYSLFIINKSGGLIYYKDYGSAGRMDTNDSLRLASLWHSMHAISQQLSPTTGCTGIDLLQAHNFDLHCFQSLTGTKFFVVCETGAQNMEILLKTIYELYTEFVLKNPFYEMEMPIRCELFDLNLAHVIQKDRVALLGR

SEQ ID NO: 5257 - protein, 558 aa, Pseudomonas sp. V22
MNAPVPVPRVADFTCEKKPATGSRGMVVTNHPLASAAGAQILLAGGNAIDAAVASLFALTVAEPMMVGILGGGLSHIRLADGRHVVIDNLSTAPGKATADMYECLSDEIGKQRDTRDRENVVGAKAVAVPGALKGWCEALARFGTLPLAEVLQPAIGLAERGFVVTPYLSNCITDNAADLARDPGLAAMLLPGGQPLQPGMRLIQSDYAASLKLIAAEGPEALYGGKLGRALTDYMAANGGLIDQADLSNYRIELREPIRGSYRGYEIIGPPPPSSSGVHIAQMLNILEGYDIGALGFGSTDAVHLLAEALKIAFADRAVATADPAFVKVPVARLIDKAYADERRALIAMEQAKSWTAGLSGGESADTTHVTVADAMGNVVSATQTINGLFGACVQTPGTGMIANNYMYNFDPHPGRALSIAPGKRVFTSMAPMMAVKEGRLAFALGLPGALRIFPSALQAIVNLIDHRMSLQEAVEAPRVWTEGGVLELEEAIPESVAQALIARGHKVVRSPRVAGGMNAIAFNPDGTLTGAACWRADGTPVAISGGLARAGARFTI

SEQ ID NO: 5258 - protein, 146 aa, Zea mays
VFLLSLNLCSIVHLCPEPYPEENARFLRTNGIRLHQFAVEGSKSGPTVLDTMSAQEPFVHIPEETIREALKVVLDVRNQPVLIHCKRGKHRTGCVVGCLRKLQKWCLSSVFDEYLHFAAAKARSTDQRFMELFDASSLTHLAASQY

SEQ ID NO: 5259 - protein, 515 aa, Zea mays
MATKGGNARGVPVGALLVAALLLSSLVPTSASSYPARVVSGFLSNAASAVVKRLWSLKSTTETAASGGKSMVKYEGGYTVETVFDGSKLGIEPYSVEVTQSGELLVMDSMNSNIYRMALPLSRYSRPKLVAGSPEGFPGHVDGKLREARMNHPKGFTVDDKGNIYVADAMNMAIRKISDTGVTTIAGGKSGRGGHVDGPSDEAKFSTDFEVRYIGSSCSLLVIDRGNQAIREIQLHFDDCVYQYEAGFPLGVALLLAAAFFGYMLALLQRRVLGMYSNGDEQEDESPVKAKLSSIPPPYQKPLKSSLRPPLIPNDDEPVKQEEEGLFTSIGKLVGVARSSVAEIVGATFSRKKRVNVHHHQLGRPTSWPVQESYAIPRDETPPPLDTRAPTPRKSYAFMSKEPEKIHHIRHGRPQSHGWTGEAAAAAPQQQAASLPPQQQQQQVHHQQYHNRQYSAGPQTFYEPSCDAAKEIVFGAVQEGDTGRRRPVEIKPVNHGDQAPFELNGLRFRSSYGMG

SEQ ID NO: 5260 - protein, 214 aa, Bacillus anthracis str. Ames
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSVIEHVLEDIDMVLLMTVNPGFGGQKFIHSVLPKIKQVAEMVKERNLEVEIEVDGGVNAETARLCVEAGANVLVAGSAVYNQKDRGEAIRVIRG

SEQ ID NO: 5261 - protein, 159 aa, Bacillus cereus ATCC 10987
MNISIISIGKLKEKYLKQGIAEYLKRLSAYAKVEVIELPDEKAPENLSEAEMLIVKEKEGIRILDKISDDTHVIALAIEGKQKSSEEFAVSLDRLATYGKSKVAFVIGGSLGLSSEVIKRSNESLSFSKMTLPHQLMRLVLLEQVYRAFRINRGEPYHK

SEQ ID NO: 5262 - protein, 431 aa, Clostridium perfringens ATCC 13124
MKQYIEIIDVVARQILDSRCFPTVEVEVYLEDGTVGRAAVPSGASTGIYEAVELRDGDKDKYLGKGVEKAVANVNDTIAEEIIGLNVLDQAYIDKTLIELDGTKNKGKLGANAILGVSLAVAQAAANYLGMPLYQYIGGVNAKVLPVPMMNIINGGSHADNSVDIQEFMIMPVGFDCFERAVRACAEVYHALKKTLNSKGYSTGVGDEGGFAPNLKSNAEAIEVILEAIEKAGYEPGKEFFIAIDAASSEYYKDGKYVLEHEGKTLTAAEMVDFFEDWVNKYPIISIEDGMAEEDWEGWKLMTERLGKKVQLVGDDLFVTNTERLKTGIEKGIANSILIKLNQIGTLTETLNAIEMANRAGYTAVVSHRSGETEDTTIADLVVAVNAGQIKTGAPARSERVAKYNQLIRINEELGEVAEYRGRNAFFNLSK

SEQ ID NO: 5263 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKIMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 5264 - protein, 347 aa, Chlorokybus atmophyticus
KVGINGFGRIGRNFLRCWWGREDSPLELVAINDTGGVKQASHLLKYDSMLGTFAPDVKAVGDNKISVDGQEFMIVSSRNPLDLPWKELDIDLVIEGTGVFVDSAGAGKHIEAGAKKVLITAPAKGSDIPTYVVGVNDQDYDPSAPIISNASCTTNCLAPFVKILSDKFGIVKGTMTTTHSYTGDQRLLDASHRDLRRARAAALNIVPTSTGAAKAVALVLPQLKGKLNGIALRVPTPNVSIVDLVIQTEKKTFAEEVNAAFREAANGPLKGILAVCDEPLVSVDFRCTDVSSTIDSSLTMVMGDDMVKVVAWYDNEWGYSQRVVDLADIVANNWNSTVEQAKELSAV

SEQ ID NO: 5265 - protein, 380 aa, Clostridium perfringens ATCC 13124
MNKNVIGVEISGIRKFYNEVVKFPEAISLTLGQPDFPVPEKVKEAMIRAIEEGKTTYTANAGIVELREEISSLLKNNFDIDFSKDEIIITVGGSEGLYAAMTALLNSGEKVLVPSIAYPAYESISKIIGCEVINYDLNEDFSVNIESLKEGIKQGGKLLVLSYPCNPTGALLSKKSRDELIEIIKENDILVLTDEIYSSLCFEEEYYSVAQCKDIKEKIIYVSGFSKMFSMTGLRIGYVACSKEIYDQIIKVHQYNSSCATSISQWGALEGLKSCMNDVENMKESFKERMNFTYKRLKSMGLEVEKPKGAFYIYPNISKFGLTSEEFCHRLLEEGKVACVPGDAFGKGGEGYIRISYCYSKDELERALDKLEAFVKTLKK

SEQ ID NO: 5266 - protein, 222 aa, Rickettsiella grylli
MEIQNLERLKKKLAETTLAYISPGSILGLGSGSTINHLITALAAIRHKIEGVVPASLETEKRLKELHIPVLDLNSAGELMLYIDSADEVNPHLQLIKGGGGALTREKIIASASQNFMCIIDESKYVGMLGQKGLPLEVIPMARSYVAREIVKLGGFPFLRDKFITDNGNIILDTQHWDFTDPIKLERLLNNIPGVVSNGLFAQRPANKLLIANKNGIKIIES

SEQ ID NO: 5267 - protein, 1373 aa, Oryza sativa Japonica Group
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSQEILKSNGKYRPVACMSTNSSFVYVLTGMNSDSIGSLEPSCGYLAMTPLGAGDRPLVLENASYADVVKLMRGGFAIRFPYTSRFYVYSSKIKQCIAQSFQNIVQEERPTSFRIFYTVIFDYHFWGCLLPHPVVQLIVGVIPLAMWTLKWIAVFCRFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGRIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLALCDHASPSPSSSSVVAAVCPQIINGGAADGTDLSNLYQARRHIYHLLSVHHNTSASHILDRGEPPAWNTLVDVGWVRKCSSNISVFSEDYYWTADPPGCGSKSYELVCSDTNATILIDNATYHVNEINYDYRRFWVVDANIAGSTCPLPQWNHLLDQYKRKVSGHRIEIELAPGAYNHAYFVRCSREVKDNGIYRPVTCASSNYSFIYVLLSSDSDNPGYIESLEPSCGYLAMTLLGDWSTTVPRNASYEDVKKFMREGFAIRFPRIYGAGSINECLMDSISELRNGIEPRSSTGTAISDRLIVISIIDLHFWFCLIGYPSGILIAFGMWIVKCIAVLCRFVLVPLAILTFLAHKYWKTRLAIDAVEKFLQMQQVLGPTRYAYTDLTAVTSHFRDKLGQGGYGSVYKGVLLSGDVHVAVKMLNGASTYDGEEFISEVSTIGRIHHVNVVRLVGFCSEELRRALVYEYMPQGSLDKYIFSSERSFSWDKLNEIAIGIARGINYLHQGCDMQILHFDIKPHNILLDDNFVPKVADFGLAKLYPRNKSFVSDRALRGTVGYIAPEMVSRSFGVISSKCDVYSFGMLLLEMAGGRRNADPNTNPNASQSYYPSWVYGQLTGEQVGETSGAADMHELQKKLCLVGLWCIQMKSHDRPTMSETIEMLEGDVNALQVPPRPFFCDGDFMPNVMDSYLHSSELTAISEDDGAIEFASN

SEQ ID NO: 5268 - protein, 114 aa, Vitis vinifera
MAEEGQVVGCHSVESWKEQFQHGIESKKLVVVDFTASWCGPCRVISPFLAELAKKMPNVIFLKVDVDELETVAKEWEVEAMPTFLFLKEGNVVDKVVGAKREELVQKTEKHATA

SEQ ID NO: 5269 - protein, 363 aa, Rickettsiella grylli
MGLKCGIVGLPNVGKSTLFNALTKAGIAVANYPFCTIEPNIGIVPVPDKRLHALAKIVQPQKIIPTTLEFVDIAGLVHGAAHGEGLGNQFLAHIREVDAILHVVRCFENSEIIHVADHVNPITDVQTIHTELALADLESAEKALLRLTKAIKANDKSAQRTKNLLERMIPELNQGRLLSQLQLSPEEILLLRPYSFLTLKSILYIANVDETGFLNNPLLKQLETYGASFHAKVVPICAKLEEDCIDLNDEEKREFLHACGLTETGLDRLVRASYELLNLQTYFTQGVKEVRAWTVRKGATAPQASACIHTDFEKGFIRAEVISYDDFIRYQGEQAAKEAGKWRLEGKTYQIHDGDIIHFLFNV

SEQ ID NO: 5270 - protein, 161 aa, Oryza sativa
VMGQSVLFRQPSSASVVLPNRATSLTVRAASSYADELVKTAKTIASPGRGILAMDESNATCGKRLDSIGLENTEANRQAYRTLLVSAPGLGQYISGAILFEQTLYQSTTEGKKMVDVLVEQNIVPGIKVDKGLVPLVGSNNESWCQGLDGLSSRTAAYYQQ

SEQ ID NO: 5271 - protein, 334 aa, Rickettsiella grylli
MKKHRSLKSSDDCSPIAIIGAGAWGSALAIHLARNDQKVRLWAYEKQQITEINTRRTNERYLPDVLFPSNITCSDDYQTIFSGVQDVLIAVPSIAFRDTLRKIQPYLHVNQRLLWASKGLDSEKHQLLNETAKEILEDINMAVLSGPSFAKEVAKGLPTAVCIASENYDFAHDLLLRFQTKNFRVELTQDIIGVELGGAMKNILAIAVGITEGLGFGANAKAAVMTAGLSEMLELGLILGAKQETFLGLSGLGDLVLTCTDNQSRNRRLGLALGAGQSIEEAKKLIGTTEGYETAKNIFFLIKKYRMKTLFCEGVYQILYEKKQPKTLFKNYFS

SEQ ID NO: 5272 - protein, 316 aa, Azoarcus sp. EbN1
MAYGSLMVFTGNANPKLAADVVRRLGISIGAATVGRFSDGEVNIELLENVRGKDIFVLQPTCSPTNENLMELLVLVDALKRASAGRITAAIPYFGYARQDRRPRSARVPITAKVVANMLQAVGVQRLLTMDLHADQIQGFFDIAVDNVYAAPVLLADLDKQKYDDLLVVSPDVGGVVRARAFAKRMECDLAIIDKRRPKANVSEVMNIIGEVKDRTCVIMDDIVDTAGTLCKAATALKANGARRVLSYCTHAVLSGSAAARIADSDLDELVVTDTIPLRDDAKACPRIRQVSVASLLADTVLRISNEESVSSLFME

SEQ ID NO: 5273 - protein, 313 aa, Sulfolobus tokodaii str. 7
MMQRSTLPMRDTFGRLLAELGEKNKDIIVITADVGNSTRAMYFREKFPDRYFNVGISEQDMVNFAAGLSVTGFKPIVVGFAMFVMRAWEQIRNSIARMNLDVKIMVTHSGYSDSGDGSSHQALEDIALMRVLPNMKVIIPADSEDVKRSLPVVVNELRGPLYYRMGRDYTPVITEGLDYDFKLGKAYVLRDGEDLAIMGAGVVLADALKAAEELEKMGISAAVINLMSIKPIDEDLIEYYARKTGRIITIEEHSIYGGIGSAVAEVVVKKYPVPMRFIGAITFGRSARSERDLLDFYGINYKSILNAVMELVK

SEQ ID NO: 5274 - protein, 419 aa, Triticum aestivum
MAVVNFVKPHIGQSPKLQGRTPRRGSGVVRSSLQGAVVGNRAEWLTSCAVLSSKVAALAPHSTNGHLALAVAASNGAVLDLVPVKTVDGSARSLPAPLRIADLSPAPMHGSELRVAYQGVPGAYSEKASAKAYPGSDAIPCDQFEVAFQAVENWVADRAVLPVENSLGGSIHRNYDLLLRHRLHIVGEVQLPVHHCLLALPGVRREDITRVISHPQALAQCEHTLTRMPGLNAAREAFDDTAGAAEYVAANGLRDTAAIASSRAAELYGMEVLADGIQDDSGNVTRFVMLAREPIVPRMDRPFKTSIVFAHDKEGTSVLFKVLSAFAFRDISLTKIESRPHRPIRLADDADSGTAPKQFEYMFYVDFQASLADPRVQNALAEVQEFTSFLRVLGSYPMDMTPMAAGVASSESSSAYSSS

SEQ ID NO: 5275 - protein, 133 aa, Mycobacterium tuberculosis CDC1551
MADRIELRGLTVHGRHGVYDHERVAGQRFVIDVTVWIDLAEAANSDDLADTYDYVRLASRAAEIVAGPPRKLIETVGAEIADHVMDDQRVHAVEVAVHKPQAPIPQTFDDVAVVIRRSRRGGRGWVVPAGGAV

SEQ ID NO: 5276 - protein, 484 aa, Oryza sativa Indica Group
MQRLASSRRLLQAALAPVRAQSSLSAAAAAAAPAPENAFAAAPKMPPFDYTPPPYDGPRAEEISRKRAEFLSPSLFHFYDRPWAYRHPRFGSYRDYHKYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 5277 - protein, 546 aa, Candida albicans SC5314
MSQSPTNVPRSYNSVLDLKLASPTNSASGATGGWIVQKFGGTSVGKFPENIVDNIVKVYSQTNRVAVVCSARSSQTKSEGTTSRLLRSADLAENDKDYQPLLNAIEEDHVTNAERIQSEEIKQELIKDTKQEIEHVRELLHACQIIGEISPRSLDSIMAVGEKLSCLFMTALMKDHGLNAVYINLQDVIPLSYDFQKGFDDSFYQFLSQEIGKRVLQCDKEGEREGEEDVIPVLTGYFGVVPGGLLNGVGRGYTDLCAALAAVALQADELQIWKEVDGIFTADPRKVPNARLLDSVTPEEAAELTYYGSEVIHPFTMEQVIRAKIPIRIKNVENPTGKGTIIYPDNIGRRGEATPPHPPAAFEQLAMSSLLQRKRSATAITAKQDIVVINIHSNKKTLSHGFLAHVFTTLDKYKLVVDLISTSEVHVSMALSIQSDQESQLKHALVDLRKMGTVDVTKKMTIVSLVGKQMVNFIGIAGNMFKVLADEKINIEMISQGANEINISAVINEKDTIRALKSIHAKLLEGGSAIGDSSAVDTRLEALKLS

SEQ ID NO: 5278 - protein, 464 aa, Delftia sp. AN3
MRWHTTAPQRAAQRLLRRPRLRPTTRPARPAEARPATRLHPPGHRPRRIRPSLARPRLPGAGASFRISPVMKFSTRADRIEPFYVMEIAKAAQEMARGCADSDTPMIFLNIGQPDFTAPPLVQEAAARAVQDGATQYTPALGLPQLRERISHWYAQRFGVDVPARRIVVTAGASAALQLACLATIDAGDEILMPDPSYPCNRHFVSAAEGRAVMVPTTAAERYQLSADKVEAAWNAHTRGVLLASPSNPTGTSIAPAELRRILDVVRARGGLTIIDEIYLGLSYDAAFGQTALALGEDVISINSFSKYFNMTGWRLGWMVVPEAMVPVVERVAQNLFICASTVSQRAALACFEPESIAEYERRRAEFKARRDFFIPALEALGLPVPVQPDGAFYAWADCRAAAARLGVQGSWDFAYAVMERAHLAITPGRDFGTFETADFVRFSTANSMEQLQEAVRRLQRLLA

SEQ ID NO: 5279 - protein, 243 aa, Streptococcus agalactiae A909
MYKAGQFIKSEMQNTFDVEEKSRFDDLVTSLDKKTQKLLIQEIIQHYPDDNILAEEDDVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 5280 - protein, 562 aa, Shewanella sp. MR-4
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKERYCCFNDDIQGTAAVTVGSLLAACKAAGTELNKQRVAFLGAGSAGCGIAEAIVAQMVSEGISDEQARSQVCMVDRWGLLLDNMPNLLPFQQKLAQKCADISHWNNFSDNISLLDVVNNVKPTVLIGVSGAPGLFTEEIVRAMHSHCERPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 5281 - protein, 501 aa, Delftia sp. AN3
MPENPETKMSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 5282 - protein, 510 aa, Oryza sativa Japonica Group
MDFTNLLITVLLLLAPLKYKSDVATASDDEDFFKTCSSHRCSKHGPEISLANNASQFWYLAYPYEYMSILPLGCTIVSKDIPMPYSYDKNGPNFDISIFTETAKRVISTGPRVTIIAVTSSVGTFIVLSLIVATALYISLKSRYNEEIHLKVEMFLKTYGTSKPTRYTFSEVKKIARRFKDKLGHGAFGTVYKGELLNGVPVAVKMLENSVGEGQEFINEVATIGRIHHANIVRLLGFCSEGTRQALIYEFMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTEPTVENQNEFYFPEWIYERVMNGQDLVLTMETTQGEKEMRLEKTKHVASGLVDSTGSLPAVSATIEDTVATTDGAMAVRATARLGHALSHMPGGNGSLPICLRRREAAAEAARGTAYRRINRSSRRE

SEQ ID NO: 5283 - protein, 441 aa, Bradyrhizobium japonicum USDA 110
MNALRQLEWALLELQQSTPLASVSGAISEIAPTHFRVSGLSRFVRLGELIGVNSGGKPQIGEVVRIDSEGIIAKPFDRQFAGGLGSVAYRMPPLSFAPDPSWKGRVINALGAPLDGQGPLTPGSRAVSAEAEAPSAMKRARVHKPLRTGVRVIDLFAPICAGQRVGIFAGSGVGKSTLLAMLARSQGFDTVVLALVGERGREVREFIEDVLGANRNRAVTIVSTGDESPMMRRLAPKTAMAVAEYFRDRGESVLLVVDSITRFAHAAREVALAAGEPAVARGYAPTVFTDLPRLLERAGPGEEGSGTITGIFSVLVDGDDHNEPIADTIRSTLDGHIVLSRHIADQARYPAVDVLASVSRLAHNVWDPEERELVSKLRTMIAKYEDTRDLRLMGGYQSGRDSGLDQAIDLVPRIYSAMRQDASAQPSADPFRELRDMLKGE

SEQ ID NO: 5284 - protein, 158 aa, Oryza sativa
MQFLRGGGGGSGGGGAGGMAWEVLKRHFSRKRAVDVRRINPKVPKEEAVAISGRLLQIFTDHGPLTVGNTWNHAKDAGISGLNSKTHMKILLKWMTGRRIVKLNCVGTGNSKKFLYSPYSADADKSEEAAAEELSKAATSQGGKATKGQQKKRATALH

SEQ ID NO: 5285 - protein, 521 aa, Solanum tuberosum
MAASIGALKSTPSSNNCINERRNDSTRAVSSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDVDRKLLAAKGSVPIGIGKNCHIKRAIIDKNARIGDNVKIINKDDVQEAARETDGYFIKSGIVTVIKDALIPSGIII

SEQ ID NO: 5286 - protein, 519 aa, Candida apicola
MNINFSDALMLGGISLSFLLASQAIYFYFIYSPRAKKLGCAPPPIFFSFPLGIPDLIRLVNAWFHDDLLEWFTHRFEEFGRRTAFQSVAGQLWIGTIEPENIKTMLATSFKDYSLGFRYNAMYGLLGNGIFTLSGDGWKNSRALLRPQFSREQVSHLESMRTHINMMINNHFKGGQVVDAQVLYHNLTIDTATEFLFGESTNTLDPALAQQGLPGPKGLVTGEQFAEAFTSALELLSVRVMAGAAWFLVWTPKFWRSCKVCHNFIDYFVYKALATPMEKGQDADRYVFIRELTKETSDPRVIRDQALNILLAGRDTTAALLSFTTYYLGAYPEVYDELREAVIADFGSADAEPPTFEQLKQCKVLQNVIREVLRLHPNVPLNFREAIADTTFPTGGGPNGDQPIFVPKGQKVFYATYVMQRNAGIWGPDSTSFRPDRWNEPREALASGWDYIPFNGGPRICLGQQFALTEASYTLVRICQEFSRIEVLHPDVITARNVMKQRMRLPNSSSGGVITRFIR

SEQ ID NO: 5287 - protein, 549 aa, Mycobacterium smegmatis
MSADITETPAWQALSDHHAEIGDRHLTELFADDPARGTELALTVGDLYIDYSKHRVTRRTLDLLVDLARAAGLEERRDAMFAGEHINTSEDRAVLHTALRLPRDAKLVVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHSSRCPPTRSWSTKFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 5288 - protein, 191 aa, Triticum aestivum
AYLGDTIEQVCTKKQAGTGPEFPGYRRPTRPLGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 5289 - protein, 505 aa, Candida maltosa
MAIFTPELWLICFAVTVYIFDYIYTKYLMYKLGAKPITHVIDDGFFGFRLPFLITLANNQGRLIEFSVKRFLSSPHQTFMNRAFGIPIILTRDPVNIKAMLAVQFDEFSLGLRYNQFEPLLGNGIFTSDGEPWKHSRIMLRPQFIKSQVSHVNRLEPHFNLLQKNITAQTDNYFDIQTLFFRFTLDTATEFLFGQSVHSLNDGENSLQFLEAFTKSQAILATRANLHELYFLADGIKFRQYNKMVQDFSQRCVDKVLNMSNSEIDKLDRYFFLYEMVKITRNPQVLRDQCLNILLAGRDTTASLLSFAFFELALNEPIWIKLRTEVLHVFQTSLELITFDLLKTKCPYLQAILHETLRLYPSVPRNARFSKKNTTLPHGGGVDGMSPILIKKGQPVAYFICATHVDEKFYTKDALIFRPERWCEEPLIKKNLAWSYLPFNGGPRICLGQQFALTEASYVLTRLAQCYTKISLQPNSFEYPPKKQVHLTMSLLDGVHVKISNLSIS

SEQ ID NO: 5290 - protein, 586 aa, Robiginitalea biformata HTCC2501
MAKSTGKPGAQAKGGRSGSTRSSKSDSRAGYGNNPKDRGYVDGGYEARGYNDPGYDDRGYDDRGYDDRGYNDKGYQDTGYQDGGSDSGNYGKGQGRDTYTDSPQDTYASGKGAGGYSPGDDYVSSPVSKGDPYNREVEDNPSTGYYSDDPYSDNEPIQDPPYDGYDDPVSKQPGGNGYAAKGGGDGLPDADMVFTEEEVYGNSSQPEADMVFTEEEVYGEGPRREEGTSQPQPRGDVFDRSATAFGQIRFRNARDIDQFFADNSDQPDFMSWFGTHIGGRGPWQHRRFGRISAENRSRFSMVWDRIPLIYRGRSEEYSINLFQFLGLVSIMINEVGQTFTPIRERGSLRYMFGTIIPASRTRPQRSKRSYNDFGRSATHRNNKTAYELFNDPAFLEAHRDEALYERVARTTDRVWDGHVYPNGFPTDPDQGGIITQADFYKFSGRGLVQTTWSGAYMRLIDATLQYEGSNRIILEYRNAWRGKRSSGLSIRDIASQTKNSDWDRLFMETNNEFACLAVYCFQHAKNDFLQIPTDAARLRATQTASSGSGSIFYVGYRVGGSRRYGELVRERVMQMLSRLLHDTRQA

SEQ ID NO: 5291 - protein, 521 aa, Candida maltosa
MIDEILPKLVQYWYIVLPTLLIIKHVVSYINTQRLMRKFRAKPVTNVLNDGFFGIPNGIKAIKEKNKGRAQEYNDEKFAAGPKPKVGTYLFKLFTKDVLVTKDPENIKAILATQFEDFSLGKRLDFFKPLLGYGIFTLDGEGWKHSRAMLRPQFAREQVGHVKLIEPHFQSLKKHIIKNKGQFFDIQELFFRFTVDSATEFLFGESVESLKDESIGYDQQDFDFDGRKNFAEAFNKAQEYLGTRAILQLFYWLVNGADFKKSVAEVHKFTDYYVQKALDATPEELEKHSGYIFLYELVQQTRDPKVLRDQSLNILLAGRDTTAGLLSFALFELARNPEVWSRLREEIGDKFGLDEDATIEGISFESLKQCEYLKAVVNECLRMYPSVPRNFRIATKHTTLPRGGGPDGKDPIFIKKGAVVSYGINSTHLDPMYYGPDARLFNPDRWSKPETKKLGWAFLPFNGGPRICLGQQFALTEASYVLVRMIQNFKELELTPNTVYPPRRLTNLTMSLYDGAYIKVN

SEQ ID NO: 5292 - protein, 510 aa, Candida maltosa
MIDALYILIVALVIYKTAQFVHRKSLEKKHHCQPVKQIPLVSILSGLGFDMFFKDTAEMTKNGGLHKKLQQMLESLQTTTFRSRMLTGSQIVTMEPENERTMCSSAHMKDWTIGYRPFALKPLLGDGIFSSEGESWKHSRIMLRPIFAKEHIKQITAMEPYMLLLIEIIKSSSANEGPVDLQPLFHAFTIDYASDFLFGESCDVLKENLGGKSTSGMDAQVKRDFASVFNDVQNYLTKRMMLGPLAFLVSSKDFHDGIKKQHEFVSYFVQKAISMSDEELNDESKNYVFLYQLAKQTKDAKVLQDELLSILLAGRNTTASLLSFLFFELSHHENVWTTLKEVVDQSFPDVESITFETIQNCDYLRWCLFESLRVNPSVPFNSRTANKDTILPRGGGEDCSHPILVKKGDQVLFPLYASNRQEKYFGRKPEEFIPERWRDLPKTGGPAFMPFSTGPRMCLGQQFALIEASYVTIRLVQTFSKLKSHSLEYAPKRLVAATIRLIDGCFVSFE

SEQ ID NO: 5293 - protein, 523 aa, Rickettsiella grylli
MTIPKERILILDFGSQYTPLIARRIRELHIYCEIYPYDVSESKILAFAPKGIILSGGPETVTSMTTPRAPEIVFTLGCPVLGICYGMQTMAEQLGGKVVSCTNREFGYAQGLITTQTHLLTDLRDNAKNEETALLDVWMSHGDHVEQVPPGFVVILSTPNTPIAGMACPIRQFYGLQFHPEVTHTYQGKKILARFVEKICRCQPSWTAPEILEHEIAEIRTNVGKEKVLLALSGGVDSTVLAALLHKAIGKQLLCVFVNTGLLRITDKDSTIQALADDMQISVVKIDASLRFINTLKGITDPEEKRKAIGNLFVEIFESEASKHKDIAWLAQGTIYSDVIESAGTITQKAHAIKSHHNVGGLPDTLKLKLLEPLRELFKDEVCELGIELGLPPELVYKHPFPGPGLAIRILGEVTHEKVDLLRKADLILIEELRKQNYYHKISQAFCVFLPINSVGVIGDTRQYAPIIAIRAIETTDFMTARWANLPHSLLETISNRIINEVHGISRVVYDISGKPPATIEWE

SEQ ID NO: 5294 - protein, 177 aa, Vitis vinifera
MEKMNHAFERVKILVGMEVDDDQNVAAPPDDGPFSFMDDFNRDCTLSTKQRFYGFAICLAAGLTCTLLSMLVFFNPIKFGITFTFGNLLALGSTAFLIGPKRQVTMMLDPVRIYATAIYLASIIIALFCALYVRNKLLTLLAIMLEFGALIWYSLSYIPFARSMVSKIMVSCFDTEF

SEQ ID NO: 5295 - protein, 519 aa, Candida maltosa
MIFTAFILDYWYFTLLFLIAAYFIGKHVYTNYLMRKHHAEPILDVVDDGAFGFKFGFQSLKAKKIGNQIDLLFLKFNEAKHPSIGTFVTRSFGMQFIATKDPENIKAMLATQFNEYTLGQRLNFLAPLLGKGIFTLDGNGWKHSRAMLRPQFSRDQIGHVKMLEPHFQLLKKHIIKNKGTFFDIQELFFRFTVDSATEFLFGESVSSLKDESIGYDQEEIDFAGRKDFAEAFNKSQVYLSTRTLLQLLYWLVNSADFKRCNKIVHKFSDYYIKKALTATPEELEKHSSYIFLYELAKQTRDPIVLRDQSLNILLAGRDTTAGLLSFAVFELGRNPEVWSKLRQEIGHKFGLDSYSRVEDISFELLKLCEYLKAVLNETLRLYPSVPRNARFAAKNTTLPHGGGPDGMSPILVRKGQTVMYSVYALQRDEKYYGKDANEFRPERWFEPEVRKLGWAFLPFNGGPRICLGQQFALTEASYVLARLIQSFETLELSPEAAYPPAKLSHLTMCLFDGTPVRFE

SEQ ID NO: 5296 - protein, 519 aa, Candida maltosa
MVFTAFILEYWYFTLLSLAAGHFIGKHVYTNYLMRKHHAEPILDVVDDGAFGFKFGFQALKAKKIGKQIDLLFKKFNEAKHPSIGTFVTRSFGMQFIATKDPENIKAMLATQFNDFTLGQRLSYFAPLLGKGIFTLDGEGWKHSRAMLRPQFSRDQVGHVKMLEPHFQLLKKHIIKNKGSFFDIQELFFRFTVDSATEFLFGESVSSLKDESIGYDQEEIDFAGRKDFAEAFNKSQVYLSTRSLLQLLYWLVNSSDFKRCNKIVHKFSDYYIKKALTATPEELEKHSSYIFLYELAKQTRDPIVLRDQSLNILLAGRDTTAGLLSFAVFELGRNPEVWSKLREEIGDKFGLDPDSRIEDISFELLKLCEYLKAVINETLRLYPSVPRNGRFAAANTTLPHGGGPDGMSPILVRKGQTVMYSVYALQRDEKYYGKDANEFRPERWFEPEVRKLGWAFLPFNGGPRICLGQQFALTEASYVLVRLIQSFETLELSPDAPYPPAKLTHLTMCLFDGAPVRIE

SEQ ID NO: 5297 - protein, 441 aa, Pseudomonas fluorescens Pf-5
MARLQRTLSLGAVVLFGIAYMTPIIVLGTFGILAQTTAGMVPAAYLAALVAMFFTAMSYGRMAAAFPVAGSAYSYVRKAISPKLGFIAGWAVLLDYLFLPMAIWLIGAAYLHSAFPGVPQWVWVLAFIGVTSAINIVGLKLANGINGLLMLVQFLVLIAFVGLCIHYLGGEAGRPLFTLAPFFNGQMHLPLIMSGAAIACYSFLGFDAVSTLTEETRDPRRTIPRAIMLITLVGGLIFVAVSYFVQVAHPSFEFADVDSAAYEIARNIGGDLFVSIFLIGLIVGQFASGLSAQASGSRLLFAMGRDGVLPKRFFGSLHGRFGTPVNSILLCAVVALLALKLDVTTSTSFINFGAFLAFSLVNLSVIFHYWVGGRQRGLRELILFLIFPLIGLAADLWLMSSLDHLAIYLGASWLVIGLVYLGFLTRGFSRQPPEMDFQEAA

SEQ ID NO: 5298 - protein, 335 aa, Streptomyces coelicolor A3(2)
MATVPTALAGRHFLKELDFTEEEFRGLIELAAELKAAKRAGTETRYLQGRNIALIFEKTSTRTRCAFEVAAADQGASTTYLDPAGSQIGHKESVKDTARVLGRMFDGIEYRGDSQTKVEELAAFAGVPVYNGLTDDWHPTQMLADVLTMTEHSDRPLREITFAYLGDARFNMGNSYLVTGALLGMDVRIVAPKSYWPAQEVVDRAHRLAAASGARITLTEDVAEGVRGAGFVVTDVWVSMGEPKEVWAERIKALAPYAVTMDVLRATGNPDVRFLHCLPAFHDLGTKVGQEIFEAHGLDSLEVTDEVFESAHSVVFDEAENRLHTIKAVLVATLA

SEQ ID NO: 5299 - protein, 357 aa, Sulfolobus tokodaii str. 7
MVSAIVLAGGYATRLRPLSLTKPKALLPILDKPLLDYILDSLEIAGINEVYLSLRVMADKILSHIEGENRKVIPVIEKERLGDAGPLKLISQRYNLSDDVLVIYGDIYNELDIKSLLKFHEKEGCDATIVGKPVEDPRRYGVLITEGERLVQIIEKPKNPVSNLINAGIYVFKKKLLEKIDGQSIAKNFLPKLLSDNTCIAVYKYDGLWMDIGVPSDYIRINLQLLSLKYPKGYINEEAKVSEKVNLIPPYYISSGVNISEDSFIFNSIIGKNTSIGNGVYIDQSILMEDVKVDSFSYIRDSILGDKDNLGKWVRLDSVILGDEVVIYDGVFVNRDTIILPYKEVNESVYDKGKIIL

SEQ ID NO: 5300 - protein, 230 aa, Mannheimia succiniciproducens MBEL55E
MEIANNLKQIHKNIVSICQNAGLPSNSVKLLAVSKTKPVEDLEQAYQAGQRAFGENYVQEGVEKIEFFQAKHPDMEWHFIGPLQSNKTRLVAEYFDWMQTVDREKIAIRLNEQRPANKSPLNVLIQINISDEESKSGIKPADMMALAEIIENLPHLRLRGLMAIPAATHDVAIQAQSFSAMHKLFVELQQSLPNQRIDTLSMGMTDDMTAAIKCGSTMVRIGTAIFGSRN

SEQ ID NO: 5301 - protein, 369 aa, Streptococcus pneumoniae TIGR4
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYV

SEQ ID NO: 5302 - protein, 106 aa, Triticum aestivum
  misc_feature (56)..(56): Xaa can be any naturally occurring amino acid
  misc_feature (59)..(59): Xaa can be any naturally occurring amino acid
  misc_feature (75)..(75): Xaa can be any naturally occurring amino acid
  misc_feature (78)..(78): Xaa can be any naturally occurring amino acid
  misc_feature (85)..(85): Xaa can be any naturally occurring amino acid
  misc_feature (90)..(90): Xaa can be any naturally occurring amino acid
  misc_feature (94)..(94): Xaa can be any naturally occurring amino acid
MAAVWMALAVMLVAAAQVAVAAPVMAPAFLWAPKNYGLSPNEAKEVIHYQDNLPKXLSXSVLQEGGGQTWVCSKXGPXKNVDVAXLFLGXKLQXSNISKDKQSILL

SEQ ID NO: 5303 - protein, 387 aa, Thiomicrospira crunogena XCL-2
MSKRDYYEILEVSATASEGEIKKAYRKLAMRYHPDRNPDDEEAEDKFKEASEAYEVLSDAQKRQAYDQFGHAGVDGSAGQGGFGGGGFADFGDIFGDIFGGGFGGGHRGPQPGSDLQYELEVSLEDAVAGTTVDVRIPTKELCESCDGSGAEPGSDVQTCPTCQGIGQVRVQQGFFAVSRTCPNCHGTGKLVKTPCKTCRGEGYKHSSKTLSVKIPAGVDNGDRIRLQGEGEAGEPGAPHGDLYVRIRVKEHKIFQRDGNTLFCDMPLSFATATLGGTMDVPTLNGKANLKIPAGTQSGQRFKLAGKGVKSVRSSHVGDMIVEVHIETPVKLTSEQKELLKAFDESLQGKHHKQHSPKTHSFFDSVKAFFKGDDEDGGNDKKDGPWN

SEQ ID NO: 5304 - protein, 289 aa, Nitrosomonas europaea ATCC 19718
MSQKHPVIAVTGSSGAGTSTVKTSFEHIFQRERLNVAVVEGDSFHRYDRESMKQAVEESEKGGGRPISHFGPEANEFEKLEELFRSYGQSGSGEIRLYLHNEQEAQPYNQKPGTFTPWKSIQPGTDLLFYEGLHGGVKSDTADVSQYVDLLVGVVPIVNLEWIQKIYRDTAARGYSAEAVTHTILRRMHDYVHYITPQFSRTHVNFQRVPTVDTSNPFIARDIPTLDESMVVIRFRDHRGADFPYLLNMISGSFMSRPNTIVVPGGKMGMAIELILTPLILDLVAKSKK

SEQ ID NO: 5305 - protein, 353 aa, Zea mays
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGC

SEQ ID NO: 5306 - protein, 409 aa, Clostridium perfringens ATCC 13124
MKKLNIIGLGYIGLPTALSFASAGIEVIGTDYNKEIVNTLNNGRVTFKEDGLYNLYKKALNKGIEFSTEYAKTNKYIITVPTPYIKESKKLDARYVISAVESVLEVCDKGTILVIESTVSPGTMDKFVRPIVENRGFVIGEDIHLVHAPERIIPGNMVNELKNNSRTIGSDNIEIGYEVKRWYETFCKGEIVVTDIKTAELSKVVENTFRDINIAFANELSRICRKENMDVYELINIANKHPRVNILTPGPGVGGHCISVDPWFLVGDYPEIVNIIKAAREVNDSQPDFVIDRIRDIMNENGITDISKVGLYGLTYKENVDDLRESPTLQILEKLERYFVKGIKLYDPWIEEKIFENQYNNFNEFLDNIELVVVLVAHDHIKEFKDMLEGKLIFDTKNILRNLNGIYKL

SEQ ID NO: 5307 - protein, 314 aa, Coleochaete scutata
INGFGRIGRNFIRCWHGRGKDSPLEVIAINDTGGVKQASHLLKYDSMLGTFGAEVKIVGDDAISVDGHVIKVVSDRNPLNMPWGKMGVDLVIEGTGVFVDSEGAGKHITAGAKKVLITAPGKGKDIPTYVVGVNAQNYKHTDTIISNASCTTNCLAPFVQILDAKFGLIKGTMTTTHSYTGDQRLLDASHRDLRRARAAALNIVPTSTGAAQAVALVLPQLKGKLNGIALRVPTPNVSVVDLVIQTEKKTFAEEVNAAFREAANGPLKGILAVCDEPLVSADFRLSDVSSTVDSSLTMVMGDDMVKVVAWYDNE

SEQ ID NO: 5308 - protein, 392 aa, Oceanobacillus iheyensis HTE831
MQSLYKSNIVRNMPPYLFAHIQKKKQKLMEQGSDVIDLGIGAPDLPPPSYIIEELSKHIKNRHLHRYSPYQGIPELRQAVATFYQEKYNVTLDPEEEILILIGSKEGLVHLIQSVINPGDKVILPDPGYPVYKMGVHMTQGRAVYLPLDKNKEYKPNWKMLSEQDKEEAKLLFLNYPNNPTGATAQKETFVKAVQIANKYNICIAHDAAYDHVTFSDYKSPSLLQVDGAKKVGVELGSLSKNFNMTGWRIGYIVGNSSVIQALATLKSNIDTSQFIPVQIAAIKALEQSEDEIRTIHHTMEKRMLKTWKLLKNAGFEVKKTKGTIFLWVKVPKGYTSSSFTEQVLDQAHVIVTPGSAFGEQGEGFFRIALTVPEERLIEAVQRIDSWLNGGK

SEQ ID NO: 5309 - protein, 484 aa, Delftia sp. AN3
MKQFLNFINGDFVATAKTFENRNPATNEVVGLVHEAGQAEVDAAVAAGRAALKGEWGTMSVVKRAELLHAVADEINRRFDDFLAAELADTGKPRSLASHIDIPRGAANFKIFADIVKNVPTESFQMTTPDGGTAISYGLRTPLGVVGVICPWNLPLLLMTWKVGPALACGNTVIVKPSEETPATATLLGEVMNAVGVPKGVYQVLHGFGPGSAGEFITKHPGVNGITFTGETRTGEAIMAAAAKGVRPVSFELGGKNAGIVFADADFDKAIAGITRSAFENCGQVCLGTERVYVQRPIFDKFVAALKEKAEGLKIGGPDMPGVGIGPLISAEHKQKVMGYYAKARAEGATVVTGGGEPAMTGEYANGHFVQPTIWTGLPESASVIREEIFGPCCHIAPFDTEEEAIALANATDYGLATTVWTQDLGKAHRMASAIEVGLCWINSWFLRDLRTAFGGSKASGIGREGGVHSLEFYTELRNVMVKL

SEQ ID NO: 5310 - protein, 541 aa, Magnaporthe grisea 70-15
MEADKHKETANTSAVVSDNNSHDEEVGVVNKSKPLVRELRNRHMQMIAIGGSIGAGLFVGSGKALRTGGPASLLICYSIIGGMLFFVCQALAELAVLYPVNGAFYTYVVRFVDPSWGFAVGWDYALSWLTVLPFELIAASITIKYWRDDLRPSIWIATFLAVLIIIQFFGVRGYGEVEFILSVIKIAACTGFIILGIVINTGGVGDQGYLGAKYWVDPGPFQNGFNGFAGVFAIAAFAFGGTELVGLAAAESDNPRKSIPAASKQVFWRIAFFYIVNLFIIGLIVPANDPRLMGASGANTKASPFVLAIEDAGIRVLPHIMNGVITVAVISVANSCAFGSTRTMQAMAERGMAPKQLAYVDKKGRPVICIIIQLAFGLLAFIGESADSGKVFDWLLSLSALSFFFVWGSICLAHIRFRAAWKLQGYSLEQIPYRPAFGVYGSWIGFALNCLCLIATFYNALYPSPNAKPDAEVFFQSYLAAFIVIGLYRVSEKVYSREWSLYVPLADIDLMSGARMAEPSDEPEEERTWKNLPKRVIKALF

SEQ ID NO: 5311 - protein, 375 aa, Fulvimarina pelagi HTCC2506
MSETDLTLDKVEDAIAAIRNGELVVVVDDADRENEGDLIMAASKATPENMAFMIRYTSGIICVPMTGERSEKLNLPPMVANNLDPMRTAFTVSVDYKHGMTTGISADERCNTARALANDNAAGSDFLRPGHMFPLIARDGGVLIRSGHTEAGTDLARLAGLPEVGVLAEVVNDDGTVMRLPELVPFARAHGLKIVSIEDMIAWRVRRESFVKAVREETMTIGGLTGQIRIYETPFDDLQHVVAVFGDVREGEGVPVRIHREQPVTDLFGRTRDTKTWVEIAVDEIGKLGHGVLMLLRTPEVDEFDLGDTVIDHADGEKHQSAISRRKRWREVGLGAQILRDLQIRSIREIASHERAYVGLTGFGIEVTGTILVRG

SEQ ID NO: 5312 - protein, 261 aa, Streptococcus suis 89/1591
MKIGFIGLGNMGAALAHAVSQQPDTQLLLSNHNPAKAQVLQEKVGGQLFSNGEIAEQAKVIFLGVKPHLIQTVLSGLQDQISQNPSAIWISMAAGVPLDSLAAFVSADKLIRIMPNTPVAIGQGMTTYSLVNQELAPLLEQILEKSGKVQQVPESLIDAATAIAGCGPAFVYQMIEALTDAGVQNGLTAQDAKVLAAQTLAGTAQMVLTSDKHPAQLRQEVTSPGGSTIAGVVALEKEGFRYAIIRAVAAALKKTRKLGKK

SEQ ID NO: 5313 - protein, 467 aa, Clostridium perfringens ATCC 13124
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLIANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 5314 - protein, 584 aa, Arabidopsis thaliana
MPLGERGGWERTESRYCGVETDFSNDVTHLLNFNISTGGFDYVLAPLVDPSYRPSLVEGNGVDTQVLPVCGSDLVLSPSQWSSHVVGKISSWIDLDSEDEVLRMDSETTLKQEIAWATHLSLQACLLPTPKGKSCANYARCVNQILQGLTTLQLWLRVPLVKSEGDSMDDTSEGLNDSWELWNSFRLLCEHDSKLSVALDVLSTLPSETSLGRWMGESVRAAILSTDAFLTNARGYPCLSKRHQKLIAGFFDHAAQVVICGKPVHNLQKPLDSSSEGTEKNPLRIYLDYVAYLFQKMESLSEQERIELGYRDFLQAPLQPLMDNLEAQTYETFERDSVKYIQYQRAVEKALVDRVPDEKASELTTVLMVVGAGRGPLVRASLQAAEETDRKLKVYAVEKNPNAVVTLHNLVKMEGWEDVVTIISCDMRFWNAPEQADILVSELLGSFGDNELSPECLDGAQRFLKPDGISIPSSYTSFIQPITASKLYNDVKAHKDLAHFETAYVVKLHSVAKLAPSQSVFTFTHPNFSTKVNNQRYKKLQFSLPSDAGSALVHGFAGYFDSVLYKDVHLGIEPTTATPNMFSW

SEQ ID NO: 5315 - protein, 403 aa, Oryza sativa Japonica Group
MNTSMIHWHGCTCKKLLKKQNLPAITDAIFQLSVAAVQGSHVKVIAATSSVTAFVVLLSMVAIALYLSLKTRYNEEIHMKVEMFLKTYGTSKPTRYTFSEVKKIARRFKVKVGQGGFGSVYRGELPNGVPVAVKMLENPKGEGDEFINEVATIGRIHHANIVRLLGFCSEGTRRALIYEYIPNDSLEKYIFSHDSNTSQELLVPSKMLDIALGIARGMEYLHQGCNQRILHFDIKPNNILLDYNFSPKISDFGLAKLCARDQSIVTLTAARGTMGYIAPELYSRNFGEISYKSDVYSFGMLVLEMVSGRRNSDPSVESQNEVYFPECIYEQVTTGRDLELGREMTQEEKETMRQLAIVALWCIQWNPKNRPSMTKVVNMLTGRLQNLHVPPKPFFSADSHPIM

SEQ ID NO: 5316 - protein, 142 aa, Brassica napus
MAAAHGRVVQKTEEEWRAILSPEQFRILRQKGTEIPGTGEYDKFFEDGIFSCVGCKTPLYKSTTKFDSGCGWPAFFEGLPGAINRAPDPDGRSTEITCAVCDGHLGHVTKGEGYDTPTDERHCVNSVSIIFNPQKPPEEAED

SEQ ID NO: 5317 - protein, 486 aa, Pseudomonas sp. ST41
MKEIKHFINGAFVYSADGRTFEDINPVNGQVIGRVHEAGRAEVDAAVKAARAALKGPWGKMTVAERAEILHRVADGITARFDEFLEAECLDTGKPKSLASHIDIPRGAANFKVFADLIKNVPTEAFEVATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLNYYQQAVDDGATVVTGGGVPDMSAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 5318 - protein, 479 aa, Synechococcus elongatus PCC 7942
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLKRLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAESCPAIAAGWSRHRNPHGCFGAQNYAGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 5319 - protein, 398 aa, Solanum tuberosum
MARRDIQALECKKDGSMSISHLGLQWSLQDSNFCPGGLFASVGQMGSMGFGVSSPNPSDSRDENGGFKLPYSDLCMKYLSFSEGFKIVGNGEEEGVVKEKKKKGGLKIKLKVSNPSLRRLISGAIAGAISRTAVAPLETIRTHLMVGSSGHSSTEVFNSIMKTEGWTGLFRGNFVNVIRVAPSKAVELFVYDTVNKNLSSKPGEQSKIPIPASLVAGACAGVSSTLLTYPLELVKTRLTIQRGVYNGLLDAFVKILKEGGPAELYRGLTPSVIGVIPYAATNYFAYDSLRKAYRKIFKEEKIGNIETLLIGSAAGAISSTATFPLEVARKHMQVGAVSGRAVYKNVIHALVSILEQDGIHGLYKGLGPSCMKLVPAAGISFMCYEACKRILIEAENEE

SEQ ID NO: 5320 - protein, 217 aa, Solanum tuberosum
MAEGGEEDLPRDAKIVKTLLKSMGVDDYEPRVVHQFLELWYRYVVDVLMDAQVYSEHAGKASIDSDDIKLAIQSKVNFSFSQPPPREVLLELARNRNKIPLPKSIAGSGVPLPPEQDTLINPNYQLAIAKKQTSQPEETEEDEERADPNPAPSKNPSLSHEKTDVPQGTPQQVSFPLGANVQDDVLCLISFSHKSLCNRLPMYLIKGIVYLLFKHEV

SEQ ID NO: 5321 - protein, 266 aa, Triticum aestivum
  misc_feature (245)..(245): Xaa can be any naturally occurring amino acid
  misc_feature (260)..(260): Xaa can be any naturally occurring amino acid
RVINNRLSALSFHIREYYWVDMKKINEIYRYKTEEYSHDAINKFNIYPEQIPSWLADWIPDKGGYLIGNLQPAHMDFRFFSLGNLWAIVSSLATQKQAEGILNLIETKWDDIVANMPLKICYPALEYEEWRIITGCDPKNTPWSYHNGGSWPTLLWQFTLACIKMGRPDLARRAVEAVEKRLSDDKWPEYYDTRTGRFIGKQSRLYQTWTIAGFLSSKMLLDCPGVAPILICDEDLELLEGCACXLSNSARIKSSRRAAXRSQVLV

SEQ ID NO: 5322 - protein, 473 aa, Pseudomonas fluorescens Pf-5
MPVGNQLPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVVGGIGIIAFGFGNDGVALGISNLWSHGGFMPNGVTGVLMSLQMVMFAYLGVEMIGLTAGEARNPQKTIPNAIGSVFWRILLFYVGALFVILSIYPWNEIGTQGSPFVMTFERLGIKTAAGIINFVVITAALSSCNGGIFSTGRMLYSLAQNGQAPAGFAKTSNNGVPRRALLLSIFALLLGVLLNYLVPEKVFVWVTSIATFGAIWTWVMILLAQLKFRKGLSPAERAGLKYRMWLYPISSYLALAFLVLVVGLMAYFPDTRVALYVGPAFLVLLTVLFYLFKLQPTNVQQGSARSAS

SEQ ID NO: 5323 - protein, 387 aa, Saccharomyces cerevisiae
MSAPTPLAEASQIPTIPALSPLTAKQSKGNFFSSNPISSFVVDTYKQLHSHRQSLELVNPGTVENLNKEVSRDVFLSQYFFTGLRADLNKAFSMNPAFQTSHTFSIGSQALPKYAFSALFANDNLFAQGNIDNDLSVSGRLNYGWDKKNISKVNLQISDGQPTMCQLEQDYQASDFSVNVKTLNPSFSEKGEFTGVAVASFLQSVTPQLALGLETLYSRTDGSAPGDAGVSYLTRYVSKKQDWIFSGQLQANGALIASLWRKVAQNVEAGIETTLQAGMVPITDPLMGTPIGIQPTVEGSTTIGAKYEYRQSVYRGTLDSNGKVACFLERKVLPTLSVLFCGEIDHFKNDTKIGCGLQFETAGNQELLMLQQGLDADGNPLQALPQL

SEQ ID NO: 5324 - protein, 487 aa, Sinorhizobium meliloti 1021
MQRFQCYINGEFADGEARFESIDPTTGRAWAEMPEAREADVNRAVEAARIALHDQPWSTLTATQRGKLLYKLADLVAENAGRLAELETRDTGKIIRETSSQIAYVADYYRYYAGIADKIEGSYLPIDKPDMDVWLRREPIGVVAMVVPWNSQLFLSAVKIGPALAAGCTMVVKASEDGPAPLLEFARLVHAAGFPAGVVNIVTGFGPSCGAALSRHPQVDHIAFTGGPETARHIVRNSAENLASTSLELGGKSPFIVFADADLESAANAQIAGIFAATGQSCVAGSRLIVEKSVKDRFLQILKAKAETIRIGSPLEMSTEVGPLATERQSNHVKTLVARSLAAGAKLVTGGTAPEGAGFYYRPTILDCDGSASPSLENEFFGPVLSVLSFETEAEALHLANDSRFGLAAGVFTQNLTRAHRLMKGIRAGIVWVNTYRAVSPVAPFGGFGLSGHGREGGLEAALDYTRSKTVWLRTSDDPIPDPFVMR

SEQ ID NO: 5325 - protein, 378 aa, Thiomicrospira crunogena XCL-2
MTHTALLALEDGTLFWGISLGAEGETVGEVVFNTSLTGYQEILTDPSYYKQIVTLTYPHIGNVGVNEEDEESPSIMAQGLIVRDCPPLMSNFRAQKSLPDYLKEQGVVAISDIDTRKLTRILRDKGAQSGVIVAGENIDADAAIAKAKTFAGLKGMDLAKEVTTSETYVWTEGTWSLENGHTDCASKSEYHVVAFDYGIKRNILRMLADRGCKLTVVPAKTPASEVLAMKPDGIFLSNGPGDPEPCDYAIQAIQEVLRTDIPVFGICLGHQLLALASGAKTVKMKFGHHGGNHPVQDLKTKKVMITAQNHGFAVDADSLPDCLEATHSSLFDGSSQGIQHKDKAAFSFQGHPEASPGPHDVAPLFDQFIENIKKYKQA

SEQ ID NO: 5326 - protein, 477 aa, Frankia sp. EAN1pec
MTETDLSTSDDRTSDGRTSNDRTPGLAGPEHASGPRPARVAELLAAGPGSEVLLAGAVRRTVLPGGLRVVTEKVPGVRSVAIGIWVGVGSRDETPLTGGCSHYLEHLLFKGTPSRDALSISASIEAVGGDLNAFTAKEYTCYYARVLDVDMDLAIDVVCDMVANSLVTADDVEAERGVILEEIAMHEDDPGDVVHDVFADAVLGSSVLGRPVLGTVDTIEALGRETVFDYYRERYAPPALVVSIAGNIEHDHALDRVVAAFADRLTGPARHQEVRRGEYPFPPPPGIVVTNRPTEQAHVVLGTAGLSRHDPRRYALGVLSTALGGGMSSRLFQEVREKRGLAYSVYSFDNQFADAGLFGVYAGCTPGRADEVLEICREQVHRIAEHGITAEELERARGQNRGGLVLNLEDTGSRMSRLGKSELVHGELLSVDEVLARVEAVTLDDVRAVAGELVDQPWALGVIGPFEDHDFSAAVAR

SEQ ID NO: 5327 - protein, 398 aa, Oceanobacillus iheyensis HTE831
MTITSTNIIEETNYYGAHNYHPLPIVVSEANGVWVKDPEGNSYMDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSEKNILFIADEVQTGFARTGKMFACEWENVEPDIYVMGKALGGGVFPVSAIAANNEIMDVFTPGSHGSTFGGNPLACAVSMAAIDVIEEENLVNKSLESGKYFADKLRAVNFEGIKEVRARGLFIGMEFHQPVREICEKLKDKGILCKETHVNTIRFAPPLVITKDEMDWAIQRIEEVLTN

SEQ ID NO: 5328 - protein, 296 aa, Brassica rapa subsp. rapa
QLTTNFYSTSCPNLLSTVKSGVKSAVSSQPRMGASILRLFFHDCFVNGCDGSILLDDTSSFTGEQNAGPNRNSARGFTVINDIKSAVEKACPGVVSCADILAIAARDSVVQLGGPNWNVKVGRRDAKTASQAAANSNIPAPSMSLSQLISSFSAVGLSTRDMVALSGAHTIGQSRCVNFRARVYNETNINAAFATLRQRSCPRAAGSGDANLAPLDINSATSFDNSYFKNLMAQRGLLHSDQVLFNGGSTDSIVRGYSNSPSSFNSDFAAAMIKMGDISPLTGSSGEIRKVCGKTN

SEQ ID NO: 5329 - protein, 334 aa, Triticum aestivum
HYRTSLYKKAGWYRSGIPGISSTHASALISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKSTEMRVAELKSKKN

SEQ ID NO: 5330 - protein, 208 aa, Oryza sativa Japonica Group
MLSFARTSFGGQTAHLPKSKSSGYKHFVSISSGLPCFLAIRRQSPGYSSVHTASFSSQHNQLSTDRSGTVMAERELIDKDKLILRGLQFHGFHGVKQEEKTLGQKFVVDVDAWMDLSAAGETDSISDTVSYTDIYRIAKDVVEGPSRNLLEAVAHRIASATLLKFPQISAVRVKVGKPHVAVQGIVDYLGVEILRYRKDVGGDRQELH

SEQ ID NO: 5331 - protein, 365 aa, Bacillus anthracis str. Ames
MKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNIATGKVAITSQNHGYAVEEESVENTELEITHVALNDGTVEGLRHKKFPAFTVQYHPEASAGPEDANDLFEDFLTMIENFKKEGEELCQNA

SEQ ID NO: 5332 - protein, 127 aa, Mannheimia succiniciproducens MBEL55E
MAYSEKVIDHYENPRNVGSFDKKSSDVGTGMVGAPACGDVMQLQIKVNEEGIIEDAKFKTYGCGSAIASSSLITEWVKGKSLDEAGAIKNSQIAEELELPPVKVHCSILAEDAIKAAIADYKSKKGA

SEQ ID NO: 5333 - protein, 166 aa, Magnaporthe grisea 70-15
MASPAFEVNRPTETEVLLSRLLEKTIRRSNALDTESLCLVAGQKCWSIRVDVHAESHDGNLIDASCLAVVAALRHFRKPDTSIEGEVVTVYTPAEREPVPLSWLHSPFCVTFSFFGDLGDMFVVDANWLEEQVHRKARRDRRRSRHTAAVQRGGVGQGQGFLQAPR

SEQ ID NO: 5334 - protein, 492 aa, Delftia sp. AN3
MMKSLRQDWLSNVRNDLLAGIVVALALIPEAIAFSIIAGVDPKVGLYASFSIAAIIAFAGGRPGMVSGATGAMALLMVTLVKDHGLQYLLAATVLTGVLQILAGWLKLGALMRFVSRSVITGFVNALAILIFMAQLPELTNVTWHVYAMTAAGLGIIYGFPYITKAVPSPLVAIVVLTAVAIFLGLDIRTVGDMGKLPDSLPVFLLPDVPLNLETLKIIFPVSATLAVVGLLESMMTASIVDDLTDSNSNKNRECVGQGVANIASGFLGGMAGCAMIGQSVINVKSGGRGRLSTLAAGVFLLLMVVFIGDWVARIPMAALVAVMIMVSIGTFNWASIRNLREHPKSSSVVMLATVVVTVGTHDLAKGVLVGVLLSGFFFAHKVGQILRVTSRTEDEGRVRTYTITGQVFFASSERFINAFDYKEVIEKVRIDVSRAHFWDITAVSALDKVVIKFRREATEVEVIGLNEASATLVDKFAVHDKDGADDMLMGH

SEQ ID NO: 5335 - protein, 286 aa, Streptococcus suis 89/1591
MITIKSQREIDAMNRAGDVLAGIHIGLREIIKPGVDMWEVEEYVRKTCKEKNVLPLQIGVDGELMDYPYATCCGLNDEVAHAFPRHYKLKEGDLLKVDMVLSEPLDKAVVDVSKLNFNDVKAMKKITQTYRGGCADSCWAYAVGQVSEEVQNLMDVTKECLYRGIEQAVVGNRIGDIGAAIQEYAEGLGYGVVRDLVGHGVGPTFHEEPMVPHYGTKGRGLRLREGMVLTIEPMINTGTWEIDTDMKTGWAHKTLDGGLSCQYEHQFVITKDGPVILTSQGEEGTY

SEQ ID NO: 5336 - protein, 723 aa, Oryza sativa Japonica Group
MANSIAIFRRSTTYGPLQKAALTTICCMLAVAAGPNPQECLPFSCGDLGNISYPFRLQGDSRQCVSTPRPWYNLSCSRGKATIHINTRKYYVISINYTRENFLVVDATMQLDDDTNGTSCPLPRSDHLPYMIYWSDLSSIDSYGFKDLVTASDTWACFVNCSRAITNDSRYKPVTCLSGNNSFPYVYVYIYDDYGCCPVKRLQPSCRYLGMIPFDYVYQPGSYDDDIMSNVLQSASYRDIVGFIRKGFRVNFPLYNNDQRAPTIVERCLNNSMSYFKDQISGASIPHLTRALFWTEIHFVQCVSTNHDYTIKLFSVVITIVSAIDVTKLLFVLCRFVLAPLVVLTFLAHKYWKTRIAIDAVEKFLRMQEMLGPKRYAYTDIIAITSHFRDKLGQGGYGSVYKGVLLPGDIHVAIKMLDGKSDCNGEDFISEVATIGRIHHINVVRLVGFCSEEMRRALVYEYMPRGSLNRYIFSSERSFSWDKLNEIALGIARGINYLHQGCEMQILHFDIKPDNILLDDNFIPKVADFGLAKLYPREKSFVSDRALRGTFGYMAPEMACRSFGVISSKSDVYSFGMLLLEMAGGRKNADPNANSNSSRAYYPAWVYDQLIVDQQVDEISSAIDMHEKERKLWLVVFWCIQMKSYDRPTMSEVIEMLEGDVDALQVPPRPFFCDGDSTPPPPVPVMDSICLYSSELTAISEEEDVDGITQLDSSCLLGYERSI

SEQ ID NO: 5337 - protein, 326 aa, Geobacillus kaustophilus HTA426
MTTDLFTALKAKVTGTGRKIVFPEGTDDRILTAASRLATEQVLRPIVLGDEQAIRVKAAALGLPLEGVEIVNPRRYGGFDELVSAFVERRKGKVTEETARELLFDENYFGTMLVYTGAADGLVSGAAHSTADTVRPALQIIKTKPGVRKTSGVFIMVRGDEKYVFADCAINIAPNSQDLAEIAVESARTAKMFGLKPRVALLSFSTKGSASSPETEKVVEAVRLAKEMAPDLILDGEFQFDAAFVPEVAKKKAPDSVIQGDANVFIFPSLEAGNIGYKIAQRLGGFEAVGPILQGLNKPVNDLSRGCSAEDAYKLALITAAQSLGE

SEQ ID NO: 5338 - protein, 248 aa, Chlamydomonas reinhardtii
MKLNIAYPATGCQKKLEVDDEAKLRAFYDRRVAAEVDGEVLGEEFKGYVLKIAGGQDKQGFAMKQGVLTNARVRLLMTPGDQGFRGYGRRKGERRRKSVRGCIVSPDLAVLNLVIVKKGEQELPGLTDEEKPRIRGPKRASKIRKMFNLGKVDDVRKYVTIYSRERTDKNGKKHRKCPKIQRLVTPAALQRKRARKSLKKRQQEKNKTDAAEYHKLLMQRLKEQRERRSESLAKKRAMRVASQASKEA

SEQ ID NO: 5339 - protein, 487 aa, Oryza sativa Japonica Group
MRGFVGAAVLLVCNLATASAWKDKDFFSACPAKQCGKVEIRYPFRFEPSNTSSSCGLPCMKLTCSDRQETILDIKNYLGRPYKVTAIDYKRATLTIVPLADDSSLPPTPGCPLPNLISEGALDHRCEPYAMWLLKSINIEFPFRRAVHVSESLQTRYNEEIHLKVEMFLKTYGTSKPTRYSFSEIKKIARRFKIKLGQGGFGSVYRGELPNGVPVAVKMLENSKGEGEEFINEVSTIGRIHHANIVRLLGFCSEGTRRALIYEFMPNESLEKYIFSDGYNILQELLVPNKMLDIALGIARGMEYLHQGCNQRILHFDIKPHNILLDYNFSPKISDFGLAKLCARDQSIVTLTAARGTMGYIAPELYSRNFGEISYKSDVYSFGMLVLEMVSGRRNSDPSVESQNVVYFPEWIYEQVNSGQDLALGREMTQEEKETVRQLAIVALWCIQWNPKNRPSMTKVVNMLTGRLQNLQVPPKPFLSADSYPVL

SEQ ID NO: 5340 - protein, 123 aa, Geobacillus kaustophilus HTA426
MKTFILLGALNAFLAVALGAFGAHGLEGKIPDRYLEIWKTAVQYQMFHALGLLVVGLLAGKAPNVGLIGAAGWVMFAGIVLFSGSLYVLSVTQIKPLGAITPFGGVAFLVAWVMIGYAALKWL

SEQ ID NO: 5341 - protein, 680 aa, Oryza sativa Japonica Group
MAKSLLVSSLLAVVAAVVVGAGPNPQYCPPSSCGHLGNISYPFRLQGDSRDCVATPRPWYNLSCSSGRAAIQINTGTYYVSSINYTGEVFSVVDATLQDDDTNSSCPLPRSDHLPFPDWYRDYRPADSYGFFDLATASGTWACFVNCSRAITDIMPWYKPVTCLLPNNSFVFVSFVNCAVGELQPSCRYLAMIPFESRHISDNSSQLQNASYTDIIGFIRKGFSVRFPYRPDQYQSPRMSARECLKDSNRYFKERISHPSILNLTRAIFWSETNSEVDCGYEVAPQKDRIFLGTIVSAIDIIKFHFVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGTDELQVPPRPFFCDDEQLPGVESYNMPSDLTAISEEHEDDDDDSICLFESYQ

SEQ ID NO: 5342 - protein, 333 aa, Mesostigma viride
GINGFGRIGRNFLRCWHGRENSPLEVVAINDSGGVKQASHLLKYDSMLGTFAADVKAVSDDTISVDGKLIKIVSSRDPLSLPWKEMGIDIVIEGTGVFIDEAGAGKHITAGAKKVLITAPGKGPNIPTYVVGVNADQYKSTDTIVSNASCTTNCLAPFAKVLDEKFGIIKGTMTTTHSYTGDQRLLDASHRDLRRARAAALNIVPTSTGAAKAVALVLPKLKGKLNGIALRVPTPNVSVVDLVIQVEKKTFAEEVNAALREAANGPMKGVLAVCDEPLVSVDFKCSDVSSTIDASLTMVMGDDMVKVVAWYDNEWGYSQRVVDLAHIMAKEMK

SEQ ID NO: 5343 - protein, 288 aa, Chlamydomonas reinhardtii
MPSTLEDLAGLAKKNSPDLLPTLAYAVLWLIVRWIFYKLLRSYFKTLPATSVLKNVGMQEKVLEESFAIIGALLCATLGLSSLPPADAPASDNSHAIPSRRSLQSSASWHSGKAIEARMGMEDNLQMHLHHFSTITLLLISYLLNLHRAGVLVLSLLNISNPFLHVAKVVHYVEAKGDTLAFLAFAVAFFLSRIVAYPVVVLHATLIESWQVHPAYLDRARHLPVYLLANGLLLLLMVMQVQWMAGIVRLLLKAVGGSKAEFKKEGASVDYAKTKTKQGKAEHAYASP

SEQ ID NO: 5344 - protein, 296 aa, Arabidopsis thaliana
MVTATASTPFSLSSSVVFTRRRNFKRFPVCASLSPEVSPLLRAAHHTVDNYVKSGMIIGLGSGEASDFAIRYLGQQLGSGSLHNVVGVPMSARSASEAAKYGIPLEYYRDGVQIDFAFHDADAVEENTLIAVIGRRRSSQEDDYILKQKSIVKVADEAVFMIKEEQYKAGLEGSIPVLVQSLNWLAIAEEIDDLYLGDAEVWRRASVENEGPLGGDFPIVTSDGHNILDVIFTTPIRSLADLATSLDKIDGVVDHGLIIKTRCTVVIAEETVVRSVTLQTSALEGGVRTYGQTLQK

SEQ ID NO: 5345 - protein, 641 aa, Oryza sativa Japonica Group
MHTENRMRGFLAAALLVFGILLNLDTAASAWEDKDFFSYCPPSRCSEHGPEVRFPFQLESNNTTQSSCGLPFMKLSCSGQDTILDNKCLGRPYKVTAIDYKHPVLTAVPLADEGNSSSPCPLLKSISIRPSLKADNGYHYMMYQKPSETYVEHYYAALVSCSTEFAPASIPDATDDIVGPISCLSNQTHLSYLVEVHASMSLLTLDCEVISDGPIPIPVFHYSIYDLPTFRGSAERILNFSDTTVWWYRYDCPQCEQLGGRCAFSSQRNQTFCMRRGSHVKVIAATSSVAAFVVLLLMVATALYLSLKTRYNEEIHLKVEMFLKTYGTSKPTRYTFSEVKKIARRFKVKVGQGGFGSVYRGELPNGVPVAVKMLENSEGEGDEFINEVATIGRIHHANIVRLLGFCSEGTRRALIYEYMPNDSLEKYVFSHDSDTSQEVLVPSKMLDIAIGIARGMEYLHQGCNQRILHFDIKPNNILLDYNFSPKISDFGLAKLCARDQSIVTLTAARGTMGYIAPELYSRNFGEISYKSDVYSFGMLVLEMVSGRRNSDPSVESQNVVYFPEWIYEQVNSGQDLALGREMTQEEKETVRQLAIVALWCIQWNPKNRPSMTKVVNMLTGRLQNLQVPPKPFLSTDSYPVL

SEQ ID NO: 5346 - protein, 321 aa, Brassica oleracea
MEKNIKFPVVDLSKLNGEERDQTMALVDDACQNWGFFELLNHGIPYDLMDNIERMTKEHYKKFMEQKFKEMLRSKNLDTLETEVENVDWESTFFLHHLPQTNLYDIPDMSDEYRAAMKDFGKRLENLAEELLDLLCENLGLEKGYLKKVFSGTKGPTFGTKVSNYPPCPKPEMIKGLRAHTDAGGLILLFQDDKVSGLQLLKDGVWVDVPPLKHSIVINLGDQLEVITNGKYKSIMHRVMTQKEGNRMSIASFYNPGSDAEISPAPSLVEKDSDEYPSFVFDDYMKLYAGVKFQPKEPRFEAMKNVAATTDLNPVATVETF

SEQ ID NO: 5347 - protein, 148 aa, Solanum tuberosum
MASKRILKELKDLQKDPPTSCSAGPVAEDMFHWQATLIGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 5348 - protein, 199 aa, Rickettsiella grylli
MSSSAFPLTLFLKSVAQLDQLPPDKGAEIAFIGRSNSGKSSAINAITGKKGLAKISKTPGRTQLLNFFQLNENLRLVDLPGYGFAKVSDNRKIDWEKTITHYLKMRKSLKGLIMTMDIRHPLNDRDEVLLAFVSHYHIPTYILLTKADKLTRAQAIHTLRSIRQQLTILNKTCELQIFSAIQSIGLGNARHKILDWLSK

SEQ ID NO: 5349 - protein, 336 aa, Arabidopsis thaliana
MDCGMENCNGGISNGDVLGKHEKLIIDTDPGIDDSMAILMAFQTPELEILGLTTVFGNVSTQDATRNALLLCEIAGFPDVPVAEGSSEPLKGGIPRVADFVHGKNGLGDVSLPPPSRKKSEKSAAEFLDEKVEEYPGEVTILALGPLTNLALAIKRDSSFASKVKKIVILGGAFFSLGNVNPAAEANIYGDPEAADVVFTSGADITVVGINITTQLKLSDDDLLELGNCKGKHSKLISDMCKFYRDWHVKSDGVYGVYLHDPVSFVAVVRPDLFTYKKGVVRVETQGICVGHTLMDQGLKRWNGSNPWVGYSPISVAWTVDVEGVLEYVKAKLMKP

SEQ ID NO: 5350 - protein, 321 aa, Arabidopsis thaliana
MKKIQIGAVALLVFLSVASLFEIGLASPNTVPAFLWSPHLQSANGELDEAVNYQVMSAKDLVGSVFTQGGWSNFLCSEKKLEQPVDVALVFIGRELLSSDVSSKRNSDPALVNTLNNLFTASNFSLAFPYIAAPEEERMENLLLSGLKEACPNNVGVSNIVFSDSCFVEDGTIQKLSDLQSFKDHLLARRETRKEGETDLVVLCSEGSESNSQAGQSHSERESFLELVSSVEQSGSKYTALYVSDPYWYTSYKTLQRFLAETAKGNSTPEIATGCDELCKFKSSLLEGILVGIVFLLILISGLCCMAGIDTPTRFETPQDS

SEQ ID NO: 5351 - protein, 663 aa, Zea mays
  misc_feature (258)..(258): Xaa can be any naturally occurring amino acid
  misc_feature (263)..(263): Xaa can be any naturally occurring amino acid
KRCGSPIRSPDPPACAPTRASFHRSSSFYRRLALAARWSGGLSLQPILLDSFYCLAAGSMDKQEPVANGEQTIGLAEKPKELPVASKDEKATVPPILVDSNAFNLPSEGQTQAGTSNMDGGHNGAHNFYASQAQPFYYQGSGSENPTQAWDTYPPYMSVEGLEVGPPVVYNEDPSLMFHGGYGYDPYYSPIATPVPNAVSGGGQLYSPQQFFSAPYYQQSVPPDMQYLSSPTPISQGDTIMPIDPTQGAFIADTLSPXSFLFXPRPEWFRSSERTGSFPSPAASPQPSRGVPGSYDQNNFPMASRMSSPHQKPFYGLRSTTDSYGRGFSHGGMFPQASNYGGSVTSFGLNGRSLISIEKGRRRGRGNALICSCNGPLDFLNEQSRGPRATKPKKQPEVDSKDEVPTTGVGRELYNKPDFVMEYTNARFFIIKSYSEDNVHKSVKYGVWASTTNGNKKLDSAYREAKEKGEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKNHDDDASILDDFEFYEEREKALQENKARLHQQHLPSSIVIEPKKPLTAPSDLVGHITKSFAEAVRLGEAKTVSHLTEKVSGGDPSIPVKHVEVKQSGLS

SEQ ID NO: 5352 - protein, 275 aa, Arabidopsis thaliana
MGIYLSTPKTDKFSEDGENHKLRYGLSSMQGWRASMEDAHAAILDLDDNTSFLGVYDGHGGKVVSKFCAKYLHQQVLSDEAYAAGDVGTSLQKAFFRMDEMMQGQRGWRELAVLGDKINKFSGMIEGLIWSPRSGDSANKPDAWAFEEGPHSDFAGPNSGSTACVAVVRDKQLFVANAGDSRCVISRKNQAYNLSRDHKPDLEAEKERILKAGGFIHAGRVNGSLNLSRAIGDMEFKQNKFLPSEKQIVTASPDVNTVELCDDDDFLVLACDGIW

SEQ ID NO: 5353 - protein, 325 aa, Burkholderia sp. 383
MDVRQGFVDCVGRTPLIRLTKLSAETGCEILGKAEFMNPGGSVKDRAALYIIRDAERRGVLKPGGTVVEGTAGNTGIGLAHICAARGYRCVIVIPDTQSPDKLAILRTLGAEVRPVPAAPYRDPNNYQKIAGRLADELDNAVWANQFDNVVNRQAHYETTGPEIWRDTAGTIDAFVCATGTGGTLAGVSRYLKEQNPDVRIVLADPCGSGLYGYVKTGDLGAEGSSITEGIGSTRVTMNLAGTPIDDAVRIDDQQCVTMVYRLLREEGLYVGGSSGINVAAAVWLARRMGPGHTIVTLLCDRGDIYRARLFNREWLREKGLDPGD

SEQ ID NO: 5354 - protein, 490 aa, Sinorhizobium meliloti 1021
MTISETLLVKLKDPSLAVDKGLIGAEWLDRSDSGKTFDVSNPATGEVIAILPDMSRSETARAIDAAHAAQRAWAEKTGKERAAVLRNLYDLVVANADDLATILTMEMGKPLTEAKGEILYGASYVEWFGEEAKRVYGDTIPGHQPDKRIIVLKQPIGVVAAITPWNFPNAMLARKLAPAAAAGCAVVSKPAAETPLSALALALLAERAGLPAGVFNVILSTDSAEVGKEMCANDKVRKLTFTGSTNVGKILMRQGADQIMKLGLELGGNAPFIVFDDADLDAAVEGAMVAKYRNNGQTCVCANRIFVQAGIYDAFAARLTAKVSEMTIGDGFEPDVDAGPLISEKALAKVEEHIRDAVTKGADLVLGGNARGGLFFEPTVLTGATMDMKIAGEETFGPVAPLFKFETENEVVSMANKTEFGLASYFYSKDVSKVFRVAEALEYGMVGINTGLISTEVAPFGGVKQSGQGREGSKYGIDDYVETKYLCLSI

SEQ ID NO: 5355 - protein, 181 aa, Physcomitrella patens subsp. patens
MASIVAASTVVAPAAFAAASSGVSTSESTSVKAFSGLKSATLFSSQSQQLSSVQNGSRVNCMQVWNPIGMTKFETFSYLPPLSDDAIAKQVEYMIQQKLIPCLEFDNSKGVTRENNSSPGYYDGRYWTMWKLPMFGCQDSAQVLREIEECKKTFPGCFVRVLGFDNVKQVQICGFLVARPN

SEQ ID NO: 5356 - protein, 937 aa, Streptomyces coelicolor A3(2)
MRTRWLPRGRGLGSASARLRSAVAGRGTVRAELGYGAFLSYSGERDRRWLPQLRHAIEKQSRPWYKPPHIRVFLDKTGVSIGPELWGKIEAGLARSDWLVVLASPEARASVWVDREIAWWLEHKSVHTILLVVTAGQLVWDEERGDWDPERSTALPARLAGKFERQPVWKSVDPRPDGDAVFSTDDAGFSPDVDGVAFGVASVVRGLSEDELRSEGLRDTRRNLRTARIVATALGCLLLVASTLSVVAVLSRAEATRQRDQAVVQQLITQSSLLAERDPFAARLKALAAWRIDPSPETRFAVLDAAVNPASGVLSHSVPVDSVAFSPDGRTVASGGSDGVVRIWRTGTQRTAGRPLIGHHQGITSIAFAPDGRTLASSGFDGTVRLWDLADRTQIGAPFNAGAGSVRSVAFGRDGRTLVTVDEADSGTVRVWDVATHRQTGHPLDGPGPVLGTNADGSRVGSSTSQGGIRLWDTASGAPAGGALKGGDGVVTALSFSSDGKTFATADLVGNLRLWDIEARAPVGEPIASPATSTGVRAITFSPDGAMLAAAYEGGGVRLWDLRRRAQVGGPLLAHTSTVESVAFSPDGSVLASASADTTVRLWDVRTLRQAGAPIDTGGKGAAALSPDGRSLAVVDSEQAVRLWDVVARRRVGEPLVRGVYSFSPSLAFRADGAVLAIGADGLRLREVATRRPVGEPLLGTGDVGALSFGPDGRTLVSGGPDSVHVWDLTARPPTGTALGPRSVGVALSPDGRSLATTTQDDTVVFWDMATRRRIGETPGDHTAQITAVAWSPDGTTLATAGRDDTVRLWDAATRERIGAPLRGHHGGLTSVVFSPDGATLATGGNDHTVRLWDVATERPIGAPLEGHGAGVTGVAFTPGGDTLVSWAQDGTARLWNVAATVDPVRSLCAWADGAFTTDRWHEDVPAGPASRTLCRK

SEQ ID NO: 5357 - protein, 163 aa, Dianthus caryophyllus
MAEVEYRCFVGGLSWGTDDRSLAEAFNKFGEVTDSKIINDRETGRSRGFGFVTFANEQSMRDAIDEMNGKELDGRSITVNEAQSRGSGGGGGGGGYRSGGGGGGGYGGGGGGYGGRREGGGGGGYGGGSGGGYGGRREGGGGGGYGGGGGGGYRGNSDGNWRN

SEQ ID NO: 5358 - protein, 219 aa, Physcomitrella patens subsp. patens
MTTNGAAPAVAVKLNNSAVHQPAPLNHRILSTMDRRSVAAHPWHDLEIGSDAPEIFNVVIEINKGSKVKYELDKKSGLMKVDRILYSSVVYPHNYGFIPRTLCEDEDPIDVLVIMQEPVLPGTFVRARAIGLMPMIDQGEKDDKIIAVCADDPEYRHFKDINEFPPHRLAEIRRFFEDYKKNENKDVIVDNVFGHEAALQAISHSMDLYAAYIVESLRQ

SEQ ID NO: 5359 - protein, 271 aa, Mannheimia succiniciproducens MBEL55E
MEIIMNPMLNIAIRAARKAGNVIAKSYERRDDIQTTLKSANDYVTNVDKAAEQAIIDVIRTSYPDHTIITEESGALEGKDSDIQWVIDPLDGTTNFVKGLPHFSVSIAIRVKGRTEVGVVYDPIRNELFTAVRGEGAKLNDLRLRVDAKRELEGAILATGFPFKQARHMPLHFAVMNSLIESCADFRRTGSAALDLCYVAANRVDGFFEIGLKPWDCAAGDLIVREAGGLVTDYNGGHSYLTSGHIVAASARVVKEILNRLQPLLGDEFKK

SEQ ID NO: 5360 - protein, 743 aa, Gibberella zeae PH-1
MVAETVVPERLPADSLQPGYDEKEPHNIDMDLKSEADSEDERIIDLFSSFPPAKGVEHEPNPLTARAVIVGIVLGSLVNASNVYLGLKTGFTFPATMFGAIFGYGFILMLTKSLPNVPLLGGKFGPQENSIVQAAATGAGGMSGVFVAGLPAMYRLDLLSDDPKKDFGRILTITLVCAFFGLFAAVPLRRFFIINVARELNLVFPTPTATAMTIRSMHAVGSGANDAIRKIKSLGIAFIIALLIICVGQYADGILHNWHIFTWFYAWSGYTASGLLEPENWGWYIQLTPAFFGSGILVGLNAAFSWWGGTVVAWGLIGPLLVHYGECIGIEIGEGKWEGLTRFNVMTGVDKPGFVASPRYWMLWPGVMVLMVYSLIEFFLHGKVVVDGFKFALRESARSINNRLVARGTHNSWFAGQAAKADADGGVEDFASAQEQVPTWVWVTGTIAALILAMIVTEVQFHMNAGLALLACILGVIFAFMSIYGGAVTDCAPLTASAKASQLVYGGITKGNFAIKDAQRINLIAGNIASGTADVANSLVSDFRVGFLLKTPPKLQFYAQAMGTVVSVFLAPGIFVLFMSAYPCVYRPSDDPADICPFAAPSVAAWQAVATAVTMPSIPIPKSSAYFSIAMGILCAVQAIVKHFWLVGSREKYRDWLPNWMSVGVAWVLGPDSGYANAILFGSITAWWWRKWFNNHFEMYAFAIAAGLIAGEGFGGVINAALELGKVSGSFKGTEVALPGADW

SEQ ID NO: 5361 - protein, 234 aa, Frankia sp. EAN1pec
MTGTGDLVAPKPPVLNIANILTIIRLALVPVFVAFLFAGPDTDGWRYAAFGAYAVAAITDQIDGSIARRRGLVTDFGILVDPIADKALTGAALVSLSILSELPWAVTVVVAVREIGVTLLRLWVIRYGVIAASRGGKAKTLLLNISLGLYVLPLEGVAATGRAVILACGVVVAAVTGADYVYRALALRRRATAAARPGGAPAVPTPDVPNLGGPAMGEDQEAVTGPGRGEIDAR

SEQ ID NO: 5362 - protein, 706 aa, Oryza sativa Japonica Group
MAKSNASRASATRRKFYFLQKSLLVSSLLAVVAADVVGAGPNQQCFPSSCGDLGNISYPFRLASDSRPCVGTLRPWYNLSCSSGRATIQINTRTYYVTSINYTGEIFSVVDATLQDDDTNGTSCPLPRSDHLPYIDYWPPYLGESSTDSYGFVYLATASDTWACFVNCSRARTDTMPWYRPVTCLLPNNSFVFVSFDDCAVGELQPSCRYLAMIPVDRWNLPDNSSQLQNASYTDIIGFIRKGFSVRFPYRPDQYQSPRMSARECLKDSNRYFKERISHPSILNLTRAIFWSETNSEVDCGYEVAPQKDRIFLGTIVSAIDIIKFHFVLFRLVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGSDELQVPPRPFFCDDEQFPGVESYNMPSDLTAISEEHEDDDDESICLFESYQ

SEQ ID NO: 5363 - protein, 272 aa, Shewanella sp. MR-4
MTEAYQNRFGGIGRLYGQKALAKFAASHVVVIGIGGVGTWAAEALARSGIGQITLIDLDDICVTNTNRQIHALTSTIGESKVAVMAQRIRSINPDCQVNEVEDFITVDNLGEYLLGSKAGGNIDYVVDCIDAVKQKAALIAWCKRQKIKIVTVGGAGGQTDPTQIQLTDLAKTYQDPLLAKVRNILRREYNFSKNVQRRFAVDAVFSSEQLVYPQADGSVCSSKATADGSMRMDCASGFGAVTMVTGTFGFVAASRVLARLAQLANEPAASE

SEQ ID NO: 5364 - protein, 342 aa, Oryza sativa Japonica Group
MVISFPSFFFVFLLALVVAVPAAFEDGGSFLGGEGGDEHQPMLAVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 5365 - protein, 341 aa, Aeromonas hydrophila
MTILVTGGAGYIGSHTLVELLNIGQQVVVLDNLSNSSPESLKRVERITGKPVIFVEGDVLDRVCLQQLFAAHQIESVIHFAGLKAVGESSQIPLTYYQNNITGTLVLCEEMANAGVFRLVFSSSATVYGDPASVPLREDFPTSATNPYGRSKLMVEEILRDLAKSDPRWAIVLLRYFNPVGAHESGLIGEDPNGIPNNLLPYISQVGVGKLKELGVFGNDYPTPDGTGVRDYIHVVDLAIGHLRALARIASDTGVFTYNLGTGQGYSVLEMIKAFEAASGRPIPYQIKPRRPGDIAECWAEPHKARAELGWQAERGLERMMVDTWRWQSQNPNGYGSTAKP

SEQ ID NO: 5366 - protein, 296 aa, Solanum tuberosum
MNLNSVKVPKMPGGGATSALIKFGVIAGLGVYGVANSLYNVEGGHRAIVFNRIGGVKNKVYPEGTHFMIPWFERPVIYDVRARPHLVESTSGSRDLQMVKIGLRVLTRPVSDQLPTVYRSLGENYNERVLPSIIHETLKAVVAQYNASQLITQRENVSREIRKILTERAANFNIALDDVSITSLTFGKEFTAAIEAKQVAAQEAERAKFVVEKAEQDKRSAVIRAQGEAKSAQLIGQAIANNPAFITLRKIEAAREIAQTISHAANKVYLSAMICCLTFRTSTWTLQESDLDSATD

SEQ ID NO: 5367 - protein, 424 aa, Ustilago maydis 521
MSAHPSNPHRTPYNVLNQTFLIDNAYAITKDLGQGAYGCVAAATHKGTGESVAIKKITNVFTKKILTKRALREIKLLRHFRGHKNITCLYDMDIIDPVGFNEVYLYEELMEADLHAIIRSGQPLSDAHFQSFIYQTLCGLKYIHSASVLHRDLKPGNLLICDFGLARGFETDPELAKQVGAGFMTEYVATRWYRAPEIMLSFQNYTTAIDIWSLLGGRPIFKGRDYVDQLNQILHYLGTPSEETLRRVGSPRAQDYIRSLPYQPRIPFDRLYPQANPQALNLLERMLEFDPAKRISCEEALQHPYLSVWHDPADEPVCPRKFDFGFESVDEVQGMKTLILEEVRSFRTEVRRQARLMQQPKRQESLPIPSREDIQRSSPTEEGNPAYSVLGASAGIIQGATNSEHASGVLNDACSKDVGLGSLG

SEQ ID NO: 5368 - protein, 129 aa, uncultured bacterium
MVQHQGGCHCGRVRFEVLASAVITVSQCNCSICSKSGYLAMIVPRDRFTLKSGKENLAEYTFNTGTAKHLFCKFCGIKSFYIPRSHPDGVSINARCLDAETVEDINIKQFDGQNWERYYPKGRAEGYSN

SEQ ID NO: 5369 - protein, 383 aa, Arabidopsis thaliana
MEESRESPAEHGYYMPAEWDSHAQTWIGWPERQDNWRHNALPAQRVFADVAKAISKFEPVTVCASPAQWENARKQLPEDIRVVEMSMNDSWFRDSGPTFIVRKRPVKLSSLNRNIAGIDWNFNAWGGANDGCYNDWSHDLLVSRKILALERIPRFQHSMILEGGSIHVDGEGTCLVTEECLLNKNRNPHMSKEQIEEELKKYLGVQSFIWLPRGLYGDEDTNGHIDNMCCFARPGVVLLSWTDDETDPQYERSVEALSVLSNSIDARGRKIQVIKLYIPEPLYMTEEESSGITQDGEAIPRLAGTRLAASYVNFYIANGGIIAPQFGDPIRDKEAIRVLSDTFPHHSVVGIENAREIVLAGGNIHCITQQQPAEPTSVAENGH

SEQ ID NO: 5370 - protein, 160 aa, Zea mays
MMASVPSRVALSAASRLPNLHAVAGDRSFIYKRRCPSLSIPMALSAAAPGKGGGVLDRPVEKITPGRQSEFDVKKSRKMTPPFRVILHNDNHNRREYVVQVLMKVIPGMTVDNALNIMQEAHVNGLSVVIVCSQSEAEEHCTSLRGNGLRSSIEPASGGC

SEQ ID NO: 5371 - protein, 461 aa, Polaromonas sp. JS666
MQVESFDAIVIGAGQAGPALAERCTKEGLRTAVIERAHFGGTCVNVGCIPTKTLVASARAIHMARRGAEFGFSAGDIQVNMQRVKTRKDEIVLKSRNGIHQWMQGLKNAEVIQGDAAFVGPRTVKVGERTLTAPRIFLNVGGRPSVPELAGVHDVPYLDNASIMELTEVPEHLVIVGGSYIGLEFAQMMRRFGARVTVVERSAKLLSREDEDVSDGIRAILEAEGVGFQLEAECLSLAREGSGILVGTVCATESPALIASHVLLAVGRRPNTDGMGLDVAGIELDERGYIIVDDQLRTSAEGVWAMGDCNGRGAFTHTSWNDYEIVAANLFDGDPRRVSDRIPCYALFIDPALGRVGLTEREVRASGRAALVARMPMQRVGRAREAGETQGFMKALVDADTKRLLGAAILGLNGDEVVHALVDIMAADQPYTAISRAMHIHPTVSELIPTLLQQLKPLEAQ

SEQ ID NO: 5372 - protein, 525 aa, Saccharomyces cerevisiae
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPKDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 5373 - protein, 123 aa, Solanum berthaultii
MATSSEEGQVIGCHKVEDWEVQPQKGVETKKLVVVDFTASWCGPCRFIAPILADIAKKMHHVIFLKVDVDELKKVAEDWNVEAMPTFVFIKEGKEVDRVVGANKDGLLQTIEKHGAAPAIVTA

SEQ ID NO: 5374 - protein, 845 aa, Pseudomonas fluorescens Pf-5
MAITQPLQLLAPLSGVLLPLDQVPDPVFSSRVIGDGVCIDPTSQTLCAPLSGVISNLQRSGHAVSITGEQGQQVLMHIGLDTVNLAGKGFTCLVEEGQQVSAGQPLIEFDADYLARHARSLLTLMLVVSGEAVTGLVSGSLLVELGQPVLQIEPACAEEGAKVEGAEAEALFSKPLILGNPQGLHARPAALLAQAAKGFAANICLHRRQDSANAKSLVSIMALQTVQGDVLQVSAAGADAERAIQVLVELLVSGCGEKISPAASSPEPVAARDESQETVLRGVCASPGSAVGQVLQVAERRLQISELAANPQQEREVLERALREAVRGLQQLRDNAPGEAQQEIFRAHQELLDDPSLLQQTEALIVTGKSAAFAWNSAIEVTAELFKGLGSTLLAERAVDLADVGQRVLKLILGVQEHALSLPDQAILIAEQLTPSQTASLDTAKVLGFATVGGGATSHVAILARALGLPAICGLSPRVLSLANGTRVLLDADRGELHTDPDPQRLQQLEALRQQQRLRQRQDLAQAAQPAVTRDGHHLEVTANIASLAEAEQAMSLGGEGVGLLRSEFLYQDRSHAPSPEEQAETYRAIAQALGPERNLVVRTLDVGGDKPLAYVPMDSEANPFLGLRGIRLCLERPELLREQFRAILASAGQARLHIMLPMVSQLAELRQARQLLDDEVRALGLEERPKLGIMIEVPSAALMADRFAPEVDFFSIGTNDLTQYTLAMDRDHPRLASQADSFHPSVLRLIARTVQAAHAHGKWVGVCGALASETLAVPLLLGLGVDELSVSVPLIPAIKARVRELDLSECQALAARIIDLEDAVQVREYLHKQQVAADSLVLEN

SEQ ID NO: 5375 - protein, 68 aa, Zea mays
MTVEGVNPKAYPLADSQLSITILDLVQQATNYKQLKKGANEATKTLNLGISEFIVMAADTEPLEGGPG

SEQ ID NO: 5376 - protein, 298 aa, Escherichia coli
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMVARFNETGRSQVLAKRMPGDLSEYSVIQTKEPMVAEGQVARIVEFIEKPDEPQTLDSDLMAVGRYVLSADIWAELERTQPGAWGRIQLTDAIAELAKKQSVDAMLMTGESYDCGKKMGYMQAFVTYGMRNLKEGTKFRESIKKLLA

SEQ ID NO: 5377 - protein, 219 aa, Synechococcus sp. WH 5701
MTETNEQTRSSDVPSAAVGVPAATEGQQERRGGGNRGGGGGDRRGGGGRRGDNRRGQERDSEWQERVVQIRRVSKTVKGGKKMSFRAIVVVGNERGQVGVGVGKAGDVIGAVRKGVADGKKHLVKVPLTRTSSIPTDGHGVDGAASILMRPAAPGTGVIAGGSIRTVLELAGIKNVLAKRLGSKTPLNNARATIQALQSLRTHKETAKERGISLEQIYS

SEQ ID NO: 5378 - protein, 3515 aa, Angiococcus disciformis
MTPSGDEALQSSIALVGMAGRFPGAPDVESFWRNLVAGVESISFFSEEELRQAGVSEQIRRRPEYVPAKGVLEDLELFDAGFFGYSPREASHLDPQQRLLLECSWEALEDAGLRPDQLPGWVGVYVGAGDTSYRFQLLRGHGDPLSGSKDVAGFFGNYPDFLATRVAYKLNLRGPALGIHTACSTSLVSINMACSALRGFECDMALAGGVSLRLPARSGYLYEEGGVASKDGHCRPFDARATGTVTGDGVGVVVLKRLEDALKARDPIHAVIRGWALNNDGASRAGFTAPSVEGQSEVIALAHAAAGISARDITYVEAHGTGTPLGDPIEVAALTRAFRAHTADTAFCTLGAVKSNIGHLDAAAGVAGVIKTVQALRHRLIPPTLHFERPNPALHLEQSPFFVNTQPLPWESPRGPRLAGVSSFGIGGTNAHTLFEEAPPPPASGPTRPNQVLLLSARSTSALEHIAGRLAAHLRRHPDLELADVAFTLQVGRARFPYRRALTCRTLAEAMERLEAPEPRPPEPLAHEGERPPLVMLFPGQGTPLVGTARALHESEPTFRQAVEQCARLLRQTLGLDVREVLFPSAEQEEQARRLAAQTRVAQPALFTLEYALAQTWLGWGLQPQALAGHSLGELVAACLAGVFSLEDALQLVAARGQLMQGCPPGAMLAVPLPEAELAALLGSELCIAAVNGPRACVASGPLPAVEALTAALESRGVSSRRLETSHAFHSASMEACQGPLTTLLRRMRLQAPRLPCVSGLTGRWLTGEEATEPTYWARQLREPVRFSEALETLWSLKEPVLLEVGPGTTLTALARRHPTRPARTQEVASLPVQPDTAVPCIEEAVGELWQAGLELDWSALHAAPRHRAHLPPYPFERQRYWIEPEAAPQPRAQQPTPASLVPPEQPSREALEDWFYVPTWEQAPATSGGGQPLAGPVLAFMDSSGLAEQVLAALWPADSGALLTRVEPAGHYEQLSEHAFRLRPESEEDWDALFQALQSQGRLPRRILHAWALTAEPGPCTPDGEAVLEQGFFSLLRLARALGRHAPERPVQLEVLSSFVHAVGPREPLEPLKATLLGACAVLPLEYPHVQCRTIDVRPGSEPREVLVRSLAAELAAPMGESPVAWRDGQRYVRRATRQRLEASRPLRSLRERGVYLVAGGLGGIGLVLARALAQRARARLALLTHSPFPPREQWEQWLEEAPAHPEPAWRSEADPSERRRTQHRIRCLLELEQLGAEVQVYTADVAEEAAVRSVVEQVHARWGKIHGVLHAAATFDDGVIQLRTHEQSSRALRTKVRGSMVLHEVLASEGLDWFALCSSLASALGSFGQADYCAANAFQDAYAHHLRRQGFTGALALDWGTWRDTGAAMRLVARTRRGGHEKPPTPLTHPLFDCEQREPGGTHWLGLTLRGGEDWVVDEHRLQGVPTLPGVAYLELARAACAQALGAEAVELAELLLLEPLTVPRGESRQVRVVLQPEGQAHALRVESRSEEARGWNEHARGRVRAVPRLAERIQPELLRAACEHEQPVPGEPQEQGPVHAGARWHGLFQWVRRGPRQALAQLALPEPFHGDLERFELHPALMDMATSFAIPGGVPWLAFGYERVLIHGPLPPQVLSHVSLPEESQAGAQQLRLQVRLLDLEGWERVRIDGYLLRPLKPSDASVEPAAPNVEVAVGTPGLLESLGLRRCTRPAPGPRQVEIEVEAAGLNFLDVLGALGMMPALEAEESVLGRECSGRIAAVGEGVSGLRVGDEVLAVAPGCFRSYVLVDESQVVRRPASLGLAEGAAQMVPFATAYFALHTVGRLRRGERILIHAAAGGLGLAAVQLASRTGAEILATAGSEQKREYLRSLGIAHVLDSRSTSFVSEVRERTGGRGVDVVLNSLAGELLLAGLSVLAPHGRFLELGKRDLYADQQVGLRTLARGQTFAAIDFGPHHPDFRAVLEEVATQLTQGQLEPLPTRLFPARQVAEAFSFMARALHIGRVAVSMQGATALPASMTRGSRPAPVAVPPWEDPRLAGGISSEEGAEAFLRALEQGAPQLIISPQDFSSLLRGLGGSQGVREKERLVTGRAAAAEPQALPPSSLEQLIEQVWRKHLGVERVQPTDSFFQLGGDSLLGIQVAADLRRHLGVELPTATLFSHPTLAALAAALRARQGEAAAPTAPAPALVPDPAARFEPFPLTDVQEAYWVGRRSAFELGGVAAHGYFEIESPGLEVERFIQCWRQLLQRHDMLRMVVLPDGRQQVLEQVPEYTPEVVELRGLSPQEAESRRLQLRERMAHQVLRSDRWPLFELVLCRYEGGVRIHMSMDALMLDAWSSAVLRQDFAQLYHEPGRPLEPLAITFRDYVLAERRLREGEAHERARAYWWARLDTLPPPPELPLVKEPSQLEHARFTHREARLEPHRWARLQERARAHGLTPSAACMAAFAEVLARWSRHPRFTLNLTLFQRLPLHPQVDELVGDFTSLVLLEVEAHAASTFAERASRLQAQLWRDLEHGSVSAVQLIRELVRTGRRSPGAIMPVVFTSILSLDARRGPQGSLSFFEGELVYSISQTPQVWLDHGVHEEEGALVLAWDSVEALFPPGMVDDMFHAYQRLLGALAEEEQAWEGELPELLPPAQRELLARYNATQAPRPSGRLEEGFFTQARLHPELPALLAPERTLSYGELARRAQALAARLRELEVQPQELVAIAMHKGWEQATAVLGVLQAAAAYLPLDPEQPPLRLHQLLEEGPARVVLTQSSLLHTVPWPPGVQVIAVDELEPATEAPPLPPRGTPEHLAYVIYTSGSTGKPKGVAIEHRAALNTVVDLNTRFGVGPEDRVLGLSALTFDLSVYDVLGLLGAGGALVLPAAEAEKDPAHWWERLVAGRVTVWNSTPALMLLLVEYAEQRGLKLPAALRLVMLSGDWIPVALPDRIRALGRDVQVVSLGGATEASIWSIAYPIGQVAPQWKSIPYGMPLANQRFHVLDGRLEARPWWVPGELYIGGEGLAREYWRDEPLTATRFIRHPRTGERLYRTGDQGRMLPEGSIEFLGREDLQVKVQGFRVELGEIEAALAQHPALSASVVVARGEPRGVRRLVAYAVPRSGQTPAAGELRRYLAERLPAYMVPSAFVLLESLPRSRNGKIARDQLPEPQQTQGLAAQAAAADPLVERLAALVKEALRLERVEPQDSLLDLGADSVALIRLINRLEAELQFRPRLADIYENPTVQGLATLHQEKTKSQGEGGAPRLTAPRSTLLPAEEWGRFKANRPGLRRFPDGTPEVALPGSGLAPAPEELTALERRRSVRTYSLEPVSHEQLGRLLAPLREWEVQGSRRYLYASAGGLYPVQLYLHLKPGRARGLEPGTWYYDPSTHRLVLLSAGAGLDRRIHDPHQNQAIFDSAAFSLFLIARMGAVEPVYAEHALHFATLEAGLMTQLLDLGAAPSGLGLCHIGDLDFAQARGLFHLEEEHVLLHSLVGGVLPTRGQEAASVPAEGGTEARQLAQLLQQVKTLTPEAARALLEARRGSKGRPHE

SEQ ID NO: 5379 - protein, 421 aa, Mycobacterium sp. MCS
MALVVQKYGGSSVSDAERIRRVAERIVETKKAGNDVVVVVSAMGDTTDDLLDLAKQVCPAPPARELDMLLTAGERISNALVAMAIESLGAQARSFTGSQAGVVTTGTHGNAKIIDVTPTRLRSALDEGQIVLVAGFQGVSQDTKDVTTLGRGGSDTTAVAVAAALNADVCEIYTDVDGVYTADPRIVPNARKLDTVSFEEMLEMAACGAKVLMLRCVEYARRYDLPIHVRSSYSDKPGTIVKGSIEDIAMEDAILTGVAHDRSESKVTVVGLPDVPGYAAKVFRAVADADVNIDMVLQNISKIEDGKTDITFTCARDNAPGAVEKLTSLQDEIGFTRVLYDDHIGKVSLIGAGMRSHPGVTATFCEALAEVGVNIDLISTSEIRISVLVKDTELDKAVAALHEAFGLGGDEEAVVYAGTGR

SEQ ID NO: 5380 - protein, 353 aa, Mannheimia succiniciproducens MBEL55E
MIILFNLNIIGENLMAIKIGINGFGRIGRIVFRAAQTRDDIEVVGINDLIDVEYMAYMLKYDSTHGRFDGSVEVKDGNLVVNGKTIRVTAERDPANLNWGAIGVDIAVEATGLFLTDETARKHITAGAKKVVMTGPSKDATPMFVRGVNFSAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYETIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 5381 - protein, 2837 aa, Angiococcus disciformis
MSHDTQLEGAVAVVAMAGRFPQAPTLEDYWRIIHEGVDAFTQLTDEQLLASGVGPSLLRQPGYVRRAALLDRMDQFDAAFFGFSPREAEVLDPQHRLFLECAHEALERAGHGSERARGRVGVFASASLNSYYLHSLHGNARLREVLGDFQLAIANDKDFLPTRVSYKLGLRGPSVAVQTACSSSLVAVHLACQSLLNGECALALAGGSSLSVPQAQGYLYQEGGIASPDGYCRPFDAAAAGTNRGNGVGVVLLKLLEEALADGDTIHAVIRGSAVNNDGAHKIGYTAPSVEGQASVISEALEVAAVSADSIGYVEAHGTATALGDPIEVQALTRAFRKHTERRGYCALGSVKANIGHLDAAAGIASLIKAVLVLERRQLPPCPHFTSPNPRIDFERSPFYVSGRGQPWEPVDGPRRAGVSSFGIGGTNVHVVLEEAPPRPAPRRAARPYQLLPLSARTERAREEVEARLREHLRQQPQEPLEEVAHTLQVGRRHMAWRTALVSSSPAQAVELLERRRPEALLRGQSAAQARSVAFLLPGQGSQYVGMGAALHESEAPFREQVDLCAGKLQGVLGLDVRRLLYPGPREREWAQERLRETRVCQPVLFTVEYALARLLEAWGIRPTALLGHSLGEYVAACLAGVFSLEEALEVVAARGQLMGSMPPGGMLAVGLPAQEVEPLLPAALALAAHNSPQACVVAGPTEPLAELRARLEQRGIACTPLAVSHAFHSPMMEPAVAPFVARLRRMHLRPPSLPFISNVTGTWIEAEEATSPEYWGRHLLQPVRFAQGLERLCEGVQPRLLLEVGPGHTLGRLAARQSSGPVQVVSTLGSSREESSEVERLLTAIGRLWVEGAEVDWAGLHRGERRRRAVLPTYPFEHQRYWVETAPQPSPPERPGTPAESPVTSSFYVPGWSRAALPSAAPSRRVGRLLLLAEAHGWSQGLAERLRARGHSVTLVEPGERLERLTPEHWRLPPGRREDFQRLLEDSGELPSRVLHLWLLGSSQSPQERGFYTLLALAQALGAHGTRPAVELTVVTDQLYAVAEGEPIQPLKALLQGPASVLPQELPGCTCRLVDMALPPGGVAEELLERLVAEVESTASERSVAYRGAARWVREFVPVPLPPPEPSQLPLRQRGVYLIVGGLGGVGLALAEHLARRVSARLVLTGRSPTPPRESWSAWLGTPTRLRLSQELEWLRGAAEQIEHQRPLHSLADSPGLEESLRLLCASYLYHFLFPLQAPLRLGEPRAMQALRERLGLQPGFERLFSFMIGTLEQAKLIRVGEGMLEGQVEPAHVPTPRALHERLLEGYPEVSGLLELLEHCVRHYPEVLRGSLPALSVLYPSGRSEEDSARSGVEWSSMGQCVALLRHFLARHAERTQGRTLRILEVGGGSGVVLQALLPLLRHHPVEYHFTDIGPSFVRAMEGVGRRQGLTFLHTSVLDISRPPPEQGHPPGSYDLVIALNVVHATPRVPQSLAHLESLLVPGGHLCLVETVKQQPWVDMIWGLAEGWWSYEDELRTRSPLLEVGDWEHALRDVGFAEVEVLPAAVEQRSRWDNVLLIAQRPGESGLQPVGGRAAMQERIRRLRAIEEAGGEVLPLVADVTDRERMGEVLAEVKRRHGALHGVIHAALVLEDGLMQLKTRESAGRVLASKVEGTLVLDELLRDEPLDFFVLCSSLSALLGALGQADYAAASAFLDAYAHSQRGRTDRRTISMDWDRWLEVGAAMRLGLGLAAGALGLQRTAPGEYTVRWQAERCWWLDEHRLEGRATLPGVAYLELVRAALVQELGEAPVELEQLVLLSLLEAPAGEEVEVRFHLRPEDEGYALEIRSRAGGLANGGWRSHAMGRVRMLPRGSARPTHPLRELEERLGLTQAPREHEPAQGPRELAPALGRRWSSLSWHRAWKGEEGLALIELPEELAEDLRQWPLHPALLDAATGFAPLPPGAWLPLSYGNTRIHGPLPRQLYSHIRRLEPASAQAGVVRLEVRLMDGEGRELLCVEEFVLRRVEVDSLARPQPAGKAPRQAVLPRPGALDSLRLQPLERLPPQEGEVEVQVLAAGLNFKDALLALGALPVELANGAPLALGVECAGIISAVGPGVRGLRVGEAVVAAAAGAFASHVRVPQEQVFPKPAGLSFEQAAMVPVTLFTAWYALEELARLRAGEHVLIHAAATGVGLAGVKLALRRGATVYATAGSEPKRELLRSLGVTLAMDSRAPGFDDQLLQHTQGRGVDVVLNSLSGEFLSRSLGVLARHGRFVELGVRDMLSGGTLPLAPFERGLTFLAAQIDPGMKGYRELMGEALRQIERGELEPLPYTAWPLERVAEALQLVSKGRHVGKVVLTPEEPLSRPPALPSSSRPVQPRAGVAIVGLRSAEGCEAFERILAAGLPQVAVSTRELRARMAEIERLRVSSWEPALPSVPRGSPARTERSKPYVAPRTERERALAALWQDLLGVSEVGLDDDFFELKGDSLLAIQLMGRLRKELEVELPLSSFLARPTLRTLLSAMPAPATDEPASATGAIPAAAPQPSPAVSSEPARKWRHLVPIQPQGESPPFFWAAPLMGTVFPYFTLARCLAPTHPFYALQPPGLQEGQEPMDKVEELAALYVRELRELQPRGPYRLGGWSFGCVVAYEVALQLEAAGEQVALLSLLDFPAPSGQRASLWATARFFSGSVLRGLAPYTLDYLYLAARAPLNPDAASRLSSSLTRGWERLRKGGLVQELLDHAAMARVVPEDSRLLLLREPGIAPMLRLTRAHQRAMLSYRPRGRLRQRIVLFRTSEQAWSFARDLGWGALSASGVDVREAPGDHMTLLRPPHVERVAEQLRALLSSAPLPTRR

SEQ ID NO: 5382 - protein, 81 aa, Glycine max
MVANGDAPARGSAAAAASLRGRRTTSGAAAGGGGASSMLQFYTDEAAGRKMSPNTVLIMSIGFIAVVAMLHVFGKLYRTSN

SEQ ID NO: 5383 - protein, 252 aa, Bradyrhizobium japonicum USDA 110
MGRVSEKVILVTGGAQGMGAAHARLLVAEGAKVVITDILDNEGATFAAELGPSAIYVRQDVAQPGEWCQAIAAAEGKFGAVHGLVNNAGIASMAPIERFPLEQWEKTLAVNLTGVFLGMQTALPAMRRAGGGSIVNISSVEGMRGSPGLHAYVASKFGVRGITKSAALEAAASGVRINSIHPGFINTRMTENIDLSSFPIPLARPAEPQEVSQAVLFLLSDESSYLTGSEIVVDGGLTIGVPQKGQAVENIF

SEQ ID NO: 5384 - protein, 762 aa, Magnaporthe grisea 70-15
MAAPSNTAAVDQLTSDLANANMNGGEKTTVNTNVGASFTGEEIDTAGPTPSSAAPHPQASASLYVGELDPSVTEAMLFELFSQIGSVASIRVCRDAVTRRSLGYAYVNYNTTADGEKALEELNYTLIKGRPCRIMWSQRDPALRKTGQGNVFIKNLDVAIDNKALHDTFAAFGNILSCKVAQDENGNSKGYGFVHYETDEAASQAIKHVNGMLLNEKKVYVGHHIPKKDRQSKFDEMKANFTNIYVKNINPEVTDDEFRTLFEKYGDVTSSSLARDQETGKSRGFGFVNFTSHEDASKAVQELNEKEFHGQNLYVGRAQKKHEREEELRKSYEAARQEKASKYQGVNLYIKNLDDEVDDEKLRQLFSEFGPITSAKVMRDSITEPGEEGESKEGEESEKNKENKPEEKEGDDSKPEEKEGEDSKSKSKLGKSKGFGFVCFANPDDATKAVAEMNQRMVNNKPLYVALAQRKDVRKNQLEQSIQARNQLRMQQAAAAAGMPQQYMQAPVFYGPGSQPGFMPPAGGRGMPYPQGGMPMQPGRPGQFPAGFAAQQGGRGAMPQGIPPMYGLPGQFPPQGPFPQPNNPQFLAAMQQIQQSALAGGRGGPAGRGPMQGGVPVPGMPGGAGLPGFPPNARQQGPGAGRGAAAGRAPAGAPAGARGAGAPEGLQGQLAAVADNPGQQKQILGEAIFPKIQAIHPELAGKITGMLLEMDNTELVALVENDGALRSKVDEALAVYDDYVRQQGDGEGAQAPSKEEKTEEKA

SEQ ID NO: 5385 - protein, 219 aa, Mannheimia succiniciproducens MBEL55E
MNQLEMKKVAAKAALQFVKPDMIVGVGSGSTVNCFIEELGAFRDQIKGAVAASKASEELLRKQGIEVFSANDVSSLDIYVDGADEINPQKMMIKGGGAALTREKIVSSLAKNFICIVDSSKQVDILGSTFPLPVEVIPMARSQVARKLVALGGSPEWREGVITDNGNVILDVHNFIIMNPIEMEKELNNVAGVVTNGIFALNAAHTVIVGTPDGAKIIE

SEQ ID NO: 5386 - protein, 173 aa, Oceanobacillus iheyensis HTE831
MIDHYNNIYPTIHPTAFVAKDAVINGDVQIKEKVSIWFHTVIRGDVSKTTIGKRTNIQDLCMLHQSPGQPLIIEEDVTVGHQVTLHSAIVRKKALIGMGSIVLDGAEIGEGAFLGAGSLVPPGKKIPAHTLAMGRPAKVVRELTEEDYKEMDRVRNSYVEKGQYYKNNTNMGI

SEQ ID NO: 5387 - protein, 580 aa, Populus tremula x Populus alba
LPSLWAILLFFLFLLCPATSSLHSRQSGSTKFRHQAVVARHGAVATDDGRCSRIGIDVLREGGHAVDAAVAASLCLGVVSPASSGIGGGDFMLIRLDGGEVLAYDMRETAPMQASENMYDGNATLKERGALSIAVPGELAGLYKAWKHYGRLPWERLVRPAEKLARRGFKISRYLRMQMEKTKPGILADEGLRNVFTSNGDLLQQGDICYNKKLADTLRTISKGVGAFYNGPIGFNLVRDIQKLGGILTIEDLRRYKVRVREPIITNILGYKIIGMPPPSSGGASMMLILNILAQYEVPEGISGPLGIHRLVESLKHAFAVRMKLGDPDFADVAQVVSDMISPKFAEELKKTIYDNMTFDPGHYGGRWNQINDHGTSHISIVDSERNAVSMTNTVNSYFGAQILSPSTGIVLNNEMDDFSMPGNNTGNVLPPAPPNFIRPGKRPLSSMTPTIVLKDKQLKGVVGASGGSMIIAGTTEVLLNHFAKGMDPLSSVLAPRVYHKLTPNVVQYENWTTVYGDHFELPADVRAFLQKIGHALEGFTGGTICQFIVQDLEAAEGNKLMGKLVGVSDPRKGGLPAGY

SEQ ID NO: 5388 - protein, 105 aa, Malus x domestica
GTTMTRNDRVGIEVPKVEVRFQNLSIEGDAYVGTRALPTLLNSTLNQLEGLVGLIGLSKSKKRVVKILQDVSGIVKPSRMTLLLGPPSSGKTTLLKALAGLFCWV

SEQ ID NO: 5389 - protein, 371 aa, Zea mays
  misc_feature (173)..(174): Xaa can be any naturally occurring amino acid
KGSAAKTPPQRRKSSSVEDEAWELLQESMVYYCGSPVGTIAANDPNDSDPVNYDQVFIRDFIPSGIAFLLKGEYEIVRNFILHTLQLQALFYSALLCAREMLTQEDGSADLIRALNNRLIALSFHIREYYWLDMQKLNEIYRYKTEEYSYDAVNKFNIYPDQISPWLVEWIPXXGGYFIGNLQPAHMDFRFFSLGNLWSIVSSLATTHQSHAILDLIESKWFDLVAEMPLKICYPALENQEWKIITGSDPKNTPWSYHNGGSWPTLLWQLTVACIKMNRPELAAKAIEVAERGIATDKWPGYFDPKRARFIGKQSRLYQTWFIAGFLVAKLLIEKPDAARILWNDEDAEILNASSTNRKRGKKVLKKTYIV

SEQ ID NO: 5390 - protein, 378 aa, Physcomitrella patens
SGMKSTNAVTFGKRSDDLASIVAAQSAVSASSGATRAVTEAKIKVAINGFGRIGRNFIRCWQGRKDSPLDVVVINDTGGVKQASHLLKYDSMLGTFNADVKVEGNNAISVDGKVIKVVSDRNPLNLPWGDMDIDLVIEGTGVFVDEAGAGKHIQAGAKKVLITAPGKGAIPTFVVGVNEQDYKHSDAIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACQTEQLKGVLAVCDEPLVSVDFRCTDVSSTVDSSLTMVMGDDMVKVVAWYDNEWGYSQRVVDLANLVAEKWE

SEQ ID NO: 5391 - protein, 375 aa, Arabidopsis thaliana
MVDQNRAFGWAANDESGVLSPFHFSRRENGENDVTVKILFCGVCHSDLHTIKNHWGFSRYPIIPGHEIVGIATKVGKNVTKFKEGDRVGVGVIIGSCQSCESCNQDLENYCPKVVFTYNSRSSDGTRNQGGYSDVIVVDHRFVLSIPDGLPSDSGAPLLCAGITVYSPMKYYGMTKESGKRLGVNGLGGLGHIAVKIGKAFGLRVTVISRSSEKEREAIDRLGADSFLVTTDSQKMKEAVGTMDFIIDTVSAEHALLPLFSLLKVSGKLVALGLLEKPLDLPIFPLVLGRKMVGGSQIGGMKETQEMLEFCAKHKIVSDIELIKMSDINSAMDRLVKSDVRYRFVIDVANSLLPESSAEILTEHVDHGVSITSRF

SEQ ID NO: 5392 - protein, 193 aa, Triticum aestivum
  misc_feature (35)..(35): Xaa can be any naturally occurring amino acid
  misc_feature (88)..(88): Xaa can be any naturally occurring amino acid
  misc_feature (156)..(156): Xaa can be any naturally occurring amino acid
  misc_feature (177)..(177): Xaa can be any naturally occurring amino acid
PAGPGPTSSTLSPPDPVCHSTISSSVSSSLVLPHXNIGHMASSYEIFIAFKANVGQCALADPIISRSKNRGFKIAGITLMTPGKEHLXKHYADLAGKAFFAVLIENMNSGPICAMYCHVRRFVNTDRSILEATNPLASSPVIILGDYAIDDSRNVXHGSHSIENAQKDIVLWFKEGXMTSCKDDHCIWVYEKA

SEQ ID NO: 5393 - protein, 69 aa, Arabidopsis thaliana
  misc_feature (29)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (47)..(51): Xaa can be any naturally occurring amino acid
  misc_feature (54)..(54): Xaa can be any naturally occurring amino acid
  misc_feature (57)..(57): Xaa can be any naturally occurring amino acid
  misc_feature (66)..(66): Xaa can be any naturally occurring amino acid
MASSMLSSATMVASPAQATMVAPFNGLKXSAAXPAXRKANNDITCIXXXXXRVXCMXGWPAIGKKXGRL

SEQ ID NO: 5394 - protein, 492 aa, Polaromonas sp. JS666
MTSSFSNLSLAEPLARAVAEMGYETMTPIQEQAIPVVLQGKDVMGAAQTGTGKTAAFSLPLLQRMLKHENASTSPARHPVRALVLLPTRELAVQVAEQVKLYAKHTNLRSAVVFGGMDMKPQTLELKQGVEVLVATPGRLLDHIEAKNTVLNQVEYVVLDEADRMLDIGFLPDLQRILSYLPKQRITLLFSATFSPEIKRLASSYLQDPVTIEVARSNATASTVEQHFYSVGADDKRRALHQILKERGMKQAFVFVNSKLGCARLARSLEREGLKTTALHGDKSQDERLKALDAFKKGEVDLLVCTDVAARGLDIKDVPAVFNFDVPFNAEDYVHRIGRTGRAGASGLAVSFVASSDQRLVADIEKLIKTKIELEPIEFDEDRPRISEQGRINDGRRMYRQGNEGEEGAGREAFVSREPRDRERRERREYTPHRQPAAPRDPFFDQPYEATTVIADAQPSWEAAAKAGPARSSVSANIKPKKKVAALFKTSD

SEQ ID NO: 5395 - protein, 330 aa, Burkholderia sp. 383
MKAALDVVTYGEAMAMFVATEPGHLAHATQFAKRIAGADLNVAIGLSRLGFRVGWMSRVGRDSFGGYVLDTLAREGIDASCVTVDPRYPTGFQLKSRNDDGSDPTVEYFRKGSAASHLSCDDYVADYVLGARHLHLTGVAPAISATSCELAFKLAREMRAAGKTISFDPNLRPTLWPSADVMAKTLNAIASLADWVLPGIAEGRQLTGHDTPADIAGFYLAQGARGVVIKLGAEGAYYRTADGHDGTVTGERVQNVVDTVGAGDGFAVGVVSALLEGKTIEQAVARGNRIGALAIQVIGDSEGLPTRAALDRCENVSNRADRLEETFTAQ

SEQ ID NO: 5396 - protein, 525 aa, Pseudomonas fluorescens Pf-5
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVEGSELREFGYARVDVVGKSRLLDGIEDHVDADGLFGLDVWMSHGDKVTKMPEDFHILASTPSCPIAGMFNDDLRYYGVQFHPEVTHTKQGGRILSRFILDICGCEALWTPSKIAEDAIAQIRAQVGTDNVLLGLSGGVDSSVVAALLHKAIGDQLTCVFVDNGLLRLHEGEQVMAMFAENMGVKVIRANAEEQFLNNLAGEADPEKKRKIIGRTFIDVFDAESCKLENIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 5397 - protein, 893 aa, Oryza sativa Japonica Group
MVIPGPFFRRSTALQVFSVLCVLRFVVPDPDIEWPLIHGIPACPPFTCGHLSKVASPFHRRGYECGVASYELTCTDDKATIQIDNGTYFVTGIDYSDSTFWVVDANISDSRNNCPLPRWKRIPYYYDDVSSDDEESSPYNIQVELDPASRWWSFFVNCSKEINNNVMYSPVACMGTSSSFVYVLTGRLSCYIENLEPSCGYLAMTPLDGMGRVAPAVDSLSYEDVVKFMRKGFRVQFPFRHHRNRSFKDCLMESIPKSTGIGKLSDWFSLSVTENFMDCATAKIPSPYNILLGIILYALMFWTMLALEKFLRMQQMLGPTRYAYTDIIAITGHFREKLGQGGYGSVYKGVLLPGDLHVAIKILNGYSNCNGEEFISEVATIGRIHHVNVVRLVGFCSEEMRRALVYEYMPRGSLDKHIFSSERRFSWDKLNEIALGIARGINYLHQGCDMQILHFDIKPHNILLDDNFVPKVADFGLAKLYPRDKSFVSDRALRGTVGYMAPEMVSRSFGIISGKSDVYSFGMLLLEMVGGRRNADPNADSSASKAYYPSWVYDKLIADQQVDEISNFANMHELERKLCLVGLWCIQMKSHDRPTMSEAIEMLEGGVDALQVPLRPFFCDGDGMPPPQVMDSYFHSSDLSAISEEDDGIAELASQLDEIASLAPCRTEAVRKGTCRTAPVRKGTCRTAPVRKGTCRTAPVRQHAPVRQYPVELPQFDSTLSNCPSSTVPCRTAPVRQGLRTEEPRAVAAVVIGSLPSSSPWARLRGAVVRRLSGGSGARRRSGEHGCGRRNEGERGNGAAEGASAAAGRAVEREQAADRVAERERAAEQRRASAAASEFGREGEAAGDQETISSSASSPSPAGGASPSIVGHPRGYGGGGGRARPSQLRPPPA

SEQ ID NO: 5398 - protein, 382 aa, Gluconobacter oxydans 621H
MLISLIVMILNPLFPGYDLQQVPQSLLGTINLPRTLLDGALSFLLFAGAMQVDLGLLLSRGKSVAALAILGTSLAVGLLAAPAWLIFPVFGLAVPFSWCVLLGAMLAPTDPVSVVGMLRRLGLPPALQATFAGESLFNDGVGVVIFGTMIGLATGETSSVSIGDFVLRFLVEAVGGGLLGAFTGWLTLLLLRGVEDTQIDLLGSLALATGTYSLANGLHMSGPIAVVVAGMSLAGKAGHRAITQKSREEMVVFWNLIDEILNALLFLLIGFELLEIRLHMAPLLTMLVVIPLSVLVRGASVFLSTMPVHLQPGERGRALGVLTWGGLRGGISVALALGLPAGELRETLLPVCYGVVVVTIIVQGLTMGRVVRWLYPETAPPS

SEQ ID NO: 5399 - protein, 322 aa, Aspergillus oryzae
MAFRRPLMLSKTASAPFSSLAGRTARVAATLPRFTTARASSSSTSALAYKALHRRSPLPLPVSDSSPQWDAPTAVSSILYETPVAPTNPPKRHILNCLVQNEPGVLSRVSGILAARGFNIDSLVVCNTEVEDLSRMTIVLQGQDGVVEQARRQLDDLVPVWAVLDYTDSALVQRELLLAKVSILGPEFFEELLQHHREITTPGETLDGQKDKAEAQITEFHPRNLPPSQALRHKHEHLDAITRLTHQFGGKVLDISNNNCIVEVSAKPSRIDSFMKLIAPFGVLESTRTGLMALPRSPLHEQVEEIEKEAADVVDASTLPPG

SEQ ID NO: 5400 - protein, 298 aa, Escherichia coli
MNMANLKAVIPVAGLGMHMLPATKAIPKEMLPIVDKPMIQYIVDEIVAAGIKEIVLVTHSSKNAVENHFDTSYELEALLEQRVKRQQLAEVQAICPPGVTIMNVRQAQPLGLGHSILCARPVVGDNPFVVVLPDIILDGGTADPLRYNLAAMVARFNETGRSQVLAKRMPGDLSEYSVIQTKEPMVAEGQVARIVEFIEKPDEPQTLDSDLMAVGRYVLSADIWAELERTQPGAWGRIQLTDAIAELAKKQSVDAMLMTGESYDCGKKMGYMQAFVTYGMRNLKEGTKFRESIKKLLA

SEQ ID NO: 5401 - protein, 226 aa, Saccharomyces cerevisiae
MADINKYIPMVDAILSVSNPDEISPKRVRKALQILYSVNLDSQRKLINELILERFGDIQENPRVLIPKNDLISRDQELSLRLQKEEERPLRSTRKRKGKSESKSKRKKKKNDSPDSNSISVRKVLLSAPLQKFLGSEELPRTQVVKMIWQYIKEHDLQNPKDRREILCDEKMEPIFGKKMTMFSMNKLLTKHLFNPDEIVKHEEEQKQTPEKEIKLENESLPNLSG

SEQ ID NO: 5402 - protein, 485 aa, Synechococcus sp. CC9605
MPTRFTEQSQRFRPNSNEGQVLQKAREHFEATLIGVQGELAGSVAAMEHRRSDDALNYGEIFLRDNVPVMIYLMLEGRFAIVKQFLSVSLQLQSTNVQTRGVFPTSFVEEEGELVADYGQRSIGRITSVDASLWWPILCWIYVKRSGDVDFGRSPEVQRGLQLLLDLVLHPSFEGTPVLFVPDCAFMIDRPMDVWGAPLEVEVLLFAALRSCVGLMELCQRHENSVLLAERLRLSRQWTHDLRQFLLKHYWVTSKTMQVLRRRPTEQYGENQHHNEFNVQPQVIPDWLQDWLENRGGYMIGNMRTGRPDFRFYSLGNSLASLFGLLTAPQQRALFRLVLHNRDHLMAQMPMRICHPPMEGVEWENKTGSDPKNWPWSYHNGGHWPSLLWFFGASILLHERLNPQADVLLMGQMKTLMDECYWSHLNQLPRQQWAEYFDGPTGTWVGQQSRTYQTWTIVGFLLMHHFLHINPDDVLMLNLDESMGH

SEQ ID NO: 5403 - protein, 508 aa, Oryza sativa
MESLLAAGAGGIGVAAAAVGGFIAAATLAVAPPKNRRNPPPAVPGLPIIGNLHQLKEKKPHQTFTKWAEIYGPIYTIRTGASSVVVLNSTEVAKEAMVAKFSSISTRKLSKALTVLSHDKSMVATSDSGDFHKMGKRYIMLSMLGTSAQKQFRDTRDMIINNMLSTFHQLVKDDPHAPLIFRDVFKDELFRLSMIQSLGEDVSSVYVDEFGRDISKEEIYNATVTDMMMCAIEVDWRDFFPYLSWVPNKSFETRVFTTESRRTAVMRALIKQQKERIVRGEARTCYLDFLLAENTLTDEQLMMLVWEALIEAADTTLVTTEWAMYELAKNPDKQARNIERLYQEIREVCGDEAVTEEHLPWLPYLNAVFQETLRRHSPVPLIPPRFVNEDTMLAGYDVPAGTEMVINLYGCNMNKKEWESPEEWAPERFAGGRFKVADMYKTMAFGAGRRVCAGSLQATHIACAAIARFVQEFGWRLREGDEEKVDTVQLTAYKLHPLHVHLTRRGRM

SEQ ID NO: 5404 - protein, 445 aa, Oryza sativa Indica Group
MGFVESIGRYRVGRTIGAGTFAKVRLAVDADTGATVAVKVIDKRMVIRNNLMYQVKREITAMKLLNHPNIVKIYEVIATKTKICLVMEYVPGGQLSDKLSYLKRLDEKEAKKYFYQLIDAVDYCHRRGVYHRDLKPENLLVDNQGNLKVSDFGLSVLKKPGQFLSTSCGSPCYVAPEMIQHKSYDGAAADVWSCGVILFELLAGYLPFQDCSLTNLYRRISRAQFVFPQWLSVPQKKIIIRILDPSPITRAKISDIFDDKWLQDHCNPSARIENDDDCDVIEEASTDSDSSHNTEVKETEEMTAETDRFINAFQLIVRCSDLDLSGLFQEQKTKLASPHPVQETFDKIKVAAKDVSMAVKRMNSSLVEIQDSKLLPRSNLDLTLSAEINLAPPQDSRMHNLLNGNAMHMMSTCSSVEAYQACSMVDSCLQAHLIWSVINQVMFYE

SEQ ID NO: 5405 - protein, 119 aa, Mycobacterium tuberculosis
MADRIELRGLTVHGRHGVYDHERVAGQRFVIDVTVWIDLAEAANSDDLADTYDYVRLASRAAEIVAGPPRKLIETVGAEIADHVMDDQRVHAVEVAVHKPQAPIPQTFDDVAVVIRRSR

SEQ ID NO: 5406 - protein, 709 aa, Streptomyces coelicolor A3(2)
MSTTAELLKGAAELFPGEVVTSAHVRHFDLPLGAGRFALVTLDNGHDHTKPTTLGPQSLANIDAALDQVEKEAADGDIVGVGVTGKPFIFAVGADLKGVELLKRHEDALAIGKGGHDVLKRLANLAVPSFAYYNGAAMGGGVEIGLHCTYRTVSAALPAFSLPEVFLGLVPGWGGCTLLPNLIGADKAVSVIIENSLNQNRQLKGKQVFELGIADAIFEGADFLEQSLLWTASVLKGEITVERPLIDRGEAWDQAVAKGRFIADGKVHAAAPAAYRALDIIATAKNGDLQQGYDAEDQALADLIMGGELRSGIYAFNLVQKRGKRPAGAPDKSLARPVTKVGVVGAGLMASQLALLFLRRLEVPVVLTDIDQERVDKGVGYVHAEIDKLLGKGRVNQDKANRLKALVTGVLDKAEGFADADFVIEAVFEEMGVKQKVFAEVEAVAPAHAILATNTSSLSVSEMASKLKHPERVVGFHFFNPVAILPLLEIVRGEQTDEAALATAFGVAKKLKKTAVLVKDAPAFVVNRILTRFMGEIQNVIDEGTPVAVAEKAVEPLGLPMSPLVLLELVGPAIGLHVSETLNRAFPERFTVSPNLKAVVEAGKRGFYVYDSGKPELDPEVAALLKQGDSVLTEEQVRDRVLDAVAQEIGLMLDEGVVAEAQDVDLCLITGAGWPFHLGGITPYLDREGVSERVNGKRFLEAGVASVPA

SEQ ID NO: 5407 - protein, 119 aa, Mycobacterium tuberculosis
MADRIELRGLTVHGRHGVYAHERVAGQRFVIDVTVWIDLAEAANSDDLADTYDYVRLASRAAEIVAGPPRKLIETVGAEIADHVMDDQRVHAVEVAVHKPQAPIPQTFDDVAVVIRRSR

SEQ ID NO: 5408 - protein, 574 aa, Oryza sativa Indica Group
MVRTGLLRHCSFFFLCVCVWQLVMGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLCAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMALEYEDFDKFDRVRVPKIRYAGMLQYDGELKLPSHYLVSPPEIERTSGEYLVKNGIRTFACRQFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 5409 - protein, 358 aa, Angiococcus disciformis
MGRGLQPLPPDAPHPRPARCEGRRWQGLGAHGQPHLRPRRGESGPGRCRDGSHREGTHPPQSRSYLAMTADSMDATVPSRRPALGFIGGGVMAEALIGAVTGGGLAAPGTLLVGEVDEERRRVLREQYGVEVTADNLAAADAELVVLAVKPQHLGVVLQQLRGQLREDTIVVSIIAGARLQTLCEGLEHPLVVRAMPNTPARVRKAATFWIPSAGLSEPALVRVRSLLGALGTEVEVADEAGVEMATGLAGPMPAFVYFLIEAFIDAGVALGLPRDQATLATVESMRGSLELLHRSQESPAALRKQVTSPGGATLAGLKVFESAGVRDAMDAAVRAVHARAQELGRLPLAPLEPGKEG

SEQ ID NO: 5410 - protein, 119 aa, Mycobacterium tuberculosis
MADRIELRGLTVHGRHGVAAHERVAGQRFVIDVTVWIDLAEAANSDDLADTYDYVRLASRAAEIVAGPPRKLIETVGAEIADHVMDDQRVHAVEVAVHKPQAPIPQTFDDVAVVIRRSR

SEQ ID NO: 5411 - protein, 527 aa, Prochlorococcus marinus str. MIT 9515
MNNDFNSWDKYCDYLWYDQKINIWLDISKINFSYDQISSLENKFIGVFSSIKELEAGAISNIDEKRQVGHYWLRNPSIAPNTFIKDEIIKDIRDISEFGDKVLKGIIKNNKNQTYTDVLWIGIGGSGLGPLLITEALQENSVGLNFSYIDNIDPFLISEKLDELSDKLPTTLFVVVSKSGGTPEPKIAMNIIKRHVEDKNILWNSNAIAITMKNSQLYKKAKLENWLKIFNLPDWVGGRTSITSSVGLLPLALINQDVSEFIRGASIMDELTRITNIKDNPAALLSSAWFFSGNGIGKRDMVVLPYRDRLQVFSKYLQQLVMESLGKKFNRKGKIVHQGISVFGNKGSTDQHAYVQQLRDGIDNFFCVFIELLDIPDDNKYFGSENPKEFLSGFLQGTRSALSNENRQSITITLDKLNCLTLGALIALFERAVSFYAELVDINAYDQPGVEAGKKAAAEILEYQKKVTELLNNGEEFSIKKITSLIENSTSEPIFFIIRQMCFGNDDYLIKGDWSNPISIIIKKNSK

SEQ ID NO: 5412 - protein, 175 aa, Triticum aestivum
MAPTVMASSATSVAPFQGLKSTVGLPVRRRSISAGLSRVSNGGRIRCMQVWPIEGIKKYESLSDLPPLSTEALLKQVDYLIRSKWVPCLEFSKVGFVSREHNRSPGYYDGRYWTMWKLPMSGCTDATQVLNEVEEVKKEYPDAYVRVIGFDNLRQVHCVTFIAFRPPGSEESDKA

SEQ ID NO: 5413 - protein, 143 aa, Oryza sativa Japonica Group
MAKCSKIRYIVWLRQTLRRWRSRAAARAAAEAVPAGHVAVCVGGASRRFVVRAAHLNHPVFRELLRQAEEEYGFPSGAYCGPIALPCDEGLFEHVLRHLSSPSSAARFVTLEDIQSGALSCCCAAAGDALPLLRGIATDKAVW

SEQ ID NO: 5414 - protein, 492 aa, Zea mays
MMDLADPQQQQRLIAGAALLLATAAFLRLLLGSRSGGGKRLPPTIPGAPVVGGLVKFMRGPIPMIREQYARLGSVFTVPIITRRITFLVGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNARRSISVLFPYLPIPALKRRDRARARLAEIFATIIKSRKASGQSEEDMLQCFIDSKYKNGRSTSEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKVYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 5415 - protein, 335 aa, Shewanella sp. MR-4
MLKNNLNDGLQLDRTFSIAPMLDLTDRHYRYFARLMSANALLYTEMVTTGAILHGRGDYLAYNQEEHPLALQLGGSNPAELARCAKLAAERGYDEVNLNVGCPSDRVQNGRFGACLMAEPELVAECVDAMKQVVDIPVTVKTRIGIDEQDSYEFLTYFIDTVMAKGCGEFIIHARKAWLQGLSPKENREIPPLDYDRVYQLKRDYPMLNISINGGITSLEQAKTHLQYLDGVMVGREAYQNPYILAQVDQLLCGCEKAVISREAVIEAMLPYIEAHLQAGGRLNHITRHMIGLFQGLPGARAWRRYLSENAHKNGAGIEVVKQAYQSIQSEIIAQ

SEQ ID NO: 5416 - protein, 244 aa, Streptococcus suis 89/1591
MELTNKNVFVTGSSRGIGLAIAHKFASLGANVVLNGRGQLGQDLLDSFADYGVKVLAISGDISSAEDAKRMVAEAIETLGSVDILVNNAGITKDGMALRMTEEDFDTVLKVNLTGTFNMTQAVLKPMTKAREGAIINLSSVSGLIGNAGQANYSASKAGVIGFTKAIAREVAGRNVRVNAIAPGFIQSDMTDVLSDKIKEAMTAQIPMKRFGATEEVADVAVFLAKQEYLTGQVIAVDGGLTMQ

SEQ ID NO: 5417 - protein, 544 aa, Populus tremula x Populus alba
LYSSFIPPLVYAMMGSSRDLAVGTVAVASLLTASMLGNVVNANENPKLYLHLAFTATFVAGVFQASLGLLRLGFIVDFLSHATIIGFMAGAATVVIMQQLKGILGLNHFTHSTDLVSVMRSVFTQTHQWRWESAVLGFGFLFFLLTTRYFSKRKPKYFWVSAMALLTSVILGSLLVYLTHAEKHGVQVIGNLKKELNPLSFTDLVFVSPYLTTAIKTGIITGVIALAEGIAVGRSFAMFKNYHIDGNKEMIAFGTMNIVGSCTSCYLTTGPFSRSAVNYNAGCKTAVSNIVMALAVMVTLLLLTPLFHYTPLVVLSSIIISAMLGLLDYEAAIHLWTVDKFDFIVCMSAYAGVVFASVEIGLVIAVAISVLRLLLFVARPKTFILGNIPNSMIYRNVEQYLNTSSVPGVLILEIDAPIYYANSGYLRERIARWVDDEEDKLKSSGETSLQYVILNMGAVGTIDTSGISMLEEVKKVMDRRGLKLVMANPGAEVMKKLNKAKFIEKIGQEWIHLTVGEAVEACDFMLHTCSPGPLKEDSEAYNKV

SEQ ID NO: 5418 - protein, 503 aa, Zea mays
MALAILARRRAAAAVLRRPQTAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTIVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGEQTILEADVVLVSAGRSPFTSGIGLETLGVETDKAGRILVDKRFMTNVKGVYAIGDAIPGPMLAHKAEEDGVACVEFIAGKEGHVDYGTVPGVVYTHPEVASVGKTEEQVKALGIAYNVGKFPLLANSRAKAIDDAEGVVKVIAEKETDKILGVHIMAPNAGEIIHEAVVALQYGASSEDVARTCHAHPTVSEALKEACLQTFDKAIHI

SEQ ID NO: 5419 - protein, 577 aa, Prochlorococcus marinus str. MIT 9515
MKETSPKSNNGTILDNNEKFKIEFDQISDALAAIRNGECIIVVDDERRENEGDLICAAQFATPQQINFMATEGRGLICLAMQGDKLDALDLPLMVDRNTDKNQTAFTVSIDAGPENNVTTGISAEDRAKTIQVAINPSTKPEDLRRPGHIFPLRAKKGGVLKRAGHTEAAVDIAAMSGLYPAGVICEIQNPDGSMSRLPQLKEYAKEWGMKLISIADLISYRFQNERFVYRKSETILPSIFGNFKAYGYINDLDGSEHIALVKQKSNKLSEPVLVRMHSECLTGDAFGSLRCDCRPQLEAALSRIEKEGEGVVVYLRQEGRGIGLINKLKAYSLQDGGLDTVEANEKLGFPADLRNYGVGAQILTDLGIKKLKLLTNNPRKIAGLGGYGIEVTERVPLVICPGDHNAEYLNVKRQKLGHLLEEDKINSRFVDPYIAIFLDGDYKSIDLVPIKNKTFEFCTKKNINIMLESSPRLLAFWNRPKLVWRILHDKNREDFTINDNEIKNIEIFIKFLSEFDKSSKVGIIVSKNIEQALHPKNNIKLKNTKFSIKNDYLYSSTRKFNLDKETFSIIFNKDLA

SEQ ID NO: 5420 - protein, 381 aa, Gibberella zeae PH-1
MLAIRALRTPASRQALRTAAPRAAIFYNRCYSTSGDRVAKYNGTKDAKGNFLVSLIEGDGIGPEIAQSVKDIFAAAKTPIAWEPVDVTPIIKDGKTAIPDAAIDNIKKNKIALKGPLATPIGKGHVSLNLTLRRTFNLFANLRPCRSVAGYETPYDNVNTVLIRENTEGEYSGIEHVVVDGVVQSIKLITREASERVLRFAFQHAESIGRKKVRVVHKATIMKLSDGLFLKVAQEVAKDFPGIEFDAELLDNSCLKMVTDPTPYNDKVLVMPNLYGDILSDMCAGLIGGLGLTPSGNIGDECSIFEAVHGSAPDIAGKNLANPTALLLSSIMMLRHMGLNEHATRIEKAIFDTLAEGKALTGDLGGKAKTNEYAAAIISRL

SEQ ID NO: 5421 - protein, 544 aa, Populus tremula x Populus alba
LYSSFIPPLVYAMMGSSRDLAVGTVAVASLLTASMLGNVVNANENPKLYLHLAFTATFVAGIFQASLGLLRLGFIVDFLSHATIIGFMAGAATVVIMQQLKGILGLNHFTHSTDLVSVMRSVFTQTHQWRWESAVLGFGFLFFLLTTRYFSKRKPKYFWVSAMAPLTSVILGSLLVYLTHAEKHGVQVIGNLKKGLNTLSFTDLVFVSPYLTTAIKTGIITGVIALAEGIAVGRSFAMFKNYHIDGNKEMIAFGTMNIVGSCTSCYLTTGPFSRSAVNYNAGCKTAVSSIVMALAVMVTLLLLTPLFHYTPLVVLSSIIISAMLGLLDYEAAIHLWTVDKFDFIVCMSAYAGVVFASVEIGLVIAVAISVLRLLLFVARPKTFILGNIPNSMIYRNVEQYLNTSSVPGVLILEIDAPIYFANSGYLRERIARWVDDEEDKLKSSGETSLQYVILNMGAVGTIDTSGISMLEEVKKVMDRRGLKLVMANPGAEVMKKLNKAKFIEKIGQEWIHLTVGEAVEACDFMLHTCSPGPLKEDSEAYNKV

SEQ ID NO: 5422 - protein, 368 aa, Haemophilus ducreyi
AVTPTCPIAAMSDEKRRFYGVQFHPEVTHTKSGLALLTNFVENICGCARSWTPENIIEDAVAKIKQKVGNDQVILGLSGGVDSSVTALLLHRAIGKNLHCVFVDNGLLRLNEGDQVMEMFGDKFGLNIIRVNAEERFLEALKGIDEPEAKRKIIGKVFIDIFDDEAKKLTDVKWLAQGTIYPDVIESAASKTGKAHVIKSHHNVGGLPDYMKLGLVEPLRELFKDEVRKIGLTLGLPAEMLNRHPFPGPGLGVRVLGEIKKEYCDLLRNADAIFIEELYKSGWYYKVSQAFTVFLPVKSVGVMGDGRKYDWVVSLRAVETIDFMTAHWAHLPYELLGKISNRIINEVNGISRVVYDVSGKPPATIEWE

SEQ ID NO: 5423 - protein, 404 aa, Aspergillus oryzae
MAAPSDSTVFRATTTAPVNIAVIKYWGKRDATLNLPTNSSLSVTLSQRSLRTLTTASCSAKYPTADELILNGKPQDIQSSKRTLACLSNLRSLRQELEAADSSLPRLSTLPLRIVSENNFPTAAGLASSAAGFAALVRAVADLYQLPQSPRDLSRIARQGSGSACRSLMGGYVAWRAGNLADGSDSLAEEVAPESHWPEMRALILVVSAEKKDVPSTEGMQTTVATSNLFATRAESVVPERMAAIETAIQNRDFPAFAEITMRDSNGFHATCLDSWPPIFYMNDVSRAAVRLVHDINRAVGRTVCAYTFDAGPNAVIYYLEKDSELVAGTVKAILGASSEGWDGPFYEPLKSFTAPGVALDKVDSRAVDVLKDGVSRVILTGVGEGPVSVNDHLVSETGDILSN

SEQ ID NO: 5424 - protein, 406 aa, Pseudomonas fluorescens Pf-5
MPGVWAILGDLRAAVVRTAQQGILMIISKLPNVGTTIFTQMSQLAVETGALNLSQGFPDFDGPQALRDALGWHAANGHNQYAPMTGLPALRQQVAAKIARSYGVQVDADAEVTITPGATQAIFCAIQAVIQRGDEVIVFDPSYDSYEPSVELAGGRCVHVPLAGQGFALDWQKLGEALSPRTRMIILNSPHNPSGALISRAELDQLAALIRDRDIYLVSDEVYEHLVFDGVPHVSVLAHEELYQRAFVVSSFGKTYHVTGWKTGYVVAPPALSAELRKVHQYVSFCGVTPLQYALADFMAEHPEHVEELPAFYQAKRDLFCDLLSASRFSFNRVSGTYFQLVDYSQIRPDLNDVDMAIWMTREHGVAAIPVSVFYQQPPQGQRLVRLCFAKREETLRQAAEKLCVI

SEQ ID NO: 5425 - protein, 246 aa, Rickettsiella grylli
MLLKNKVALVTGASRGIGAAIAIGLAKQGALVWGTATTESGAEKISQSFQEHGLHGKGWVLNINDDHAIKNLMDALQVVNLPNILVNNAGITRDNLLLRMKMDEWNAVLETNLSAIFKLTQLCLKPMLKARYGRIINISSIVGCTGNSGQANYAAAKAGLIGFTKALAQEVATRHITANVIAPGFIETDMTHQLNESHRTALLEKIPAKRLGSVEDIANACVFLASDWASYITGSTLHVNGGMYMN

SEQ ID NO: 5426 - protein, 291 aa, Sulfolobus tokodaii str. 7
MITVVGSYNVDFILKVDEFPNEGETVFAKEIYINHGGKGSNQAVSASRLKAKVRIIAAVGNDEFGKNAIRFWEDEGIDTAYVKIKNSVTGSAYIIVNSRGENVIVVNRGANALLNEEDIDNALSGDILLTQLEIDEKVVKKALKEFNGIKILNPAPAILKDFSILDYVDILTPNEIEFKELTNTDDIDSGIQLLLKKVKKAVIITLGERGALIATKHEKILVPTIKVNPIDTTGAGDVFNAALAVYLERNYDLRTAVRIANKLASYSTTIIGALGPRYEEVKNLIEEENEN

SEQ ID NO: 5427 - protein, 616 aa, Oryza sativa Indica Group
MHRFLVTALLFSLLNYEAVMATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPNTSNQGRKDYNASASTEFNESAKRITTFSEITFTWQLLISLMFASDCERQQRLCGFSSQRRTAFCKPHGSKSPAKVIIVAVSVPTIVVLTLVASALYLSLKTKNDDEIQLKVEMFLKTYGTSKPTRYTFSEVKRITRRFKHKLGTGGFGSVYKGELSKGVPVAVKMLENSKGEGEEFINEVATIGRIHHVNVVRLLGFCSEGTRHALIYEFMPNNSLEKYIFSRDYISSQEVLVPDKMLKIALGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 5428 - protein, 400 aa, Chlorobium tepidum TLS
MNTPAINLETEKQLFFHNYARLPLDIASGKGSFLYTASGERYLDMIAGVGVNAIGYGDKRLEQAITEQASKYIHVSNLFMQKPQFDLAAKLLEISRMSKVFFCNSGTEAIEAAIKLARRFAARNGDTDKTQVLSLTNCFHGRTYGALSLTAKPKYVDGFEPLVPETGMIDFNDVEDLERKVSNRTAAVFVEFVQGEGGIHKVSEAFIAKLKELAKEHDFLIVADEIQAGCGRTGAFFSYMPFDIQPDLVCVAKPLGGGLPLGAIIGSEKVAEVFTPGSHGTTFGGNPVACAAGLAMIEAILADGLMQNALEVGSMMRTAFEKMAEKHAQILEIRQYGLMIGVTVHREAKYYVEEALKRGVLVNATSNNVIRLLPPLSISKEEAQLCLDTLDAIFTEEAKA

SEQ ID NO: 5429 - protein, 206 aa, Borrelia garinii PBi
MAKIIGISGGSGSGKTTVVSKISEFIPEFVLISQDNYYKSVGDYEYEFSKVNFDHPDAFDNNLFYEHLKNLKKNSPIDMPLYDFINHKRQLKTVMVVPTPVIIVEGIMIFVEERVRNLIDLKIYIDTPNDIRFIRRLKRDISKRGRTLESVIDQYLNTTRWGYYRFIEPTKEYADLIIPEGGHNDKALYVLSTFLKSLSKEGLDFV

SEQ ID NO: 5430 - protein, 204 aa, Oryza sativa Indica Group
MATFKQSFLKNLLSSLKSSSKNKAAMSTLSERKRAIKSSADIAMATARTGIAGAARWPHAILASSSSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSNASSSSSGGLAQLKERTVQISGETENPC

SEQ ID NO: 5431 - protein, 439 aa, Chlamydomonas reinhardtii
MAQIARKRAAHFANFQDDDGGDDDDNIHAGGDQARTLGPWSSAMELVNARGKAQHDRQAKLQAAAEAEQEGEADAAAHWHPSRDPALGPHPRDPVRPLFGQCLDVLTAYIDCVESLWGVPDAIKVRLAAHVCARRKMSPEVLVPDCTQLDAAAMTDLLKELLSATPALRRLSVAQGSRFTSALLDKLPALVPQLTHLNLADCRGLGAEALAAALPRLQQLRSVRLDLIPEVDDAVLVALATRLPHLAELSLRCCQAVSDAGLRALAASARGPHLELLRIDECGGRVTDAGLAALASQCRALKVFSARRCAKLGDEALAELLRAGSVTHLCLSGVAGVGPAVADALAACCRESLEELDVSFCRKLPDRGLGLVLERCGKLRRLSVFGCSQLSAASLYGHSNAGLVIEGIHTKVVKQSLQTLTDQGRCPSFSPPSRLMAIS

SEQ ID NO: 5432 - protein, 459 aa, Synechococcus sp. CC9605
MALTQTQLSRMKELVGAGLTRPLAWRREQLQRLSALVEEHESEVLEALAADLGKPPTEAFFELVALRQELKLTGRQLERWMRPRRVAVPLSLRPGQAKVVPEPLGCVLIIGPWNYPFQLTLRPLISALAAGNTAVLKPSEHASVIADLIARLIPQHFEPEVVQVVQGDGAVAANLVAMPFDHIFFTGGGSIGRKVLEGAAAHLTPVTLELGGKSPAIVLEGADLTVGARRLIWGKGINAGQTCIAPDHLLVAPALRSPLLKAMEEARTEMYGADPLNSNELGQIINERQFNRLEQLLETARADGRILIGGEISREQRRIAPTVIRVNDRNDPLMAEELFGPLLPVLVLEDLTTALQEIRQGPKPLALYLFGGDEAQQQQVLTTTSSGGVCLNDVVMQAGVPQLPFGGVGASGMGSYHGQSGFDTFSHHKAVLKRPFRFDFKLRYPPYQVDLNLLKRLAG

SEQ ID NO: 5433 - protein, 616 aa, Mycobacterium sp. MCS
MALYRKYRPATFAEVVGQEHVTEPLSTALSAGRINHAYLFSGPRGCGKTSSARILARSLNCEQGPTPTPCGTCDSCVALAPNGPGNMDVTELDAASHGGVDDTRELRDRAFYAPAQSRYRIFIVDEAHMVTTAGFNALLKIVEEPPEHLIFVFATTEPEKVLPTIRSRTHHYPFRLLAPKTMRTLLERICADEGVSVDDAVYPLVIRAGGGSPRDTLSVLDQLLAGAAGNRVEYGRALALLGATDVALIDDAVDALAAGDAAALFGAVESVIDAGHDPRRFAVDLLERFRDLIVLQAVPDAAARGVVDAPGDVLERMRDQAARLGSATLTRYAEVVHAGLGEMRGATAPRLLLEVVCARLLLPSASDTESALLQRVERIETRLEMSIPASDMPAAARPVEPAKTFTRRSQVADAPAPAPAPVEIRPEPPAPPVAPPPAPAPPPSPPPVRPPAEPVVEAPAAAPPPAAGAPNAAAVRSMWTTVREKVRQRSRTIDVMLAGAIVRTVEGDTLVLSHESAPLAKRLVEQRNSDVIREALKDALGVDWKIRCEAGGGPAPAVVAEPARPAPVADPPPPEDDEESMLAEAVREEAGPRRDPEEAALELLQNELGARRIDGS

SEQ ID NO: 5434 - protein, 525 aa, Synechococcus sp. CC9605
MADHQVDLLVIGAGASGASVAYEATRRGLSVALLEAGDIGGGTSCRSTKLLHGGVRYLELAFKSLDLAQLRLVREALLERSHWLTQAPFLARRLELALPTQQLWGQAYYRVGLGVYDALAGQRSIGHSRLLSQQQMRQALPLLKACQGGVAYSDGQFDDARLNLLLALTAEQQGATLRTRCRVVELETGGMGQLKAAISESATGQRERWCASAFVNATGIRADEIRQMAEADAPPRMLTSRGAHIVLEQNLCPKGVGLLVPSTADGRVLFMLPFHGRTLVGTTDEACSKENATSPSPEEEAYLLNYVRDWFPQLQGPKVSSRWAGGRPLLKPADQGLDSSRVVREHEVETLACGLVSVMGGKWTTCRPMAEDTLTAVERQLGRALPPPEPMPLRGATESLQATLDGLQRQKHQLEALLPDTALRTAQVAHLQSTYGLDGLALIERAEPSRREPISPVIPLCGAELDHAIQREHARSSSDVLARRCRLAMVDLNEAERLRPQVEALLDQAAVAAGSTSPINHQLNP

SEQ ID NO: 5435 - protein, 497 aa, Pisum sativum
MAKHDELPIPIYDNLEPVYGGDSSLEEAQLRFDTLKSKFIEIFGDAPQLFARSPGRVNLIGEHIDYEGYSVLPMAIRQDTIIAIRKNESEKVLRIANVNDQKYSICTYPADPLQELDLKDHKWGHYFICGYKGFYDYAKLKGVDVGEPVGLDVVVDGTVPTGSGLSSSAAFVCSSTIAIMAAFDVNFPKKEIAQVTCDCERHIGTRSGGMDQAISVMAKTGFAELIDFNPIRATDVQLPSGGTFVIAHSLAESQKAVTAATNYNNRVVECRLAAIVLGIKLGMKPTEAISKVTTLSDVEGLCVSFAGTKNSSDPVLAVKEYLKEEPYTAEEIENITGENLTSFLNINASYLEVIKAAKQYKLHQRAAHVYSEAKRVYAFKDVVSSNLSDEEKLNKLGELMNESHYSCSNLYECSCPELEELTKISRDNGAFGARLTGAGWGGCAVALVKENIVPQFILNLKEYYYQSRIDKGVIKKNDLGLYVFASKPSSGSAIFKF

SEQ ID NO: 5436 - protein, 221 aa, Brassica napus
MPKRTTHTYSSEDAAPEGPDSDLFVYYCKHCGSHVLITDTQLQKMPKRKTDRSSVLDKKKHLARLNVSEGGKVLLKRGEGKLERQFRMNCIGCELFVCYRADESLETAAFVYIVDGALSAVAAETNPQDAPVPPCISQLDGGLVQVAIEVEDRAQRSAITRVNADDVRVTIAAPAARGEANNELLEFMGRVLGLRLSQMTLQRGWNSKSKLLVVEDLSARQ

SEQ ID NO: 5437 - protein, 282 aa, Synechococcus sp. RS9916
MATYGVIGCGYVGSDVAVLMKAGGHHVVGTTRSAERIPELQELVHEAHQVDLTDPDGDLSFVDDLDGLLISVAPTQQGEGYRSVFAQGISRLGRALRRRTSHRPLHVTLISSTGVYGDQQGQAVDEESRLDTSNPINALLAAAEDQLLSIDRPDTGICVLRLGGIYGPGRDMVAMIQRAAGQQVPKNGNAVPAWSGILDITQGVAFAFRHNLRGIYNLVDDMQLSRRELSTLICDRDGLPPVLWGHSEPNGSRMLNARVSNRKIKDAGFRFSSPSMLEAVKV

SEQ ID NO: 5438 - protein, 533 aa, Zea mays
MVRFGNFTDVLFYIEIRFPHFYARNLLLLTSSPRTEINPLNLSDKSTYLNPSKINAGNRPTTHLNSKGWENVIALFQAKTQKNYGKPQLKNKWDTLKKEWRLWRELLKESTGIGWCPSKKMVDATEEWWAKKIQENPDFKGFKKKGIEPQLNELIWQMFGGIVATGENAWASFSSVLPSGVPIGDDTPNEGFGDSDEHSNENGGIPPNEVMDEINNMFNSFDMNYDIPELSEEAQRRIATIVTQVEHNNYHEEEEYVLSSVLVHHKTYFTMQPRMDSNYTGQIWVDEVLNGHDDRCMNSFRMPKNIFHSLLHDLQTNYGLKHGKVSAMEKLALSLYILGNRESYSNATKRFQRSGETVSRIFTDMLHIFARMGIDTIKPTEGQFEEVPNHIRHDTRYWPHFKDCIGAIDGTHIKACISPSCQIPYIGRKGKYYLVDSGYPQMAGFLGPYRGNDIIYLIFVELKKLMKVQVIKTNDLLYRFVLEFLLKRILKVPEIRARVLLFVSAFLGRRGITNVWKKRRSIMDKDLRGIGLE

SEQ ID NO: 5439 - protein, 490 aa, Mycobacterium sp. MCS
MAGRWRTKSVEQSIADTDEPGTRLRKDLSWWDLTVFGVSVVIGAGIFTITASTAGNLTGPAISISFVLAAIACGLAALCYAEFASTVPVAGSAYTFSYATFGEFVAWIIGWDLILEFAVAAAVVAKGWSSYLGTVFGFGGGVANFGGFEVDWGALVIIAVVTLLLARGTKLSAEVSLIITVIKVAVVLLVVIVGSFFIKAANYSPFIPPAESGEGGTGTEQSLFSLITGAEGSAYGWYGLLAGASIVFFAFIGFDIVATTAEETKNPQRDVPRGILSSLAIVTVLYVAVAVVLSGMVSYTELRDAGSGANLATAFAANGVDWAATVISIGALAGLTTVVIVLMLGQTRVLFAMSRDALLPRQLAQTGEHGTPVRITVIVGVVVAVAATVFPIGKLEEMVNIGTLFAFVLVSAGVIVLRRTRPDLKRGFKAPFVPLLPIAAIIACVWLMLNLTGLTWIRFLIWMAIGVVVYFLYGRRHSLVGRREQEAVTE

SEQ ID NO: 5440 - protein, 220 aa, Fulvimarina pelagi HTCC2506
MSEVLIAPSILSADFARLGEEIRAVDEAGADWIHLDVMDGHYVPNITFGPPIIKAVRGASKKVFDCHLMIEPCDPYLQAFAEAGCDVITVHAEATTHLARSLAAIRDLGVKAGVSLNPSTPESVIEYVIDQVDLILLMTVNPGFGGQKFIHPVVEKVRRVKRMIGDRDIRIEIDGGVTTETAPLVVAAGADVLVAGSAVFKGGTPKSYAANMKAIREACS

SEQ ID NO: 5441 - protein, 460 aa, Yersinia pestis KIM
MTGYLMETTLMTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 5442 - protein, 388 aa, Thermotoga sp. RQ2
MEELREAFEEGKPVILIDRNRENEADFVFPAQLITEDVVNFFVTYGKGLFCVTADEEDLLKRGFVKLSSNYGANYFVPVDWGTGTGISALERAETCRKLAEGRYFHEFRYPGHVTVIGGIGFQRRKGHTEASLEISELAGFSRHAVIVEILDEKGNSHNLDYVLKLSEKFSLPVLEMDDVWREFVKRKLLMKKKAEATLPTDFGVFKVVSFENHLDGKEHFAIVKEPLEDPVAVRIHSECVTGDVLSSLRCDCGSQLANFLRYMSAHGGILIYLRQEGRGIGLSNKIAAYSLQDKGLDTVEANRVLGFSEDERDYAPAVQILKALGIERVLLFTNNQRKTVGLEKYGIEVVETKRLYGRVTPHNRFYLSTKMKKLGHELEEIFREVNS

SEQ ID NO: 5443 - protein, 291 aa, Fulvimarina pelagi HTCC2506
MSAKHPIIATTGSSGAGTTSVKDIFDQIFRRENVDAAFIEGDAFHRYDRDAMRVKMATETASGNTTFSHFSPEANLLEDLRDVFDEYGRKGTGRTRHYIHDDREMERYGLPEGKFTEWKPLHENSDLLFYEGLHGCVKTDTIDLARYPDLKIGVVPVINLEWIQKIHRDKSTRGYSTEAVMDTILRRMPDYVKYICPQFGQTDINFQRVPIVDTSNPFIARWIPTPDESMIVIRFANPRGIDFPYLLSMIPHSFMSRANSIVAPGAKLDIAMQLILTPLILKLMERKRRAS

SEQ ID NO: 5444 - protein, 345 aa, Fulvimarina pelagi HTCC2506
MPSSLDAHLRSALDADEGQRRIAEAIRHLCTASVKVRNQIIEGGSNLGEQRGDTNTDGDVQKELDVLADRAFLQAAKDSGFMFFGSEEQEGPVTLDENGDFAIAIDPLDGSSNISTNVSIGTIFSILPVSDANRADPKTVFMQKGANQLAAGFFVYGPQLQLVLTVGDGTHVFLFSPKFGGFVEQTASVTIADKAKEFSVNMSNYRHWDTHIRNYVDDLLAGEEGPRERDFGMRYVGSLVADAYRILQRGGVFLYPSDGRKGYQNGRLRLMYEANPVAMLVEQAGGAATDGTTRILDIEPEGLHVRTPLVFGSKREVERIGRYIADPDALAERSPLFGKRTLFRP

SEQ ID NO: 5445 - protein, 299 aa, Burkholderia pseudomallei K96243
MSEPIDLSQISPALKAEILAEALPYIRRYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKLMMPDRDNPGEYVDIGQVGEVEAINPAVVKALQDDAFIPVISPIGFGEDGLSYNINADLVAGKLATVLNAEKLVMMTNIPGVMDKEGNLLTDLSAREIDALFEDGTISGGMLPKISSALDAAKSGVKSVHIVDGRIEHSVLLEILTEQPFGTMIRSH

SEQ ID NO: 5446 - protein, 210 aa, Brassica napus
MSSLSTSLSSSSPFLSNHSSLINSDPSRRSLSFPQGINLDDLCVRSKRKLVQSSVAGGDGSVITKSSSAEIKTGPLSIPSQEAADKLVIESNGGEQQSTVSITVVGASGDLAKKKIFPALFALYYEGCLPEHFTIYGYARSKMTDAELRDMVSKTLTCRIDKRENCGEKMEEFLKRCFYHTGQYDSQEHYVTLDEKLKEHEGGRLSNRLF

SEQ ID NO: 5447 - protein, 239 aa, Robiginitalea biformata HTCC2501
MNKTASESEALLDELAAKLPDCSAEVMVAPVFVNLAEAVRRLEHSKIEAIAQNMHFADSGAYTGEVAADMLLGIGVDTVILGHSERRAYFGEDDDLLAKKVGQAIEKGMRTIFCFGEELKDRQAGKHFEVVESQLKNALFQLPEEAWGRIVLAYEPVWAIGTGETASPEQAQEMHAFIRKIVSDAYTDAVAQKVSILYGGSVKPGNAAEIFSKPDVDGGLIGGASLKADDFVAIIKAIG

SEQ ID NO: 5448 - protein, 462 aa, Geobacillus kaustophilus HTA426
MEQKQPQLHRGLEERHISLMSLGAAIGVGLFLGSASAIEMAGPAILLGYAVSGAIMFFIMRALGEMAVEHPVAGSFSRYAYQYLGPLAGYLTGWNYWFLWVVTCIAEITAVGIYMQFWFPDTPRWAWALAALVLMTFINFLAVKAYGEFEFWFALIKIVTIVAMIIIGLGMILFGIGNGGVATGISNLWKHGGFFPHGISGVLMSLQMVMFAYLGIEMIGVTAGEVKNPQKSLTKAINSVFWRILIFYVGALFVIMSIYPWNEIGEKGSPFVLTFEKIGIHAAAGIINFVVLTAALSSCNSGIFSTSRMLFNLAEQQEAPSAFGRLTKRGIPGAALIATALVMLVGVYLNYVSEKVFQWVTSIATFGAIWTWAVILLSQLKFRKQLSAEQAQRLTFKLPLYPYSSYVSLAFLIGVAALMAYFPDTRIALIIGPAWLLLLTAVYFAKGMHRRQHGQAEEKQAG

SEQ ID NO: 5449 - protein, 448 aa, Yersinia pestis KIM
MMNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 5450 - protein, 482 aa, Mesorhizobium sp. BNC1
MEIALLIKGEDRPALGGGTFDRKNPVTNEVVTTAPAAKKVDVDAAVAAADAAFADWSKTGPNARRTLLNKAADMLESMADEFVRTSIDEIGCTAAWAGFNVMFGAKILREAASMTTQIRGEVIPSDKPGCLAMAIKRPVGVLVGMAPWNAAVILGVRAVAMPIACGNTVVLKASEKCPRVHMLIGEAFRRAGFPDGVLNVVTHSPQDAPEVVEALITHPKTRRINFTGSTRVGRIVAEIAARELKPCLLELGGKAPLVVLDDADIDAAVNAAIFGAFMNQGQICMSTERIIVDERVADDFVAKFTERASQLPVGDPNGNVVIGSVVDYETIERVDKLVDASVALGARVTTGGKSNGSTIMPATVVDHVNETMPLFSDESFGPVVCVVRARDTEHAVEIANASSYGLSSAVFGSDINRAISVAERIEAGICHINGPTVSDEAQMPFGGMRDSGYGRFGGTAGIDAFTETRWITVEDPHQHYPF

SEQ ID NO: 5451 - protein, 305 aa, marine gamma proteobacterium HTCC2143
MAHAKKFGSRTDSDQVLDGLDLTGKKVVVTGANTGIGYETARSLAVAGAEVVVACRSEDKGKSAVDAIQKCHNDVRVEFKKLDLSSIESVKAFSENLSWDTIDVIIGNAGLVPTNYQQTDEGIEQCVGVCHFGHFALCKLLLPRLLKSKDPRVVMVSSESHRAPKKLNFKKFPLTKTNFAVFTAYGQAKLCNVLFVNELQRRFGDQGLNACSLHPGTLITTDIGRNSGLFSLLMTLISPLTKTPNQGASTTVYCAAYINGKDMQGAYFSHCKRGKSSAEANDPEVAKHLWDISEAFCEEHNVANI

SEQ ID NO: 5452 - protein, 425 aa, Burkholderia pseudomallei K96243
MHTVTLKPSKDKSLLRRHPWVYANAIDCVDGKPAPGATVIVRAHDGRFLARAAYSPHSQIRLRVWSFDENEPIDHAFFKRRVQRALAHRRAMISGTDAVRLVFGEADGLPGLIVDYYVAARGAAHTGDAAARAAEGGAAAPVAPGDGEGRGQLVCQFMAAGVEHWKGAIVAAIVAATGCPNVYERSDVSIREKEGLEQTTGVLAGDAPPDTLIANENGVLYHVDVRNGHKTGFYVDQRENRALVAQYARDRDVLNCFCYTGGFSLAALKGGAKRVVSIDSSGDALALAQRNVAANGFDAARAQWLDADAFKTLRRLVDEGERFDLIVLDPPKFAPTRDSVDRAARAYKDVNLSGLKLLRPGGLLFTYSCSGAIDMDLFQKIVAGAAADAKVDARILKRLGAGVDHPLLTAFPEGEYLKGLLLQIA

SEQ ID NO: 5453 - protein, 141 aa, Pseudomonas fluorescens Pf-5
MAVQRTFSIIKPDAVAKNVIGKIVSRFEEAGLRVVASKMKQLSKAEAEGFYAEHSERGFFGELVAFMTSGPVVVQVLEGENAIVRNRELMGATNPKEAAAGTIRADFAESIDANAVHGSDSEAAAAREIAYFFAATEVTAR

SEQ ID NO: 5454 - protein, 398 aa, Mesorhizobium sp. BNC1
MVVSTQNPIFIPGPTNIPEVLRKAVDMPTIDHRSPLFGKILHPAIEGVKKVLKTKQAKLFVFPSTGTGGWETAITNVLSPGDKVLATRNGMFSHRWIDMCQRHGLDVIVVPQDWGESVPADRFEEILAADKAHKIKAVLATHNETATGVRSDIAAVRHAMDAAAHPALLLVDGVSSIASMDFRMDEWGVDIAVTGSQKGFMLPPGLAILGFSPKALEAVEAAKLPRTFFDIRDMARSYANNGYPYTPPVGLLNGLKIASEMLLEEGMENVFARHHRIAEGIRQAVAAWGLRLCAVRPELYSDTVSAIRVPDGFDGNRVVAHALNVYGVAFGTGLGDVAGKVFRIGHLGSLTDVMALSGIATAEMVLVDLGLPIKLGSGVAAAQEHYRLSAGNAQKRAA

SEQ ID NO: 5455 - protein, 651 aa, Chlorobium tepidum TLS
MLEVRNLSLSAGTKVLLRNTSFRIGDKDRASLVGLNGTGKSTLLRLLSGQLKEDGPISEGQIMKSSTTTIGYLPQEISFEGDLDKTALQYALEANKTLHELSEKISRMEHELALPDQDHASDEYHKLIERFSDASQDFERLGGYRMQSDAEKILSGLGFGSADFYKKVKEFSGGWQMRLLIARLLLQNPTLLLLDEPTNHLDIDSLRWLEQYLLNYEHSYLIVSHDRFFLDKLTTKTLEIAFNEITEYKGNYSFYEKEKAERYTLMMSRYENDLKKMADLKSFVDRFRYKATKARQAQSRLRQMQKLEKELQAPEEDLSQISFSFPKARPSGREVLRLEGVSKSFTLPDGTTKTVLKNIDLEIMRGDRIAIVGSNGAGKTTFCRILADEIDFEGKRQTGHHVSMSYFAQHQTDNLAPEKSILQEMMDAAPTSEAQRRVRDILGCFLFSGDAVEKKIAVLSGGEKSRVALAKILLQASNLLIMDEPTNHLDMRSKEMLIDSLENYDGTLLIVSHDRYFLDSLVNKVFEIKNGGVQVYLGTYAEYLEKAEKSWEEEKKQQAEAQAKEEAARKAATAKSVEKKPAAPKANSKKIAAIEKEIQRLEESKKQHEDMMAQPLFYEQSAEETHKAIAEYEELCKELDALYQCWEDEAG

SEQ ID NO: 5456 - protein, 558 aa, Synechococcus sp. CC9605
MALIHGLHQRNIRGDLLGGLTAAVVALPLALAFGNAALGPGGAIYGLYGAIVTGFLAALLGGTPAQVSGPTGPMSVTVAGIISSLAAIGISRDLNAGEMLPLVMAAVVIGGVFEALLGVLRLGRFITLVPYSVISGFMSGIGFIILVLQLGPFIGVSTGGGVVASLGSLIEAQSWNPAALAVGLMTLAVVFLTPLRIRQWVPTPLLALLLVTPLSLVLFNDNRLLELGLEPIARIGAIPEGGLQLVVPDFSQHLPELVKAGMVLALLGAIDSLLTSLVADNITQTNHDSNRELIGQGIANTAAGFLSGLPGAGATMRTVINIKSGGQTPWSGMTHSLVLLLVLLGAGPLAAQIPTALLAGILIKVGLDIIDWGFLLRAHRLSAKTAALMYAVLLMTVFWDLIWGVLVGMFVANLLTVDAITRSQLEGMEEDNPSDATDARHANLSLQEEALILRCGKSLMLFRLRGPLSFGAAKGISARMGLIQSYSVLILDLTDVPRIGVTATLAIERMVEEARSAGRTLFIAGANKTLEQRLRQFGVEGVLRPSRLEALQEAAQLI

SEQ ID NO: 5457 - protein, 128 aa, Pseudomonas fluorescens Pf-5
MAYSEKVIDHYENPRNVGKMNAEDPDVGTGMVGAPACGDVMRLQIKVNEQGIIEDAKFKTYGCGSAIASSSLATEWMKGKTLDEAETIKNTQLAEELALPPVKIHCSVLAEDAIKAAVRDYKQKKGLI

SEQ ID NO: 5458 - protein, 370 aa, Sulfolobus tokodaii str. 7
MSFDPQKFVDEISPQLKEIVDGRAIAAVSGGVDSTTAAVLSYKILGDKVIPVMIDTGFLRENEAENVKNMLKDLMPLQVIDEREKFISSLEGMSDAEEKRKKFRQLFYDTLSRIVKEFNAKYLIQGTIAADWVETQGGIKTQHNVLVQLGIDTEKEWGFKVVEPLADLYKDEVRALAKYLGLPRDIYNRQPFPGPGLLVRVVGKLTREKLEILRKVTTTVEKNLSELNLSQYFAVIFDSAAEYNKELSNEVGCDVKVYKTLATGVKGDVRAYGNIAGIECRKDYESLREIMEKLTSYNITHVVVKIKDKNPEGIYTIGIRAVNTQDFMTADFAKINWNILEKIANEINDKKIKEVVYDITTKPPATIEYE

SEQ ID NO: 5459 - protein, 1285 aa, Oryza sativa Indica Group
MPSGRPVFVGPCLGRGCSLWAGKARIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHSGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTTSERRDRHDDSSRKRHRSLSRSRSPPRRSLERDREHNRNRDTDRSHGNDAGRERDRLINMGIYLSTPKTDKFSEDGENDKLKFGLSSMQGWRASMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSYSNNGQDDWSFEEAYNLSRDHKPELEAERDRIVKAGGFIHMGRINGSLNLTRAIGDMEFKQNKFLPPEKQIVTANPDINVVELCDNDDFLVLACDGIWDCMSSQQLVDFIHEHIQKESSLSAVCERVLDRCLAPSTIGGEGCDNMTMVLVQFKKPITQNKKADVGEQSAKGVEEAEIK

SEQ ID NO: 5460 - protein, 332 aa, Oryza sativa Indica Group
MAKFVITKKLIILHIREYLQEGAQGFFFDMSWAAIENDPGVFTELLQQMQLKGLQVDELYSLDLDALNDLQPVYGLIVLYKWQPPEKDERPIKDPIPNLFFAKQIINNACATQAIVSVLLNSPGITLSEELKKLKEFAKDLPPDLKGLAIVNSESIRLASNSFARPEVPEEQKSSVKDDDVYHFISYVPVDGVLYELDGLKEGPISLGKCPGGVGDIGWLRMVQPVIQERIDRFSQNEIRFSVMAILKNRREKFTLELKELQRKRENLLAQMGDPSANRHAPSVEHSLAEVAAHIELNKKIIMEKEVEEVEDREHQEEAQLCAILVQFPQDS

SEQ ID NO: 5461 - protein, 392 aa, Chlorobium tepidum TLS
MNIHEYQGKGILKQFGVAVPKGIVAFSAEEAKQAAEQLFEEQSSPVVVVKAQIHAGGRGKAGGVKLAKSPEEVFEIAQKMLGATLVTHQTGPEGKEVRRLLIEEGMNIDKEFYLGITLDRTTSSNVLMVSTEGGMEIEKVAEETPEKLLKIHVDPVYGLQGFQARKAAFFLGLQGEQFRNGVKFIEALYNAYTTIDASLAEINPLVITKEGRVLALDAKINFDDNALYRHSDFHDLRDITEEDPLEYEASKSNLNYVRLDGNVGCMVNGAGLAMGTMDLIQLSGGRPANFLDVGGGASSKTVEEGFKIILGDKNVKAILVNIFGGIVRCDRVAGGIIEAAKNIGLKVPVIVRLEGTNATEAQKMLDESGLNLISAKGLRDAAEKVQKALATA

SEQ ID NO: 5462 - protein, 133 aa, Sulfolobus tokodaii str. 7
MEEEIVKEYMKTQVISVTKDAKLNDIAKVMTEKNIGSVIVVDGNKPVGIITERDIVKAIGKGKSLETKAEEFMTASLITIREDSPITGALALMRQFNIRHLPVVDDKGNLKGIISIRDITRAIDDMFETMGEY

SEQ ID NO: 5463 - protein, 402 aa, Oryza sativa Japonica Group
MESRDSRYESSKAIPLNLLEDWSTPQAVNKTKSNRPFELRNLFLAGAVRAYGVGGWWLLCPWGILVDSYIIFFSEEGGFCGVESCAQASLPDSFLADLDELSDNEAYPEGEDEEARNMEEDGDGGMPCCEFLNHDDLNSASELHKTQRYNDIMQLLGAKKKNLSGFSTAASQFRVGYLEQTEVFQSTIPSLRTHACRIISAKSTLAARIDSIRGDPTGKAGHSLLEEICKKTEKLQELPPAKILKPLPVPDCMPKKKRGGCRLRKMKERYAQTDMMKLANRMQFGVPEESSLGDGLGKGYGLLGQAGSGKLRLLAGQSRLAAKVAKRFKARSCDRSESRSGLTSTLAFTPVQGMELSNPLVHNDHSVSGTQSTYFSDVGTFSSIRGKDAIPIQSSEIQNPGV

SEQ ID NO: 5464 - protein, 631 aa, Prochlorococcus marinus str. MIT 9515
MLLSELSHPNQLHGLTVSQLEEIACQIRERHLQVVSTSGGHLGPGLGVVELTLALYQTLDLDFDKVVWDVGHQAYPHKLVTGRFNEFDSLRQQKGIAGYLKRSESIFDHFGAGHASTSISAALGMAIARDAKGENHKCVAVIGDGALTGGMALEAINHAGTLPETPFLVILNDNDMSISPPVGALSTYLNKVRLSPPLQFLSNSVQESVKNIPLIGKDLPEELKTIKGSVRRLAVPKVGAVFEELGFTYMGPIQGHDISNLINTFNAAHRLKKPVLVHVVTTKGKGYPYAEADQVGYHAQSSFNLTTGKSIPSSKPKPVSYSKIFGQTLLKICEQDSKVIGITAAMATGTGLDLLQKNIPEQYIDVGIAEQHAVTLAAGMSCDGLKPVVAIYSTFLQRAFDQLIHDVGIQNLPVSFVLDRAGIVGADGPTHQGQYDISYMRSIPNFVLMAPKDEAELQRMLITSINHKGPTALRIPRGSGRGVAVMDEGWEPLNIGEGEILEDGEDILIVAYGSMVSSAIETSKLLKDKNISPCVINARFVRPLDKDLILPLANKIKKVVTMEEGTLIGGFGSAIVELLNDNDINIPVFRIGIPDVLVDHASPDQSKTQLGLMPNQMSENIINRFNLIKNF

SEQ ID NO: 5465 - protein, 513 aa, Prochlorococcus marinus str. MIT 9515
MEDYFKKILQAQVYEVAKKTPLEKANNLSKALKNNIFLKREDLQDVFSFKIRGAFNKMRQLTPSQLTNGVITSSAGNHAQGVALSALKLNCSATILMPITTPLVKVNAVRNLKAKVILFGDNYDEAYKEAIRISEENNLCFIHPFDDTDVIAGQGTIAIELEQQLQDPPEAIYIAVGGGGLIAGISIYIKKIWPKVQIIGVEPEDAAAMSKSLKRLEIIELSSVGQFADGVAVKKVGEKTFEIGKTHIDKMITVNTDEICSAIKDVFEDTRSILEPAGALSIAGMKKDIYESNYINKNMIAIACGANMNFERLRFVAERAALGEYKESMFAVEIPEKAGSLIDFCSLLNTRNLTEFSYRMSNSINAQIFVGIEVNGVNDKEKLLNEFRKSNYPFIDISKDELSKNHLRHMVGGRLPQKFTKLDNSKHIELLYRFEFPERPGALINFLKKMKTNWTISIFHYRNHGSDVGKIVIGVLIDNAEINYWNKFVEFLGYKYWDETNNPTYKLFLGASE

SEQ ID NO: 5466 - protein, 151 aa, Phaseolus vulgaris
ARAGTPWPGNNTRDHPGMIQVFLGQSGGLDTEGNELPRLVYVSREKRPGFQHHKKAGAMNAPVRVSAVLTNGPFLLNLDCDHYINNSKALREAMCFMMDPNLGKNVCYVQFPQRFDGIDRNDRYANRNTVFFDINLRGLDGIQGPVYVGTS

SEQ ID NO: 5467 - protein, 596 aa, Prochlorococcus marinus str. MIT 9515
MSNIDLKRRTKIVATIGPATQSEEVITDLIKAGVTTFRLNFSHGDHKDHEERIKTIRKVSKNLDLDVGILQDLQGPKIRLGRFKDGPVKVKKGDKFTLTSNEVECTKSIANVTYNRLAQEVTEGKRILLDDGKIEMIVEKVDLPNNLLKCKVTVGGVLSNNKGVNFPDVQLSVKALTDKDIDDLEFGLTAGVDWIALSFVRNPSDINEIKNLINKSGQSIPVIAKIEKFEAIDQIDSILPLCDGVMVARGDLGVEMPAEEVPLLQKELIRKANTFGIPIITATQMLDSMASNPRPTRAEVSDVANAILDGTDAVMLSNETAVGDYPVEAVETMATIARRIERDYPLKAIESNLPSTIPNAISAAVSNIARQLDAGAIIPLTKSGSTARNVSKFRPPTPILATTTEKSVARRLQLVWGVTPLLVKSDDRTARTFSIAMQIAQEMGILKQGDLVVQTAGTLTGISGSTDLIKVGLVRKVITRGISIGEIGVTGKARNIETSLDLSLITHGEILFVSKNLLKDLPYSKKITGIVTDETVDECYKIFKKNKIKISSICNLSTIDNQVTNGDVITLQLNEGVIYMGQIEEDEEALDRYKYV

SEQ ID NO: 5468 - protein, 87 aa, Phaseolus vulgaris
QKTIIFLINNGGYTIEVEIHDGPYNVIKNWNYTGLVDAIHNGEGKCWTTKVSFLKLTSNFIDATWGVEYLVFIHSCMVHLRCSVKRS

SEQ ID NO: 5469 - protein, 214 aa, Pseudomonas putida
TDPSYAQQIVTLTYPHIGNTGTTPEDAESNRVWSAGLVIRDLPLVASNWRNTMSLSDYLKANNVVAIAGIDTRRLTRILREKGAQNGCIMAGDNISEEAAIAAAQGFPGLKGMDLAKVVSTKEKYEWRSTVWDLKTDSHATIEASELPYHVVAYDYGVKVNILRMLVERGCRVTVVPAQTPAAEALALKPDGVFLSNGPGDPEPCDYAIQAIKE

SEQ ID NO: 5470 - protein, 347 aa, Glycine max
  misc_feature (170)..(170): Xaa can be any naturally occurring amino acid
MSTFGAAANTNPNKSYEVAQPPSDSISSLCFSPKANFLVATSWDNQVRCWEITRNGTVVNSTPKASISHEQPVLCSAWKDDGTTVFSGGCDKQVKMWPLTSGGQPMTVAMHDAPVKDIAWIPEMNLLASGSWDKTLKYWDTRQSNPVHTQQLPDRCYAITVKHPLMVVGXADRNLIVFNLRNPQTGYKRIVSPLEYQTRSVAAFPDQQGFLVGSIEGRVGVHHLDDAQQNKNFTFKCHRENNEIYSVNSLNFHPVHHTFATAGSDGAFNFWDKDSKQRLKAMQRCSQPIPCSTFNNDGSIFAYAVCYDWSKGAENHNPATAKNYIYLHLPQESEVKGKPRAGATGRK

SEQ ID NO: 5471 - protein, 460 aa, Anabaena variabilis ATCC 29413
MLTIETSKIREIIQQERNFFQTGQTKNINFRLEQLKKLRKLVTDNETAITKALKADLNKSEYEAYFAEIGVIKEIDYAIKNLKNWSKPKKADVPLDFFSYSARIYPEPLGVVLIICPWNYPFGLIISPLVGAIAAGNCAIIKPSELAPHTSNLVAELISKYFSSEYLTVVEGGAETSQELLAEKFDHIFFTGGTAIGKVVMEAAAKHLTPVTLELGGKSPCIVDSEIHLEYTAKRITWGKFINAGQTCIAPDYLLVNQKIKKDLIAAIQKSLTEFYGDNPIDSPDYGRIISHRHFERLAKFLNNGQVIVGGETNYEDKYIAPTLLDNISVTDPVMQEEIFGPILPVIEYTEIKDAIALINSQPKPLALYIFSQNKDLQQQILQETSSGGVCINDTIMQVGVSSLPFGGVGDSGIGSYHGKASFDTFSHYKSVLKNAFWLDLDWRYAPYKDKLSLLKRMMK

SEQ ID NO: 5472 - protein, 258 aa, Pseudomonas fluorescens Pf-5
MFERLREDIQSVFHRDPAARNAFEVLTCYPGMHAIWIHRLSGALWGMGWKWLARLVSNFGRWLTGIEIHPGAKVGRRFFIDHGMGIVIGETAEIGDDVTLYQGVTLGGTSWNKGKRHPTLEDGVVVGAGAKVLGPFTVGAGAKVGSNAVVTKAVPAGATVVGIPGRIIMKSNDEQEAKRKAMAEKLGFDAYGVSEDMPDPVARAIGQLLDHLQAVDGRLEGMCGALKDLGSDYCAKDLPALREEDFAEVKGKGDSQVG

SEQ ID NO: 5473 - protein, 235 aa, Brassica napus
MVMGKALYSVGFWIRETGQALDRLGCRLQGKNHFREQLSRHRTLMNVFDKAPSVDKQAFVAPSASLIGNVHVGPASSIWYGCVLRGDANSISVGAGTNIQDNTLVHVAKSNLSGKVLPTLIGDNVTIGHSAVLHGCTVEDEAYIGASATVLDGAHVEKQAMVESGALVRQNTRIPSGEVWGGNPARFLRKVTEEEKAFFSSSAVDCSNLAQAHAGENTKNLDETDFKKLLLQKTL

SEQ ID NO: 5474 - protein, 498 aa, Mesorhizobium sp. BNC1
MEEIGHFIGGKRVAGKSGHSQNVMQPMDGTVRATVALASAAEVREAVENAKAAQIAWGATNPQRRVRVLMKFLELVHKEYDSLAELLAREHGKTILDAKGDIQRGLEVVEVCIGAPHMMKGEYTEGAGPGIDTYSMRQPLGVVAGITPFNFPAMIPLWKIAPAIACGNAFILKPSERDPGVPMRIAELFVEAGLPAGVLNVINGDKEAVDAILDDPDIQAVGFVGSTPIAQYIYGRATANGKRAQCFGGAKNHLIIMPDADLDQTVDALIGAGYGSAGERCMAVSVAVPVGKETADRLVEKLIPRVESLKVGPSTDASADFGPLVTKEALERVKGYVDIGVKEGAKLVVDGRNFKMQGYENGFYMGGCLFDEVTPEMRIYKEEIFGPVLSVVRANNYEEALRLPNDHEFGNGVAIFTRDGDAARDFAARVNVGMVGINVPIPVPIAYYTFGGWKASAFGDLNQHGPDAFRFYTKTKTVTSRWPSGIKDGAEFVIPTMR

SEQ ID NO: 5475 - protein, 392 aa, Mesorhizobium loti
MRYPEHADPVITLTAGPVNAYPEVLRGLGRTVLYDYDPAFQLLYEKVVDKAQKAMRLSNKPVILHGEPVLGLEAAAASLISPDDVVLNLASGVYGKGFGYWAKRYSPHLLEIEVPYNEAIDPQAVADMLKAHPEITVVSVCHHDTPSGTINPIDAIGALVSAHGAYLIVDAVSSFGGMKTHPEDCKADIYVTGPNKCLGAPPGLTMMGVSERAWAKMKANPLAPRASMLSIVDWENAWSRDKPFPFTPSVSEINGLDVALDLYLNEGPEAVWARHALTAKAMRAGVTAMGLSVWAASDSIASPTTTAVRTPDGVDEKALRQAARARYGVVFSSGRGETLGKLTRIGHMGPTAQPIYAIAALTALGGAMNAAGRKLAIGKGIEAALAVIDADA

SEQ ID NO: 5476 - protein, 633 aa, Synechococcus sp. CC9605
MSLISLVGAAKDFGIRTLFSDLDLHIAEGERLGLIGPNGAGKSTLLKVLAGKEPLGEGERRCSPRLRVELVGQESRITPGLTVLEQVLEGCGAKRDLLVRFSALSDAIAADPSNEALMAELGQLSQRMDEEEAWSLEQQCREVLQKLGISDLQRPVDDLSGGYRKRVGLASALVACPDVLLLDEPTNHLDAAAVEWLQSWLDRYPGALVLVTHDRYVLDRVTRRMVEVDRGQARTYQGNYSTFLQHKAEEEASEAASVAKFKSVLRRELAWLRQGPKARSTKQKARLQRIEAMREQKPNQAKAKLEMTGISRRIGKQVIEAEDVGVTADGSQGGRPLLDGFSYSFSPEDRIGIIGPNGSGKSTLLDLIARRREPTQGSLLLGETVHIGYLDQHTEDFNKGKGLDRKVIEFVEEAASRIDLGGEQVTASQLLERFLFPPAQQHSPLAKLSGGERRRLTLCRMLIQAPNVLLLDEPTNDLDVQTLSVLEDLLEDFRGCVIVVSHDRYFLDRTVDRLFCFDQGRLNRFEGNYSAFLEQQRQEERSQTQASKPSSPKPERSSETKRDGPRRRNFKENKELAALDQQLPDLELQKEELEQQMTQEGADMAKLSLDLADLISRIEQAEERWLELSELAP

SEQ ID NO: 5477 - protein, 478 aa, Sulfolobus tokodaii str. 7
MKVAYGKKVVATQNYIASYVGAKVLENGGNAFDAAIAISATLSVVLPYTSGLGGDGFLLAKTPEGIIAYNGSGWAPKGLNVEKIPSPRHPSTVVVPGLVDLWNFLIERYTSMSTYELLKPAISLATNGFYVSKSLYKAIKNSSNMPESWIKTYGNLNAGDKVKLNEMGQVLKIIAKDPREFYEGKITEEIVSGLRKQGVNVDFSDFANFKGEEVKPLKTTYKDYTLYELPPNTQGISTLQALKLAELSNVNKFPYDDEKRINEHVKIYGIVYSDRNNYIADPRFYPLDVDLLDERYLRNRMKEFRVMIEKMNTQDTTFFVVSDGENEIGFIQSLFFAFGSGIVVKDIPFNNRGFGFTEGRNKPEPRKRPLHTLSILMAEKEDENLIIGCAGGDLRPQIHSQVFEYYADYGLEIDEAIDAPRFMFLGSRIVAEKRLKTKHEQLDYYSPEVGVVQALKSNKKYNIAVADPRSEGIALVAN

SEQ ID NO: 5478 - protein, 324 aa, Synechococcus sp. CC9605
MSIPPVVVTAARRSWRWQWQRLMGGLGPADAAGSYTRPSSNPLTPPALKPPDLLQRSAGQRPMLVIGRSCPWAHRTWLVHQLRHLHDSVTLVMARADHNAGRWALDPAWEGCKTLLELYQLCDAPPSYRATVPVLVDPKTRTLLGNDSAPLVDLLNRWPHHDEVVDLAPAEATDRIQAWQHRLQPAINDGVYRCGFARNQAAYDHAEADLFTALDAVEQSLESNGPWLCGEALTLADVRLFPTLIRWELVYAPLFGCSRQPLWHYPNLWKWRQRFYRLPGVADTCDGTAWRHDYFGALFPLNPSGIVPAGPDLSTLVNSTAASG

SEQ ID NO: 5479 - protein, 273 aa, Synechococcus sp. RS9916
MQIPIEQLAAFAEGPFTGNPAAVCVLDQWLPDALLQAIAAELNLSETAFVRCGTERHDLRWFTPRCEVDLCGHATLAAAQVMFGLAPERKALHFDTHSGALQVMRNGSPDNASLNNSPLLTLDFPVQHSEPCTAPDALIQGLGRVPESCYRGADWMAVLASEAEIRALRPDLQALEQLDGRGVIVTAPGEHVDLVSRFFAPKIGIPEDPVTGSAHCSLVPYWVQRLGKQSLHARQLSARGGTLHCQMHGTRVLISGRVVPFLRGTLHLPDPVT

SEQ ID NO: 5480 - protein, 274 aa, Oryza sativa
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRKYVAEKGVNPWIEVDGGVGPKNAYKVIEAGANAIVAGSAVFGAPDYAEAIKGIKTSKRPVAVPA

SEQ ID NO: 5481 - protein, 393 aa, Pseudomonas aeruginosa PAO1
MRYSDFTQRIAGDGAAAWDIHYRALARVEQGEEILLLSVGDPDFDTPAPIVQAAIDSLLAGNTHYADVRGKRALRQRIAERHRRRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCMAHDLWMISDEVYSELLFDGEHVSPASLPGMADRTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 5482 - protein, 286 aa, Coffea canephora
ELYSNNISGPIPSDLGNLTNLVSLDLYLNSFNGPIPDTLGKLSKLRFLRLNNNSLTGPIPLSLTNISSLQVLDLSNNRLSGAGPDNGSFSLFTPISFANNLDLCGPVTGRPCPGSPPFSPPPPFVPPPPIATPGGNSATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVIPYMANGSV

SEQ ID NO: 5483 - protein, 383 aa, Arabidopsis thaliana
MRRAINLINRNPRPYDIAADQSSLLFSSLPYDVVLNCLARVSRRYYPNLSCVSKSFQSLVRSPELAHMRSLIGKDDPVVYVCFSDTKPFLGRRLDWFTLNPNEKKTSVLNSFQVFSYYMLYCPSVSIGSKIYFVGGCMYKCLPGLLIFDSWSGELCVGPSMKEARMLPGVAVVNGKLYVMGGCREDQIQVEVFDPNSQTWEVGPLSSDGEVRYGKGLMRYGAIVTEAVALEGKVYCMSYKDGSHIIYDTKDGKCETFLMADGKAWRRGGVCVVNSVIYVYYINLGVMWYDPKDKVWREVKGLNKLDYKSIDMVGMVDCNGKLGFLWGNNTREIISGRTEKRIWCEMIVLERSGVEIHGTVEWSDLVGFVPHDYEIWRCLGVSY

SEQ ID NO: 5484 - protein, 394 aa, Prochlorococcus marinus str. MIT 9515
MTETKLISTINEENLPLLGKTYVPSRLLLGPGPSNAHPEVLKALSLNPIGHLDDAYIELMSDVQKLLRYTWQCNNRITLPMSGTGSAAMEASIANFIEPGEKILIARKGYFGDRLVDMASRYKAEVSVIDKEWGEAFTFEEIKYEIETNKPAIFAIVHAETSTGVLQPLEGIGDLCRENNCLFLVDAVTSLGALELYIDKWKIDLAYSCSQKGLSCPPGLSPFTMNKRAEDKLSSRSSKVPNWYLDLSLLNKYWGSDRVYHHTAPVNMNFAIREGLRLIANEGLKNIWERHNSNAIKLWKGLESLGMELHVSSENRLPTLTTVKIPSRVDGDAFRNHLLKNFGIEIGNGLGSLSGKVWRIGLMGFNSSDENVDRLLNLFDTELKKFTIFDSSTF

SEQ ID NO: 5485 - protein, 473 aa, Prochlorococcus marinus str. MIT 9515
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGAPYDRCPRSLAQKALSYLDSTGIADTAFFGPEPEFFLFDDVRYDSKEGGCFYSVDTNEAPWNTGRTEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHVHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPAEELAKIDTVPSSLNDSLNALKTDKDYLLAGGVFTEDFIDNFIDIKYEEVQQLRQRPHPHEFFMYYDA

SEQ ID NO: 5486 - protein, 323 aa, Brassica napus
MASCLQASMNSLLPRSSPPLSLNSSGRRNSKAFRVKAAAKIPMPPINPNDPFLSKLASVAAQSPERLIARPLNADTPPYLDIFDSPQLMSSPAQVERSVAYNEHRPRTPPPDLPSMLLDGRIVYIGMPLVPAVTELIVAELMYLQWLDPKEPIYIYINSTGTTRDDGETVGMESEGFAIYDSLMQLKNEVHTVCVGAAIGHACLLLSAGTKGKRFMMPHSKAMIQQPRVPSSGLMPASDVLIRAKEVITNRDILVGLLAKHTGNSVETVANVMRRPYYMDALKAKEFGVIDKVLWRGQEKIIADVVPSDEFDKNAGIRSAERV

SEQ ID NO: 5487 - protein, 215 aa, Phaseolus vulgaris
RLSYGYSSFKGKRSSMEDFFDTTISEVDGQMVAFFGVFDGHGGSRTAEYLKNNLFKNLSSHPDFIKDTKTAIVEAFKQTDIDYLNEEKGHQRDAGSTASTAMLLGDRIVVANVGDSRVVASRSGSAIPLSIDHKPDRSDERQRIEKAGGFIIWAGTWRVGGVLAVSRAFGDKLLKPYVVADPEIQEEEIDGVDFIIIASDGLWNVISNKEAVSLV

SEQ ID NO: 5488 - protein, 158 aa, Oryza sativa Japonica Group
MAVQNGGGDGSGSGAASVVVNVYDLTPMNNYLYWFGLGIFHSGIEVHGVEYGFGAHEFPTSGVFEVEPKNCPGFVYRRSVRMGTTGMSRAEFRSFIEKLTGKYNDDVSKNLTGKPIPGWVNRLARVGSFFNYLLPKSIQVSAVRHVPTHPAFSVALSC

SEQ ID NO: 5489 - protein, 483 aa, Xylella fastidiosa Temecula1
MLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPVYWVIAPTGAAACLYLFWQPFTEHWPLMVGWTVLGLVMYGLYGYQHSKLRHGG

SEQ ID NO: 5490 - protein, 381 aa, Vibrio vulnificus YJ016
MKTFILPDLGEGLAESEIIKWHVSVGDKVEVDQVILTVETAKATVDVPAPWAGTIITRHGNEGDVVNIGALLLEIEDGDVATNSDKKVQKREDAATVVGHVSNQMHQVKVDDFWIGGNQNHTTEKRVTALPSARLLAQKLGVNLEMVSGTGPSGLIMDHDVYDEAGKQRPGTEVLKGARRTMMTTMTESHLQVAAVTITEEALLEHWSSQEDITVRLVQAVVYACQQEPALNAWFDADTVTRCVHHTVNIGVAVDSAHGLYVPVMRHADEFSPDDIRSWINQTVSGIRERKIGREQLQHATITLSNFGAIAGIYATPVVSPPQVAIVGAGRIIEKVVLREGKAVAVKAMPLSITFDHRACTGGEAARFTKALAEHLRKPSV

SEQ ID NO: 5491 - protein, 142 aa, Oryza sativa Japonica Group
MFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLEVFSPFAHSQHAILLACNSEALDCAL

SEQ ID NO: 5492 - protein, 244 aa, Arabidopsis thaliana
MGTALFLFFGFMSAQIINSKPDHISLESPSLLQLLFVAVGLGVSGAVDVWLFYRVSGGHLNPAITLGLAIIGAVPPIRAAILVVVQLLAGVVAALLVHAVTPGDLNVQTSLGTHTTTNQGLILEIILTATLVLTVFLLAVEKHRTTPLAPLGIGLVLFLIVLLSAQYSGASFNPARSFGPAVVQLNFASYHWIYWIGPILGSFAASVVYKTLKFLNYETAVAGQDHDGIDVYRLIDDSDGREVD

SEQ ID NO: 5493 - protein, 403 aa, Vibrio sp. Ex25
MTTEIKVERGLFDEVMVPCYNPMEMIPVKGEGSRVWDQEGNEYIDFAGGIAVSCLGHCHPVMVNALTEQANKLWHLSNVMTNEPALRLAKKLTEVSFAERVFFANSGAEANEAALKLARRYAADVHGAEKSEIIAFKQGFHGRTFFTVTVGGQAAYSDGFGPKPGDVTHLPYNDIEALQAHMSDRTCAVMMEPLQGEGGIVPPTPEFAQAVRELCDKHNALLIFDEVQTGNGRTGNFYAYQGLGITPDILSTAKSLGGGFPIGAMLTTAKLAEHMKVGTHGSTYGGNPLACAVAEAVVNEVTKPEVLAGVLEREAMFREGLEKINAKYNIFSEVRGQGLLLGAALNEEWQGRARDVLVAAGKQGLMVLVAGANVVRFTPSLVITQQEIEEGLAKLDKAIATLV

SEQ ID NO: 5494 - protein, 472 aa, Burkholderia pseudomallei K96243
MKNDLPGLATLDALLRDQRAAYLRAPYPSWATRADHLRALRKMLLENRDALAAAINADFGHRAKEEVLMSEIWLAKEEIDEALKHGKRWIKPKSRTMNKWLRPARAKVMPQPLGVVGIVVPWNYPVLLAAGPLICALAAGNRAIVKMSELTPRTSQLFEELISKTFARDHVAVVNGDAQIGAAFSGLPFDHLLFTGSTNVGRHVMRAAAEHLTPVTLELGGKSPVIVGPRARFDAAVDAVITGKTLNAGQTCIAPDYVLVPRGKEAEFVARARARMARLYPNLSTNPDYTSIISERHFARLQRLASEAQQAGAQLHPLTDAAPDPALRRLPPVLVTQAPDASQLMQEEIFGPLLPIVPYDTLDDAIAYVNARPRPLALYLFDEDRTTIERVMRDTISGGVTVNDTLMHIACGTLPFGGVGASGMGAYHGYDGFVTFSKMKPVLTQPRLNTRAMIAPPYGKRFAAILKLMLKF

SEQ ID NO: 5495 - protein, 263 aa, Vibrio sp. Ex25
MTPDVLFESLWQDYIQRLCPSAAKVHQLLQEDEPLINDHIALRTFNIAPLGIETLAKPFVAIGYQACGDYVFESKKLVAKHYEHPDPKQPKVFISELKVEECSPELQEIVKKLVAQVDAGKLNDSAFLHGGRLWDLSFADYQTLAKESEYASWLAAHGYGANHFTVSVNQLNEYEEVKQVNDHLRTAGFTINENGGEVKGTPEVLLEQSSTMADKVAVRFSEGTEIIPGGFYEFAKRYPMENGELYPGFVAASADKIFESTNG

SEQ ID NO: 5496 - protein, 76 aa, Brassica napus
QGNVFSLGAGVSPAATPAFSAFINNPPLALVDYRISPEGTGLPFGFSNTLLGGIFFGGFGFIWTFYFSHPLFLGED

SEQ ID NO: 5497 - protein, 289 aa, Vibrio sp. Ex25
MSAKHPIIAVTGSSGAGTTTTSEAFRKMFNMMNVKPAWVEGDSFHRFTRPEMDIEIRKAREQGRHISYFGPQANDFPGLEEFFRKYGHDGAGSVRRYLHTFDEAVPYNQMPGTFTPWQDLPENSDVLFYEGLHGGVVDGDVNVAQHVDFLIGMVPIVNLEWIQKFVRDTRDRGHSREAVMDSIVRSMDDYLNYITPQFSRTHINFQRVPTVDTSNPLNAKGIPSLDESFVVIRLRGIKKVDFPYLLAMIDGSFMSRHNTIVVPGGKMSFAMELIVRPILQQLIETGKIG

SEQ ID NO: 5498 - protein, 523 aa, Burkholderia pseudomallei K96243
MVSDVCGGALGRDELDALERELALASRGPEHEDAAAHGDGFGAHHHAPPRPLAMGAPSSRATLANPHLAHWRAHLDGIRERNARALPLRPCGRLTRAAGLVLEAIGLRLSVGAECTIELPAGSALPYAQAEVVGFAGERLFLMPTTAVAGVLPGARVWPLESAPVADPLAGAKRLPVGWEMLGRVVDASGRPLDNLGPLASKVDAPLTAPSINPLDREPIHHVLDVGVRAINGLLTVGRGQRMGLFAGSGVGKSVLLGTMARYTSAEVIVIGLIGERGREVKEFIEQILGEDGLARSVVVAAPADVSPLLRMQGAAYATTLAEYFRDQGKHVLLLMDSLTRYAMAQREIALAIGEPPATKGYPPSVFAKLPALVERTGNGPEGGGSITAFYTVLTEGDDQQDPIADSARAILDGHVVLSRSLAEAGHYPAIDIEASISRAMTALIDDAHLDRVRQFKQMLSRYQRNRDLIAVGAYAPGRDAQLDRAIALYPRIESFLQQGFRECAPYAPSLAALDALFESEGG

SEQ ID NO: 5499 - protein, 614 aa, Saccharomyces cerevisiae
MTRATWCNSPPPLHRQVSRRDLLDRLDKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFGGSQNLKKSYLLSKSATVEKAPMLTTDNLKASLVYHDGSFNDSRLNATLAITGVENGATVLIYVEVQKLIKDPTSGKVIGAEARDVETNELVRINAKCVVNATGPYSDAILQMDRNPSGLPDSPLNDNSKIKSTFNQISVMDPKMVIPSIGVHIVLPSFYSPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIQGRFGV

SEQ ID NO: 5500 - protein, 394 aa, Mesorhizobium loti
  misc_feature (393)..(393): Xaa can be any naturally occurring amino acid
MRYPEHADPVITLTAGPVNAYPEVLRGLGRTVLYDYDPAFQLLYEKVVDKAQKAMRLSNKPVILHGEPVLGLEAAAASLISPDDVVLNLASGVYGKGFGYWAKRYSPHLLEIEVPYNEAIDPQAVADMLKAHPEITVVSVCHHDTPSGTINPIDAIGALVSAHGAYLIVDAVSSFGGMKTHPEDCKADIYVTGPNKCLGAPPGLTMMGVSERAWAKMKANPLAPRASMLSIVDWENAWSRDKPFPFTPSVSEINGLDVALDLYLNEGPEAVWARHALTAKAMRAGVTAMGLSVWAASDSIASPTTTAVRTPDGVDEKALRQAARARYGVVFSSGRGETLGKLTRIGHMGPTAQPIYAIAALTALGGAMNAAGRKLAIGKGIEAALAVIDADAXA

SEQ ID NO: 5501 - protein, 400 aa, Rickettsiella grylli
MKINLSHRVSQIKPSPTLSLSATANQLKAQGKPVINLTVGEPDFDTPYHIKRAAHQAIDDGFTKYTAVDGIPRLKQAVIDKFKRDNQLDYSLDQVIISSGAKQSIYNLMQSLLNPGDEVIIPAPYWVSYPDIVLLAEAKPVFIPTSTESSLKITPQQLQAAITDKTRLMIINSPSNPSGMVYTPTELKQLAQILLRTPHVFILTDDIYEHIYWGDQPFKNILNVCPELANRTLVLNGCSKAYAMTGWRIGYAAGPKTIIRGMMNLQSQSTSNPNSIAQFAATAALTGQQTDVLHMNKIYHWRHDFFVAELNKIPGIHCLPAQGAFYSFPSFHAFIGEDKPFASDYELADFLLNNAHVAVVPGSAFGAPGYLRLSYALEETLLEKALLQLKTTLMNAMPLT

SEQ ID NO: 5502 - protein, 393 aa, Mesorhizobium loti
MRYPEHADPVITLTAGPVNAYPEVLRGLGRTVLYDYDPAFQLLYEKVVDKAQKAMRLSNKPVILHGEPVLGLEAAAASLISPDDVVLNLASGVYGKGFGYWAKRYSPHLLEIEVPYNEAIDPQAVADMLKAHPEITVVSVCHHDTPSGTINPIDAIGALVSAHGAYLIVDAVSSFGGMKTHPEDCKADIYVTGPNKCLGAPPGLTMMGVSERAWAKMKANPLAPRASMLSIVDWENAWSRDKPFPFTPSVSEINGLDVALDLYLNEGPEAVWARHALTAKAMRAGVTAMGLSVWAASDSIASPTTTAVRTPDGVDEKALRQAARARYGVVFSSGRGETLGKLTRIGHMGPTAQPIYAIAALTALGGAMNAAGRKLAIGKGIEAALAVIDADAA

SEQ ID NO: 5503 - protein, 659 aa, Vibrio sp. Ex25
MKPLRDVTKQRALRKVNENFMITFSDIQLLRGGKPLLDQASATIHPGDKVGLVGKNGCGKSTLFALLKDELSIDAGSFSQPQHWELAWVAQETPALERTALEYVIDGDREYRALEKQLAEAEAQDNGTLVAEIHGKIETIGGYSIRARAAELLDGLGFSQEQMSWSLTQFSGGWRMRLNLAQALLCRSDLLLLDEPTNHLDLDAVMWLERWLQNYPGTLILISHDRDFLDPIVGRIIHIENQQLNEYTGNYSSFENQRAQKMVLQQAMFEKQQKQMSHMQSYIDRFRYKASKARQAQSRIKALERMEKVLPAQFDNPFSFQFREPAALPNPIMMMDEVSAGYGDNLILEKIRLNLVPGSRIGLLGRNGAGKSTLIKLLSGELNAQGGDLTYSQGVKIGYFAQHQLETLHPEETPLQHMMQIAPDQTEQQLRDYLGSFGFQGDKALEKVAPFSGGEKARLVLALIVWQKPNLLLLDEPTNHLDLDMRQALTMALQTFEGAMVIVSHDRYLLRATTDDLYLVHDRQVAPFDGDLNDYYKWLTEQQRAERKEAQAAQPAKDSANSAAAKKEQKRRDAEFRKQTAPIRKTLTQLENKMDKLGAALAEAEEQLADNSLYEAENKAKLNQVLALQASSKAELEEIEMEWMSAQEELEQMELEFNQ

SEQ ID NO: 5504 - protein, 135 aa, Streptomyces coelicolor A3(2)
MSYDVEKPDEQWRAELAPAEYAVLREAATEPAFTGEYTDTKTEGVYSCRACGAELFTSTTKFESHCGWPSFYDPRDTDAVELIEDRSHGMVRTEVRCARCGSHLGHVFKGEGYPTPTDQRYCINSISLRLEPKAG

SEQ ID NO: 5505 - protein, 264 aa, Synechococcus sp. CC9605
MQTPRRINDPANSLAVVVAIVLSALLLLGQALFIVPAGKVAVVTTLGKVSGGSRLPGLNLKVPFVQSVYPFDVRTQVKPEEFATLTKDLQVIEATATVKYAVRLNEAGRIYRTIAGNDREIYPRIIQPSLLKALKSVFSQYELVTIATEWNDISALVERTVAEELDKFDYVEVRGLDLTGLQIAEEYRAAIEQKQIAEQQLLRAQTEVKIAEQEALRYDTLNRSLDDQVLYKLFLDKWDGQTEVVPALPGSNGSTPPVIVGRRS

SEQ ID NO: 5506 - protein, 554 aa, Ustilago maydis 521
MEDDRETVRLWRVNRTIHELVRDRGYQVADDEISVDLETFKAEYAPTGGSVDRNKLNFFTEHGEHENQRLFVFYSSDRNVGVKTMRQFISIMEERDIQRGIIIWPEKMTSAARKVIDAMRGTFHLEDFEEAFLLVNITHHHLVPKHEPLYPEEKKELLQRGVRWSRLSGPVRPVVDTARTASACDAVVDSSCVFDPSSVRSRLGHIRDCVFLLVILRDISSVSIGLECVLSVVDRIVSHARSTIHEWRRTRPIRDSRILNQSRITNFGHTREWRDSRLAKAAVTAKRVGVRRENKPSGVFTIVLPRTRLRSSHPQAVEAKPARYLQACTRAYAEHATMSKREKSDPSTTPDTMTHTAPASQPVETATTGTRKHSVGNSAVDETLYYPPPTSSYYFGPPDSSRAFGQQVTGKPGVHVPKEIVRIERDYSSGELPQFHSSFPLELEGRISPTTFSELINDINTLLIKAHNPRRTWIDNTFAILTFYISTLLFGSHHQRIWLTRRQCVPFSCGAQLQTMAELDSCIESCNRQTLHPAGLSLVNPRKTAFLFIELEYF

SEQ ID NO: 5507 - protein, 247 aa, Chlorobium tepidum TLS
MKKLVLLRHGESQWNRENRFTGWVDVDLSEKGREEARTAGQLLKDEGFVFDLAYTSVLKRAIRTLWTVLDEMNLMWIPVTKNWRLNERHYGALQGLNKAETAQRHGDEQVLIWRRSYDTPPPALTESDEFWPGKDPRYASLSSQELPATECLKDTVARFLPYWHETIAPQIRDGKNVIITAHGNSLRALVKYLDNISDEDIVGLNIPTGIPLVYELDDDLKPLKSYYLGDQEELKKKVEVVVKQGKA

SEQ ID NO: 5508 - protein, 468 aa, Thiomicrospira crunogena XCL-2
MSTTSTSSPLAFSTLGLHPDLLSNLKTLDYHFLTDIQAQSLPPILEGKDVIAQGKTGSGKTAAFGLGVLQKLDVKNFNVQALVLCPTRELADQVANEIRRLARQLQNIKVLTLCGGMPMGPQISSLQQGAHIVVGTPGRIEDHLKKARLTLAEVKILVLDEADRMLEMGFQPSLDTIIDQLPQQRQTLLFSATFPKQIEHISQRIMHQPVRVEVASRHDDSTITQHFYQVDSTEQRLQALRLVLLQAKPESSVVFCNTKKEVQMVADTLRDAGFSALALHGDLEQRDRDQTLIQFANKSISILVATDVAARGLDIEALDAVVNFHLAHDPEVHVHRIGRTGRAGSQGVACSFISDKESYKVATLAEYLGQDIQTEPLPDASLLNQPPLQAKMVTLLIDGGKKNKLRPGDILGALTANDVLNAGQVGKIKITDKKSYVAVTRSMFKQALKQLGAGKLKGRNFRVHKLTR

SEQ ID NO: 5509 - protein, 238 aa, Arabidopsis thaliana
MAPTIRTIGTYATQQRYLVDFFGEEFIVIVTPDPSVIGQWIHDVLSHNRFSSHPLVVGVGVQWTPSSYYSASSPVRYRSDSPPVRYRSDSPRVRRRFDPPADTLQLCVGNRCIIIQLSHCERVPQVLRNFLADRDYTFVGIWNSQDAGKLKRSKHELEIAVLLDLRKFVSDSSGRTMKRCSFEKIVEENLGHSGVRLDRKVSRSDWRVYDLRYVQILQASIDVYACCKLAILDHLWEY

SEQ ID NO: 5510 - protein, 989 aa, Brachyspira hyodysenteriae
MSDVMTPIPFGNLMNWILEEKKSGKVFGVSRAFKADKAKYYEIFGRKLETPIGPAAGPHTQLAQNIVAAYYTGSRFFELKTVQKMDGEELSKCVAKPCITANDECYNCEWSTELYVPQAFDEYVKAWVALKVIAKEWDLGDMDGFQFNMSVGYDYEGIKTEKIDTFIEGMKDASNTPIFKECKQWLTDNISRFKNFKKEDIDKINADVCNSVTLSTLHGCPPTEIEKIASYLITEKKLNTFVKCNPTLLGYEYARKTLDDMGYDYISFTDFHFKDDLQYSDAIPMLQRLQKLAEDNSLAFGVKITNTFPVDVKQKELPSEEMYMSGKSLFPLSMTVASRLSKDFDGKLRISYSGGCDYFNINEVIDAGIWPVTMATTFLKSGGYQRGEQIAKNLKEPKAFTKVDVAKTEKIIEWSKKSKHHIKPVKPLASRKVNKKVPLIDCYIAPCMETCPIHQDLTTYIRLNSEGKYEESFKVIIEKNALPFATGILCPHTCMDKCTRQFYEEPVSIRACKLEAAKAGYSKVIGTLKPAASIGKKAGIIGAGPAGLSAAFFLARAGVDVTVFDKREKAGGVVANIIPSFRISAEEIGNDVSLCKQMGVKFELGKEIKDIKEFAKNYDYTVVCIGAHKNMPLKLEAGESMNALKFLEEFNKTNGNVALGEDVVVIGGGNTAMDAARAAKKNKGVKNVRLVYRRTKRYMPALEEELQEALEDGVEFMELLAPVKLENGKLLCKKMELSDYDEKGRRNVVETSETVEVPASSVIASIGEQIESDFYKSNGIDVDDKGKPKCSASNESSIKNVYVAGDGLYGAATIVEAIRDAKVVAEAILGKAVAPDLPSVSTEEISYSKKGNLKEVSKDPEATRCLSCDYICESCTEVCPNRANVSIKVAGHSKISQIIHVDYMCNECGNCETFCPYSSAPYKDKFTLFATEDDMKNSKNDGFLFLDKEGNAKLRIDGKEESYKVGGKNNGVYTIVDAVFNNYKYLILK

SEQ ID NO: 5511 - protein, 493 aa, Physcomitrella patens subsp. patens
MEDSESNAGVDSGSNELGKPLLNEGAGRSRPVHNRRHNLRSRRDAVLPNSAYAILSTFVVALGPLSLGFALGFTSPTQAAITRDLNFTIAQFSTFGSILNVGCMFGAIVSGRLADYFGRKLALLVAVVPAIAGWILIVFGKAATPLIIARTLVGFGAGIISFTVPMYIGEISPKHLRGTLGTMNQLAITIGITLSYIFGMYLNWRSLALLGGIPELALIVGLLFIPESPRWLAKVGKREELSSCLQRLRGREFSIASEIAEIQAAMEASNAMPSVKLSDLKQRKLFRPLLAGVGLMVLQQFSGINAVMLYSSFIFSTAGVHNPDVATVALGTLQVIMTLAAAGLMDKAGRRILLMVSAGGMALSCFLVGFSFYLRDLQPDMSEALATFDAYLALVSLLVYIAAFSLGIGAIPWIIMSEIFPGYVKGIAGSVATLVNWFCSYAVTMIFNYMLLWSSTGSFWIFAAECVGTVVFVALFVPETRGRTLEQIEASFK

SEQ ID NO: 5512 - protein, 559 aa, Pseudomonas aeruginosa PAO1
MGARALRRERRLRWSPNWTRILPMQPQKTLTAGQALVRLLANYGVDTVFGIPGVHTLELYRGLPGSGIRHVLTRHEQGAGFMADGYARVSGKPGVCFVITGPGVTNVATAIGQAYADSVPLLVISSVNHSASLGKGWGCLHETQDQRAMTAPITAFSALALSPEQLPELIARAYAVFDSERPRPVHISIPLDVLAAPVAHDWSAAVARRPGRGVPCSEALRAAAERLAAARRPMLIAGGGALAAGEALAALSERLAAPLFTSVAGKGLLPPDAPLNAGASLCVAPGWEMIAEADLVLAVGTEMADTDFWRERLPLSGELIRVDIDPRKFNDFYPSAVALRGDARQTLEALLVRLPQEARDSAPAAARVARLRAEIRAAHAPLQALHQAILDRIAAALPADAFVSTDMTQLAYTGNYAFASRAPRSWLHPTGYGTLGYGLPAGIGAKLGAPQRPGLVLVGDGGFLYTAQELATASEELDSPLVVLLWNNDALGQIRDDMLGLDIEPVGVLPRNPDFALLGRAYGCAVRQPQDLDELERDLRAGFGQSGVTLIELRHACAR

SEQ ID NO: 5513 - protein, 310 aa, Salmonella enterica subsp. arizonae serovar 62:z4,z23:--
MERRKIILDCDPGHDDAIAMMMAARHPAINLLGITIVAGNQTLDKTLVNGLNVCQKLNIDVPVYAGMPQPIMRKQIVADNIHGESGLDGPVFEPLNREAESTHAVKYIIDTLMASSGDITLVPVGPLSNIAVAMRMQPAIVPKIREIVLMGGAYGTGNFTPSAEFNIFADPEAARVVFTSGAPLVMMGLDLTNQTICTADVIARMENVGGPAGQLFSDIMNFTLKTQFENYGLAGGPVHDATCIGYLINPQGIKTQDMYVEVDVNSGPCYGRTVCDELGVLGKPANAKVGISIDTAWFWDLVEECVRKYL

SEQ ID NO: 5514 - protein, 323 aa, Oryza sativa Indica Group
MAEAAITRYWCHECEQAIEEAMVDEIKCPSCGGGFIEEMTDEEIERLTNRQPEPGFSQWNPIEHPGETMDSDDEDNDLGREFEGFIRRHRRASTLRRVLDSIHDDLANDQERDSSILINAFNQALALQGSVLDPDEGQGDQGGSTNDDGLLEEYVLGAGLSLLLQHLAESDPSRNGTPPAKKEAVEALPTVKIEEVVSCSVCLDDLEVGSQAKQMPCEHKFHSSCILPWLELHSSCPVCRFELPSEETKDLNEPSNIGRVEDSHEEVRADGPGNVSESSNRPWAIVPWLNELFSTREAQNAGGVSTDQQSPHTSGTNPNAGHS

SEQ ID NO: 5515 - protein, 506 aa, Oryza sativa Indica Group
MASRAPPLLLLLIVLSLVVLAALLAAAAADASAVAGGGRSSPSTTTFVLAGERTRRKDPLDGLRLYSGGWNISDEHYWASVGFTAAPVFAAAAICVGCGVLYDGQGRFDGSTAATVEYVAGKSGDAVASLRGFASSMEAAKAAGVGPVSLPASVKGSIDGVVRKMSSAADELAAHTASNAAKIRDALETIRKILIVVAATMLILAVLGLGWCFLGGFWLQQRFCSVSPSFYYTSSRYHRCRVTSITGIGYHTAGTTTGISVVGDTCAAMGEWVQRPQARTALDDILPCVDPAAAADALARSKDVTHHLVTVLNGVIANVSNAAADGLPPPLYYNQSGPPVPLLCSPGERCAPGEVDLAAAPRAWRERVCRTTRAAAAAPEVCATVGRLTPAMYAQMVAAASACDALSRYGPVLADMADCAFVRRAFRVVGDEHCPGLGRHSAEVYRGLLAVAVAALASVVLWVAHSRERRRRRDAVELRAAASPYTVHHSHLEEGALLKSPRMMYR

SEQ ID NO: 5516 - protein, 314 aa, Thiomicrospira crunogena XCL-2
MKSLNTLQEFTPLTPLHHPLFDEKAVQVWIKRDDLNHPAIQGNKLHKLKYNLAEARQQGKQSLLTFGGAYSNHIAATAAAGNAFGFETIGFIRGEELANQPDKWSPTLKNAYQNGMQLHFLNRMDYRQKTRAHFLQQLQQQFPKSYILPEGGTNDLAIQGFEELSQQLAMQCPDWSHLYSAVGTGGTLAGLIKFSAFFCDQPRLISGIATLKQASYLIPTIEQLSGVHHNQRGLTQWQLLLDYCGQGYGKEDSDILTARKWFEEQFDIPLDPVYTNKMVYGFLEELAADKIPAGAKIILYHSGGLQGRALEKKA

SEQ ID NO: 5517 - protein, 396 aa, Brachyspira hyodysenteriae
MGIQKYISKLDSLEFGKMYQNDFFLTWDKTFDELQAVWTVADALRFLRESNISTKVFDSGLGISLFRDNSTRTRFSFASACNLLGLEVQDLDEGKSQIAHGETVRETANMVSFMADVIGIRDDMYIGKGHEYMKEVSESVKQGYNDGILEQRPTLVNLQCDRDHPTQMMADSLHFIHELGGLENLKGKKVAMTWAYSPSYGKPLSVPQGAAGLFTRLGMDVALAYPKGYELMPEVEAIAKKNAEAAGVKLTITNNMDEAFEDADVVYPKSWAPFAAMQERTDLYGKGDTDGIKALEKRLLEQNAQHKDWCCTEEKMKKTKNGKALYLHCLPADINDVSCKDGEVAASVFDRYRVPLYKQASYKPYVIAAMIFLSKFRDPQAILSKLASDKKQRIFG

SEQ ID NO: 5518 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 5519 - protein, 282 aa, Mycobacterium sp. MCS
MSTVPTVTLNDGASIPQLGFGVYQVKPDETANAVKTALDIGYRHIDTAEMYQNERGVGEGIRDAGIDRAEVFVTSKLNNGFHRPDDARRAFDKTLSELGFDYVDLFLIHWPLPTLYDGDFVSTWQTLEEFKKDGRARSIGVSNFQVDHLERLARETETVPAVNQIEVHPYFTNDAVRAYGREHGIATEAWSPIAQGQVLDDPTVTRIAEASGKSPAQVVLRWHVQRGDIIFPKSVTPKRIEENFDLFDFELGEADVDALSGLDKGEQGRIGPNPDTFDYIPD

SEQ ID NO: 5520 - protein, 408 aa, Streptococcus suis 89/1591
MIDFESIRKDFSILDQVVNDEPLVYLDNAATTQKPQQVLDVLEDYYQTDNANVHRGVHTLSERATARYEAARQKVADFIQAKSSKEILFTRGTTTSLNWVAQFAKEILQPDQEVIISVQEHHSNIIPWQQACQQIGAKLRYVPLKDGELDVDSLKSILSEKTKFVSLAHVSNVLGGVVPIGEIAELVHQVGAYLVVDGAQSVPHMAVNVQELDVDFFAFSGHKMLGPTGIGVLYGKEELLNLMSPVEFGGEMIDFVYEQSATWKELPWKFEAGTPNIAGAIGLGAAVDYLTEIGMDAIQAHEAELVDYVFPKLQAIPGLTIYGSQDLSKRTGVIAFNLDDLHPHDVATALDYEGVAVRAGHHCAQPLLRYLQVPATVRASFYIYNTKADCDKLVEAIIKTKEFFNGPI

SEQ ID NO: 5521 - protein, 957 aa, Propionibacterium acnes KPA171202
MDERAPEPGMENEAVEPEVFEQDGPDLFGDEESPRPVMPPDEATPDDDLPSDPCDPGLLDGPETPEEPDGLETDEDEEDGADVIERVQELIGEAPDSNPDDDLPELPLALYRRYRPETFDEVIGEDHVIEPLKRAILNNRVNHAYLFSGPRGCGKTTTARILARALNCEQGPTPTPCGTCQSCRDLACGGPGSIDVIEIDAASHGGVDDARDLRERAFFAPVHSRYKIYIIDEAHMVTPQGFNALLKLVEEPPPHVKFIFATTEPEKVIGTIRSRTHHYPFRLVPPKVLVEYLAELCGKEGIDVDHAVLPLVVRAGGGSVRDSLSVLDQLLGGAADGHVSYEQAAALLGYTPEALLDEIVDAFAAGDAHQVFATIDKVIEVGQDPRRFAEDLLRRMRDLVIVSAVPDACRSGLIDVSPEQATRLAHQVSGFGAGELTRAAEVLATGLTNMRGTTAPRLHLELMCSRILLPGADTDGRGIHARLERLERRIGVSGPVEEVERAERPVTAQPPTRYADTPQQASPPQHWPAENLQNPERRSAPEHHDAPSPGQRPSGRPRPSRKDYRPGNQLAEQPPSNQHGDDGQMSQGPRQQGGPSTSQRQQPRPQDHQPSQRDRQDTPPAQPQQPSAEQGGRADDAINITTLRREWPQVLEAVKDGGRVAWMVLNQYAQVLEVHGNQATLGFSNIGARENFAAGNYPKVLHDAVVKVLGVDLAFTAVVGEPPAAVRPESHPAEFQSGPAAQEPPDDDPWEQGPHHQDSTRGGEPSDPTHPGRDPQGRPGDRQAISDDASKDAPPPPVTSSHPSEAGDDDPAPDATTEDQSADVRDEVVESGPVAGAPDPDSGGAAEPKPDLVPGQDHVEAAGRAESARQIDPGGASSQGRPSAAAVSTAHRWSERAKGSVRPLEVTSRSAQVEEPPDDGGEWDDTVVEESNESPIDLIMRELGGVVIDTDGDSTAR

SEQ ID NO: 5522 - protein, 377 aa, Glycine max
SARAPSILIRVSGVVSAVMGGFMICIIICCFRYKLLIQPIKLCSTTKSDQDIEAFLKNKGAVAQKRYKFSEVKKMTNSFKVKLGQGGFGAVYKGQLPTGCPVAVKLLNSSKGNGEEFTNEVASISRTSHVNIVTLLGFCLKGRKKALIYEFMANGSLDKFIYNRGPETIASLRWQNLYQISIGIARGLEYLHRGCNTRILHFDIKPHNILLDENFCPKISDFGLAKLCPRKESIISMSDTRGTLGYVAPEMWNRHFGGVSHKSDVYSYGMMLLEMVGGRKNIDAEASRTSEIYFPHLAYKRLELDNDLRPDEVMTTEENEIAKRMTIVGLWCIQTFPNDRPIMSRVIEMLEGSMNSLEMPPKPMLSSPTRSATESSS

SEQ ID NO: 5523 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQVKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGESYLRESTTSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 5524 - protein, 542 aa, Oryza sativa Japonica Group
MGARASRHRQSPDQSQSQSPSPHHKHHHHHQTTRAPKPKPKPQPPPPQQPRSQPPPPPRHQPQQAPQQAAAEDGVGRVLGRPMEDVRATYTFGRELGRGQFGVTYLATHKPTGRRYACKSIAARKLARPDDLDDVRREVHIMHHLTGHRNIVELRGAYEDRHSVNLVMELCEGGELFDRIIARGHYSERAAAALCREIVSVVHSCHSMGVMHRDLKPENFLFLNKREDSPLKATDFGLSVFFKPGEQFRDLVGSAYYVAPEVLKRLYGAEADIWSAGVILYILLSGVPPFWAENEDGIFDAVLQGHIDFSSEPWPSISSGAKDLVKRMLRQDPKERLTAAEILNHPWIREDGEAPDKPLDITVISRMKQFRAMNKLKKVALKVVAENLSEEEIVGLKEMFKSLDTDNSGTITLEELRAGLPKLGTKISESELRQLMEAADVDGNGSIDYVEFISATMHMNRLEKEDHIYKAFEYFDKDHSGFITVDELEEALTKYDMGDEATIKEIIAEVDTDHDGRINYQEFVAMMKNNSPEIVPNRRRMF

SEQ ID NO: 5525 - protein, 161 aa, Vibrio sp. Ex25
MAITSEFLQSSVVFLSAAVIAVPIAQRLGLGSVLGYLLAGVLIGPWGLGLISDVDAILHFAELGVVLLLFLIGLELNPKKLWQMRGPILGLGGAQVVVTTAVLGSVVSMFGVSMQVSLVIGMGLALSSTAIALKVIEEQGLNGTETGQSGFAVLLFQDIAV

SEQ ID NO: 5526 - protein, 439 aa, Arabidopsis thaliana
MSCSSSSGSEGEEEGFDAYRKGGYHAVRIGDPFSGGRYIAQRKLGWGQFSTVWLAYDTLTSNVLLCMFLCLFAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLTPILEFAPEKRPTAQQCLDHPWMNVTTQNDAENVDDQMNNLHIKG

SEQ ID NO: 5527 - protein, 430 aa, Xylella fastidiosa Temecula1
MNFHSTRTTAPVTTLSQAIAAGLAPDGGLYVPECLPPLGDLDHSADLINTATALLTPFFAGDPLEVHVPSICAEALDLPAPLLPLATPEDYVLELFHGPTAAFKDFGARFLAACLTRLRRDAERPLTILVATSGDTGAAVAAAFHRQPGLRVVVLYPDGRVSPRQAHQLGCFGDNIHTLRVAGVFDDCQAMVKQALNDTSLQTAVPLSSANSISLGRLLPQMSYYAHAALTHRASTGRPLNLIVPTGNLGNALAAILARALGVPLGQIVLATNANHVLPDYFSGAHYRPQPSVATLANAMDVGAPSNFERLRWLYRGDDAALRAAFTAYSVDDTAIRQTITARHRRYDEIFCPHTATAVFVLEHLRAQGVAGDWAVVATAHPAKFEQVVEPLIGTTVPVPAALDSLLQRPARDEPLAPEYPALRHMLLAT

SEQ ID NO: 5528 - protein, 459 aa, Nostoc sp. PCC 7120
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDNHTVEVGERKFTADKILIAVGGRPIKPELPGMEYGITSNEIFHLKTQPKHIAIIGSGYIGTEFAGIMRGLGSQVTQITRGDKILKGFDEDIRTEIQEGMTNHGIRIIPKNVVTAIEQVPEGLKISLSGEDQEPIIADVFLVATGRVPNVDGLGLENAGVDVVDSSIEGPGYSTMNAIAVNEYSQTSQPNIYAVGDVTDRLNLTPVAIGEGRAFADSEFGNNRREFSHETIATAVFSNPQASTVGLTEAEARAKLGDDAVTIYRTRFRPMYHSFTGKQERIMMKLVVDTKTDKVLGAHMVGENAAEIIQGVAIAVKMGATKKDFDATVGIHPSSAEEFVTMR

SEQ ID NO: 5529 - protein, 828 aa, Xylella fastidiosa Temecula1
MSTVETPVYVPRTVVHKFGGTSVADADCYRHVTRLLLAREETVQVTIVSAMKGVTDTLIALAEQAANHSPDWQVLWQQTRTRHCDAAQALLGEHAATLQDWLNTRFNELHEMLVALSVIGMLPSEVLDRLQGLGEVYSAQLLGHYLQSQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPGHPGTRITADSVVSGSVKGLTLSPGLAVLNLEGTGLIGVPGTAERVFAALRNARLSVVMISQGSSEHSICCLVHQTEAERARDALLYAFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCAAQQQLLSKANLDLRLRAIVSRRRMLLDERGLGSDWRHAFAAAPEAVDLDAFTAHLQAAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLIAQARAMGYTEPDPRDDLSGVDVARKLVILARDAGRDISLEDVAVESLVPETLCQLSVADFMERLNEIDATFAERLAAAKQRGCVLRYVAQLSPGHVPSVSLIELPSDHAFVNLRLTDNVVQFTTRRYSENPLIVQGPGAGPEVTAAGVFADLLRVAAGEGARL

SEQ ID NO: 5530 - protein, 183 aa, Zea mays
RKENRSNPEAENSRRIQRRLQVCWRCCRAGGRRLLAPGLRRLGLGTGASGEAGPAAAAAGVRAYHERVVDHYNNPRNVGSFDKDDPNVGTGLVGAPACGDVIEAADPASTKTPGRIVDPCFKNFWLGGPAIGGLPPSLRKGGREKPGGKILKIQNPGIRKTFFPSPIKFPFGIVSQKSHLKPR

SEQ ID NO: 5531 - protein, 238 aa, Picea mariana
MATEACGEKGQVQLLGGSLSSFVLRVRIALALKGIDYEFIEENMQNRSQLLLQSNPVHRKIPVLIHNGKPVCESMIIVQYIDEAWDTKAPNLMPKDPYDLAIARFWAAFVDDKLVPCMRRVFAGHGEQLQKEAEDLVTNFHLIEEALRTNSCFSGKAYFGGDKIGLLDIALGGMLAVLKGLEKATDTVIIDPEKMPLLSAWMDRFCQSNGVKEVMPDPAKQLESLSARRARLASPAGN

SEQ ID NO: 5532 - protein, 490 aa, Chlorobium tepidum TLS
MGKLKGFMEYRRALPVDREPLERIKDWNEFHEEMSAEQLSDQGARCMDCGTPFCHSGFMLNGMTAGCPIHNLIPEWNDHVYRGFWRDAWERLMKTNNFPEFTGRVCPAPCEGSCVLGIIQPPVTIKNIEYSIIEHAFAEGWVEPKQIAVRTGKKVAIVGSGPSGLACADQLNKAGHTVTVFERDDRVGGLLMYGIPNMKLDKRLVVQRRVDLMKEEGVSFVTGTEVGVNYPVDKLLSEYDAVVLCIGATNPRDLNADGRNLDGIHFAMEFLRASTKAVLDGTEPVLSAKGKDVVVIGGGDTGTDCVATSLRQGCKSVIQLEIMPKPADFRQEDNPWPEWPKVFKVDYGQEEAAAVQGGDPRRYLMMTKKFIGENGRLSAVEVSKVEWIKQEGRTIPVPVSGSEEIIPAQLVLLAMGFLGPEAQLLQSLGVEQDSRSNIKADEKSYRTSVDKVFAAGDARRGQSLVVWAINEGRAAARECDRFLMGCTSLP

SEQ ID NO: 5533 - protein, 190 aa, Aspergillus oryzae
MLSHKSTAPRIGLAAIKRSTYFFFFTSPTVANIFLNQPRMNLENFNSPKVGSFNKNDADVATGLVGAPACGDVMKLQIRVDKDTNVISDVRFKTFGCGSAIASSSYLTELVRGMTLEEAGKIKNTEIARELLPPVKLHCSMLAEDAIKSAISNYYTKNPNARTTNLGGTGASIPNVKVEIEKSEGAAATA

SEQ ID NO: 5534 - protein, 242 aa, Photobacterium sp. SKA34
MFASKEGQAVPQVTFHTRKGDQWVDVTTEDLFANKTVVVFSLPGAFTPTCSSSHLPRYNELASVFAENGVDDILCVSVNDTFVMNAWKADQDAENITFIPDGNGEFTKGMDMLVEKDDLGFGARSWRYSMLVKNGVVEKMFVENEEPGDPFKVSDADTMLKYIAPEQKLQESITVFSKPGCPFCVKAKQNLIDKGLQYEEIILGKDATTVSLRAITGRSTVPQVFIGGKHIGGSEELETYLG

SEQ ID NO: 5535 - protein, 604 aa, Anabaena variabilis ATCC 29413
MALIVQKFGGSSVGSVERIQAVAQRVYKTVKAGNSLVVVVSAMGKTTDGLVKLANEISRNPNRREMDMLLSTGEQVTIALLSMALQELGQPAISMTGAQVGIVTEAEHTRARILHIETERVEGHIQEGKVVVVAGFQGISSNGSLEITTLGRGGSDTSAVALAAALQADFCEIYTDVPGILTTDPRIVPEAQLMGEITCNEMLELASLGAKVLHPRAVEIARNYGMPLVVKSSWTDDPGTWVTTPKPQGRSLINLELARPVDDVELDTDQAKVALLRVPDKPGVAAKLFGEISRQKVDVDLIIQSIHEGNSNDIAFTVTTPILKRAEAVAAAIAPSLRSPSHPKSDEAEVMVEQNIAKVSIAGAGMIGRPGVAAKMFTTLAEAGVNIQMISTSEVKVSCVIDAQDGDRAIIALRKAFEIETPLHSPTPPTLSTHNSPPVRGVALDLNQARLAIRQVPDRPGMAAQLFGILAQNNISVDMIIQSQRCRIVDGVPRRDIAFTVPRMDGETAQKLLCQVAPELGWGDVVLDSAIAKVSIVGAGMVGQPGVAAKMFEALAKHQINIQMIATSEIKISCVVSQEQGVQALQVIHTAFELAGTEKFVVPV

SEQ ID NO: 5536 - protein, 145 aa, Triticum aestivum
MSSPSKRREMDLMKLMMSDYKVDMINDGMHEFFVHFHGPKDSIYQGGVWKVRVELTEAYPYKSPSIGFTNKIYHPNVDEMSGSVCLDVINQTWSPMFDLVNILRCSCPRFSSEPPGPLDGEAAPLMMPDKKPYENKAKILGEYPA

SEQ ID NO: 5537 - protein, 1341 aa, Gibberella zeae PH-1
MTESSPRAVRFQGSEDDGRPDKVRGHRLETPIESNGDPHATERHDELGNLIGYGATGHTGSLTSLAPGTVINGVSKAQRGPNTGDDGTAYTPNGSWPQRPLGPARTPSNTYNPATSRKPAHPPATPSFTESIRSSSKTRPRNESRFRAQERAYVQKLRQDYSGGYFTSYSNLNGNDSDSEGETPSSEGPYDDRFDQETIMFYGNDTLQPTDEDLKDPENRERLEWHGMLEAVLTGDVVRQEKKRLIGSADQQAGKSAHKTELWLGIRSKVCGRHIPVQRRMLEESRSTLDRTLDEIINFQIKGESEAGKPPYEQVKDMVAKIQMCENLYPSWAALATEHKAADSATFKESHDAIISWYNTNEMINTELNILKKWVGNEELDFTRTKQRSPAVNGINNDETSFLDRLMKEDGLQSLYNDDNGNLEKGMLAPISTVISKAKDTLIRNSEAFRKRHLPPYLEELLTLISFPSRLIEEITRLRLAYARRVKESAQQNPLMQDQMISQFQLLLKFAIRIKIECTSIANPEPGWDLPPCIDESFDQVVLEALKYYFKMLNWKLSGNKNTFKEAELLFQEWDFANEIGSHLQRGHIEVAEQFSSLTFKALHRLSQTFEKELQAKPKETATEMSKRYKACLDSVRVRQRMLQRFTRMLNDNYEHASDYSISFPPETMQKFYDQLVASGHFQVDTRLLEQDNIYVIASPELRERLEDIQAMMAITSKDQFPDELGEQYLLILRPEDPLNWFGETIEVPLRDLNIDLKRGHIRLCASSPQTLHNARRAFIENVDMHVDLVQEARSNIQKVNSRLTEIRRVAYKLSNNFMDSVEIIRKQARGKDCQELIQTCFVFATEFGQRSLLYMDSNRRQMNNLKLTKLALDWVSFICDDCVASDRKTFRWAVLALELAMGMTRGRHILALGEGEYAKLRSKVAGCMSLLISHFDVMGARSNLAAQAEKERIEALVGQFRKLDKNRMMNDEEASRCVTEQRMSELERVDEYRCEKIAERQGVGRVLEGNNEVDRSLAYLSSSATNVTMRWQQGQFVGGGTFGNVYAAMNLDTGHLMAVKEIRLQDPKLIPQVAEQIREEMGVLEVLDHPNVVSYYGIEVHRDRVYIFMEFCSGGSLANLLEHGRIEDEQVIMVYALQLLEGLVYLHESGIAHRDIKPENILLDHNGIIKYVDFGAAKWIARQGRTLAGDVQPSLPNRSMTGTPMYMSPEVIKGENPGKPGAVDIWSLGCVILEMATGRRPWAQLDNEWAIMYNIAQGNPPQLPPSDQLSPQGLDFLKRCFTRDPRNRSSAVELLQHDWITSIRSQVVEPATPSDTSSSAQSTPTVGSISSKLGGSDGFY

SEQ ID NO: 5538 - protein, 413 aa, Picea sitchensis
MSQSIFSAATTMESSMVAYSCSSTPLSRGSEPRLMSRPSLASPARIPSITFRQTAKESSIYGEPLRTWPKSCARRMASARKASSNSSTLVTKCELGDSLEEFLGKATPNKNLARLMVCMGEALRTIAFKVRTASCGATACINTFGDEQLAVDLLANKLLFESLRYSHFCKYACSEENPEPEDMGGPVEGGFSVAFDPLDGSSIVDTNFTVGTIFGVWPGDKLTGVTGRDQVAAAMGIYGPRTTYVLALKDAPGTHEFLLMDDGKWHHVKETTEIGEGKLFSPGNLRATFDNPEYEKLINYYVSEKYTLRYTGGMVPDVNQIIVKEKGVFTNVISPTSKAKLRLLFEVAPLGMLVEKAGGYSSDGKQSVLDKVISFVDERTQVAYGSKNEIIRFEETLYGSSRLNVPVGAGVKA

SEQ ID NO: 5539 - protein, 489 aa, Salmonella enterica subsp. arizonae serovar 62:z4,z23:--
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYMLQGYDVNDLPYRSGFFPLGPIFAFILCLIITLGQNYEAFLKDTIDWGGVAATYIGIPLFLIIWFGYKLIKGTHFVRYSEMHFPERVKK

SEQ ID NO: 5540 - protein, 268 aa, Oryza sativa Indica Group
MYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQAGASEHARTLGPKGSDPHKAAVIGDTIGDPLKDTSGPSLNILIKLMAVESLVFAPFFATHGGILFKLF

SEQ ID NO: 5541 - protein, 458 aa, Oryza sativa Japonica Group
MASAPFAVSSSPAASAVAARSKVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 5542 - protein, 401 aa, Picea sitchensis
MDPFYGPGRNQLFVPGPVNIPEPVLHAMNRNNEDYRAPPVPALTKKLLADVPKIFKSTTGTPFLFPTTGTGAWESALTNTLSPRDRIISFEMGQFSLLWIDQMKRLNFDVDVVHCEWGTGVDLEILRTKLEADKEHKVKAICCVHNETATGVTNNLAAIRTVIDDCMHPALFLVDGVSSVCAIDFRMDEWGVDVALTGSQKALSLPTGLGIVCASPKALEATKTAKSLRVFFDWNDYLKFYKLGTYWPYTPSIQLLYGLRTALDLIFLEGLDNVIARHTRLGRATRLAVEAWGLKNCTQREEWYSDTVTAVVIPPYIDSTEIVKRAWKRYNLSLGLGLNKVAGKVFRIGHLGNLNELQLLGCLSGVEMVLKDIGYPVKLGSGVAAAAAYLQMTTPLIASRV

SEQ ID NO: 5543 - protein, 556 aa, Zea mays
MEGLGLVFRRAGGGSGSGGRCGASRREDGESVHADRLQLQYLGSVLFYRGALGALLVYDITRRKSFDHIPRWLDELRAHADKNIVIMLVGNKSDLEEQRAVSTEDAKESRDALRNRQLSEQEDRRPHGVGVDANRGAADVPEAVYGRIQVDLRAGELITVTRQDSYGGKKALVLCCVHGPRPECWEARTASSAANMYVIVGLPAGAAHSPCSASSSQSLPAPAVPPSPMERAASVISSLLGGGGGSGAQAATVKSVLVYPIKSCRGISVPQAPITATGFRWDRQWMLVNSKGRACTQRVEPKLALVEVQMPPEAFAEDWHPTPDDHMGIRNILKLRFIFNPLHGAVIRAPGMEPLKVPLSVECATISDVSVWEWTGAAYDEGAEAAEWFSTFLGCPTRLVRFNEDSETRLTDPDYARGYKTMFFDGFPYLIVFQGSLDALNEILKEPIPINRFRPNILVEGCHPYAEDMWKSVKINKLTFQGVKLCGRCKVPTINQDTGIPSPTEPTETLQTYRSGEVLLCSHKNKPQVYFGQNAVCKEFLSANGEGRIVKVGDPV

SEQ ID NO: 5544 - protein, 352 aa, Catharanthus roseus
MANFSESKSMMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGRVVSRGIKFDGFGNILQVIPLPPPYEGEHFEQIQEHDGLLYIGSLFHSSVGILVYDDHDNKGNSYVSS

SEQ ID NO: 5545 - protein, 212 aa, Tropheryma whipplei TW08/27
MFKVLVIDNHDSFIYTLVNYLQQLGVTTSVVRSDNNCHSVESMLGVHDAALISPGPGTPEESGITLSVIRAAYSTSTPLLGVCLGHQALAVAFGGDIGPSGRIMHGKLVTVRPRPSAIFKDLPTAFTATRYNSLTVTKVPQALRVIARADCGEVMALEHRTAPMYGVQFHPESAVSEWGFRILGNWLYISGFNKALGISRDLPIVVYNTRVR

SEQ ID NO: 5546 - protein, 826 aa, delta proteobacterium MLMS-1
MNDITLQINDQSVNASAGMTILEAASRAGIRIPTLCQVDGKNSEVPCELCLVEVEGQTAPVKACATPVADGLKVITENKELVEHRRERLAVLAETHFGDCKAPCNLTCPGQINVQGYIAHVAKGQYEEAVRLVMERNPFPFSVGRVCPRFCETRCRRLLVDEAVSINHLKRFVADWCMTNKVDLRLTTAAATGQRVAVVGGGPAGLTAAYYLAQRGHEVTVLEAAPKLGGMLRYGLPRYKVPENVLDYEIGTILRMGISVRLNQRWGRDFTLQGLQEQGFAAILLAVGACYDESLDIEGGSLPGVVPALKLLRRANEGDKTDYGRRAMVVGGGNTAMEAARTLLRRGVEQVTVLYPRAQTEMPANQRNIGEAKEEGVQFLLMASPVTIQEGEQGLDVDLIRMKLGEPNDKGLRFPEAIPGSNIAMNVDTVVVASGQSATGDGVLGGELEEKLELTPKNNIKANPRNFQTNLPTIYAAGDATSGPRSVIQAVVAARRAADNIHAQLLGLGKEAPASRFNFSRGKSFEQVDLRNFEGIRVNLREKMPSRPPERAIQDFNEVRLGFTEQMAKSEAERCLSCGCTAFDRCDLKEQAIAHGVDPNKTGMGTTPRYARQEEHPTISVDLNKCIYCHKCANSCEYRALEITAGSFDEQGRAQDLSLTFMEHCVSCGKCVDNCSTGALNKKDQIVPITDEEIRLVPTTCPYCGAGCQMNLKVKGDTIIEVTADPELAPNYGALCVKGRFGFHFVQDRRRLTRPLIRRGGQLVECSWDEALNYTAKRFFDIKAMYGSDAVAGFSCARATNEENFLMQKFMRTAIGTNNIDHCARL

SEQ ID NO: 5547 - protein, 339 aa, Neisseria meningitidis MC58
MKKILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFSIVFSSSATVYGDPGKVPYTEDMPPGDTTSPYGASKSMVERILTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLTQMMEDSWRWVSNNPNGYDD

SEQ ID NO: 5548 - protein, 393 aa, Solibacter usitatus Ellin6076
MSTTAAAFRNRFRSQRISRFTESVIREMSRLAIRHGATNLAQGFPDFPAPEALKRAAAEAIDSDINQYAITWGAKPFRDAIAAKYQRTYGMEFDPEREITVCCGATEGMVASLLAVVDPGDEIVLFEPFYENYGPDSQLCGAVPRYVKLQAPDWNFDPDELRAAFGPRTKAIILNSPNNPTGKVFTRQELEFIAGLCQEFDVLAITDEIYEHILYDGAVHIPIMSLPGMRDRSILVNSMSKTYSVTGWRVGWVLASPDLTDSIRKVHDFLTVGAAAPLQQAGVLALSLPEDYYEHLSTEYSGRRDHIVESLEAVGFKCFVPHGAYYVMTDVSGFGFSDDTSFVRHLITNLGVAAVPGSSFYAHPATGSQQVRFCFCKKYETLELARSKFLKLQ

SEQ ID NO: 5549 - protein, 338 aa, Enterobacter cloacae
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAKELRQQEKDLGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 5550 - protein, 467 aa, Burkholderia pseudomallei K96243
MSLFRKKNVDRMIAGAQAAGLKKALGAVDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPANWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 5551 - protein, 158 aa, Streptococcus vestibularis
MRRMLTAKLQNRSGVLNRFTGVLSRRQVNIESISVGASEDPNVSRITIIIDVNSQNEVEQIIKQLNRQIDVIRIRDITDQPHLEREVILVKVSAPTSKRAEILAIIQPFRASVVDVAPSSITIQMTGDAEKSEALLRVIRPYGIKNIARTGATGFTRD

SEQ ID NO: 5552 - protein, 432 aa, marine gamma proteobacterium HTCC2143
MIHEVLINFYSTEFSMSYQHIQIPDTGEKITVNADYSLNVPDQPIIPFIEGDGIGVDITPVMVKVVDAAVEKAYGGHKKISWMEIFTGEKAAEMYDGDWFPAETLDAIKDYSVGIKGPLTTPVGGGFRSLNVALRQELDLYTCLRPVRWFEGVPSPVKEPAKTNMVIFRENSEDIYAGIEWRAGSPEATRVIEFLQNEMGVTKIRFPDNCGIGVKPVSKEGTDRLVRKAIQYAIDQDLPSVTLVHKGNIMKFTEGAFKDWGYQLAQNEFGGELIDGGPWVSLKNPNTGTDIVVKDVIADAMLQQVLLRPDEYSVIATLNLNGDYLSDALAAQVGGIGIAPGANLSDNIALFEATHGTAPKYAGQDKVNPGSLILSAEMMLRHLGWNDAADLIIGGMNGAIQARTVTYDFERLMGDATLLKCSEFGDAIIAKM

SEQ ID NO: 5553 - protein, 151 aa, Picea mariana
KKAKEKGVSLLLPTDVVIADKFAADANSKVVPASDIPDGWMGLDIGADSIKTFSEALDTTKTVIWNGPMGVFEFDKFSLGTTSIAKKLAELSGKGVTTIIGGGDSVAAVEKVGVAEKMSHISTGGGASLELLEGKTLPGVLALDEAVPVTV

SEQ ID NO: 5554 - protein, 485 aa, Glycine max
MALGNNSHQLLSKIATNDKHGENSPYFDGWKAYDSNPFHPTKNPQGVIQMGLAENQLCFDMIQEWIRNNPKASICTAEGVNQFKYIANFQDYHGLPEFRNAVANFMSKVRGGRVRFDPDRILMSGGATGANELIMFCLADAGDAFLVPSPYYPAFVRDLCWRTRAQLIPVECHSSNNFKITREALEESYRKAKEGNINVKGLIITNPSNPLGTTIDKETLKSIVGFINEKNIHLVCDEIYAATVFRAPSFVSVSEVMQDMEHCKKDLIHIIYSLSKDLGLPGFRVGIVYSYNDEVVNSGRKMSSFGLVSSQTQHFLAALLSDDEFVERFLAESARRLAARHSHFTKGLEKVNITCLPSNAGLFFWMNLKGLLKEKTFEGEMMLWRVIINEVKLNVSPGSAFNCPEPGWYRVCFANMDDETVDVALMRIRAFVGKETGKPPKELKRWKSNLRLSFSNSRRFDENLMSPHMMSPHSPMPHSPLVRAT

SEQ ID NO: 5555 - protein, 108 aa, Brassica napus
KNKKSNRQDWCCVVLGSGCLVVFFFFEIGQILAPLPIGFAVFLVHLATIPITGTGINPARSLGAAIIFNKDNAWDDHWVFWVGPFIGAALAALYHVIVIRAIPFKSRS

SEQ ID NO: 5556 - protein, 144 aa, Agrobacterium tumefaciens str. C58
MATFVKDLLDRKGRDVVTVGPDVSIGEAAGTLHAHKIGAVVVTDADGVVLGIFTERDLVKAVAGQGAASLQQSVSVAMTKNVVRCQHNSTTDQLMEIMTGGRFRHVPVEENGRLAGIISIGDVVKARIGEIEAEAEHIKAYIAG

SEQ ID NO: 5557 - protein, 335 aa, Polaromonas sp. JS666
MSQRISLTRYLVEQQRREGHIPAQLRLLLEVVARACKGISQSVNKGALGGVLGTAGSENVQGEVQKKLDIIANEVLIEANEWGGHLAAMASEEMDSIYLVPNRYPQGEYLLLFDPLDGSSNIDVNVSIGTIFSVLKKPDDHAGVEEKDFLQPGNKQVAAGYCVYGPQTTLVLTVGDGVAMFTLDREQGSFVLIEENVRIPEDTKEFAINMSNMRHWDAPVKRYIDECLQGTEGPRGKDFNMRWVASMVADVHRILSRGGIFMYPWDKREPEKAGKLRLMYEANPMGWIVEQAGGSATNGKQRILDIQPGKLHERVSVILGSKNEVERVTGYHSGL

SEQ ID NO: 5558 - protein, 780 aa, Candida albicans SC5314
MSSPTSLDDLSNMPETGNTIKTLHELKQESSPDSNNEMNIDGEMSNDNSNHSNSNHKMHTYDGDFVMDNEYNDYEELRKSLVNKRRLSSIKRPHGPFLDHNNQIDKRSLLRLPTEILLQIFHYLERRDWYSLLTTCSEIADLIIEMLWFRPHMQNDSAFKKIKEVMEINKSVTHWDYRQFIKRLNLSFMTKLVDDELLSLFIGCPRLERLTLVNCAKLTRYPITQVLNGCERLQSIDLTGVTDIHDDIINALANNCPRLQGLYAPGCGNVSEEAIIKLLRSCPMLKRVKFNSSTNITDESILVMYENCKSLVEIDLHGCENVTDKYLKSIFLDLTQLREFRISNAPGITDKLFESIPEGHILEKLRIIDITGCNAITDRLVEKLVSCAPRLRNVVLSKCMQITDASLRALSQLGRSLHYIHLGHCGLITDYGVAALVRYCHRIQYIDLACCSQLTDWTLVELANLPKLRRIGLVKCSMITDSGILELVRRRGEQDCLERVHLSYCTNLTIGPIYLLLKNCPKLTHLSLTGISSFLRREITQYCREPPSDFNEHQKSLFCVFSGHGVNQLRNYLNQVVEERTYQIDQGDIHTLFNERRRRFLNGDIDMDEEEMNIWERRRGLGVTADLGHPDMAEINREIFRELNEGNMGPDEMREHFQRLIRNHHQQRLLEHQNRLNQQLVQQRQQQQQQEPQLEQENLQNRGQVETQAPDQLPNEGQLRLQPPLQQQRAQNTIINNPQNAPQIEQPAVFPNGENQTLPLVLNEDEDVDMEPVDLFPRNT

SEQ ID NO: 5559 - protein, 84 aa, Anabaena variabilis ATCC 29413
MSQSETFEKVKSIVVEQLSVEDPDKVTPEASFANDLQADSLDTVELVMALEEEFEIEIPDEAAEKITTVQEAVDYINNQVAASA

SEQ ID NO: 5560 - protein, 104 aa, Zea mays
AQNLTDDGLACISRCGRLTYLNLSWCVRVTDTGIVAFALGCRALELLSLFGIVGVTDACLEALSKSCSSSLPTLAVNGCIGIKRRSRDDLLKLFPSLSCFKVHS

SEQ ID NO: 5561 - protein, 540 aa, Ustilago maydis 521
MVKRRRKTRTHLKGPNNSAATSTSAPKSFIIRTGKVARSVSSLVQDTRKVMEPNTATRLRERNSNKLKDFISMAGPIGVTHLLIFGQTDAGTNLRILRAPRGPTLTFRVNKYALSKDVQASSRRPAPPGSEFVTPPLLVLNNFGGEERQIKLLVATFQNLFPPIQVQSMKLSQARRIVLLNYNSATGTIDWRHYLISVRPVGVSKSVRRVVEGSRSTSRSSRAKLPDLSSTQDISDYVLGRTTSTSCTNGEFETDASEAESEAEDVADPRNKVHLHDRYVGRGNAANTQKAVRLREIGPRMELKLVKIEEGCNQGAVLFHEYVKKTAHEEAQLQREHMEKLKLQKQRREQQQENVERKKHDKAELRKASRRNAGLGSEDDATDGSHDEQEEENDEEEDEFAYEDQYGDHANDDQIDEDEELFDDAQLSSDNDREQDDDDDDDDDDDNDDPPTWIPSRSASGGYDNPPGVDPHSDDSDLEPIPLGGMQHDYSSAEDWPEYSDDDDTPAPSAATNQSKSTAASKTLSKPKFAAASQRKKSRR

SEQ ID NO: 5562 - protein, 270 aa, Zea mays
  misc_feature (5)..(5): Xaa can be any naturally occurring amino acid
GPDGXPRRSYAAAPVCKWLIARNGTGQGSWAPIGLMNLNKGFMETWYYMKDAVPEGATPTEKAYGMPLFEHLGSDEALNTLFNQAMAGHSEIVISKLLEVYRGFEGVDVLVDVGGGTGSTLRMVTAQYKHLRGVNYDLPHVIAQAPPVQGVEHAGGSMFEYIPSGNAILLKWILHLWRDEECIKILKNCHRALPANGKVIVVECVLPASPEPTQVAQGALLLDVVMLNRLRGAKERTEREFAELAAEAGFSGGCRATYVFTGAWALEFTK

SEQ ID NO: 5563 - protein, 224 aa, Photobacterium sp. SKA34
MKNFLIAPSILSADFARLGEDVDKVLAAGADVIHFDVMDNHYVPNLTFGAPICKALRDYGITAPIDVHLMVKPVDRIIPDFAKAGATMITFHVEASDHVDRTLQLIKENGCKAGVVFNPATPLHHLDYIMDKVDMILLMSVNPGFGGQSFIPSTLDKLREVRKRIDASGRDIRLEIDGGVKVDNIREIAAAGADMFVAGSAIFNEPDYKVAIDKMRAELAEAKC

SEQ ID NO: 5564 - protein, 253 aa, Bacillus subtilis
MNLTDKTVLITGGASGIGYAAVQAFLGQQANVVVADIDEAQGEAMVRKENNDRLHFVQTDITDEAACQHAVESAVHTFGGLDVLINNAGIEIVAPIHEMELSDWNKVLQVNLTGMFLMSKHALKHMLAAGKGNIINTCSVGGLVAWPDIPAYNASKGGVLQLTKSMAVDYAKHQIRVNCVCPGIIDTPLNEKSFLENNEGTLEEIKKEKAKVNPLLRLGKPEEIANVMLFLASDLSSYMTGSAITADGGYTAQ

SEQ ID NO: 5565 - protein, 341 aa, Oryza sativa Japonica Group
MASASLSLRLPTPSTAPSSGASSSFLSLPPTLLRQARGGAAASSALVARAASGGSPNPLFNPRADPFLSTLAAASPEELQAAAAGGGRRGDDHLPFLEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKTEIHTLCIGAAAGHACLVLAAGKKGKRYMFPHAKAMIQQPRIPSYGMMQASDVVIRAKEVVHNRNTLVRLLARHTGNPPEKIDKVMRGPFYMDSLKAKEFGVIDKILWRGQEKYMADMLSPEEWDKVAGVRRPDIM

SEQ ID NO: 5566 - protein, 230 aa, Oryza sativa Japonica Group
MASASLSLRLPTPSTAPSSGASSSFLSLPPTLLRQARGGAAASSALVARAASGGSPNPLFNPRADPFLSTLAAASPEELQAAAAGGGRRGDDHLPFLEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKTEVHILHQCVLQYFSYYYYYYYFVH

SEQ ID NO: 5567 - protein, 170 aa, Oryza sativa Japonica Group
MATLARVSLPSVLLTLRHGATTQGFAAARPAAVVAKRLLGSVRCGGAAEALGADMAVPRSVPVRVAHELQQAGNRYLDVRTEGEFAGGHPVGAVNIPYMYKTGSGLTKNTHFLEKVSTTFGKEDEIIVGCQSGKRSLMAASELCSAGFTAVTDIAGGFSAWKENELPTNK

SEQ ID NO: 5568 - protein, 991 aa, Brachyspira pilosicoli
MSDVMTPIPFGNLMNWVLEEKKSGKVFGISRAFKADKAKYYEIFGRKLETPIGPAAGPHTQLAQNIIAAYYTGSRFFELKTVQKMDGEELSKCVAKPCITANDECYNCEWSTELYVPQAFDEYVKAWVALKVIAKEWDLGEMDGFQFNMSVGYDYEGIKTEKIDNFIEGMKNASNTPIFKECKEWLTNNISRFKNFKKEDIDKINADICNSVTLSTLHGCPPTEIEKIASYLITEKKLNTFVKCNPTLLGYDYARKTLDEMGYDYISFTDFHFNDDLQYSDAVPMLQRLQKLAEDNSLAFGVKITNTFPVDVKQKELPSEEMYMSGKSLFPLSMTVASRLSKDFDGKLRISYSGGCDYFNINDVIDAGIWPVTMATTFLKTGGYQRGEQIAKNLKEPKAFTKVDVAKTEKIIEWGKKSKHHVKPIKPLASRKVNKKVPLVDCYIAPCMETCPIHQDLTTYIRLNSKGQYEESFKVIIEKNALPFATGILCPHTCMDKCTRQFYEEPVSIRACKLEAAKAGYSKVIGTLKAAPSIGKKAGVIGAGPAGLSAAFFLARAGVEVTVFDKREKAGGVVANIIPRFRITAEEIGNDISLCKQMGVKFELGKEIKDIKEFAKNYDYTIVCIGAHKNMPLKLEAGESMNALKFLEEFNKTNGNVELGENVVVIGGGNTAMDAARAAKKNKGVKNVRLVYRRTKRYMPAHEEELKEALEDGVEFMELLAPVKLENGKLLCKKMELSDYDEKGRRNVVETNETVEVPANTVIASIGEQIESDFYKSNGIDVDDKGKPKCNANNESSIKNVYIAGDGLYGAATIVEAIRDARVVAESILGKAIAPDLASVSTEEISYSKKGNLKEVSKDPEATRCLSCDYICESCTEVCPNRANVSIKVEGGAKISQIIHVDYMCNECGNCETFCPYSSAPYKDKFTLFATADDMKNSKNDGFLFLDKEGNAKLRIDGKEESYKAGSSKNFNGVYSIVDSVFNNYKYLILK

SEQ ID NO: 5569 - protein, 406 aa, Photobacterium sp. SKA34
MTTEQRVERNLFDKVMVPCYSPMAEIPVRGSGARVWDQHDREYVDFAGGIAVSCLGHCHPIMVNALKDQADKLWHLSNVLTNEPALRLAKKLTELCFADKVFFANSGAEANEAALKLARRYAVDKFSAEKDQIIAFHQGFHGRTFFTVTVGGQEAYSDGFGPKPQAVTHIPYNDLSALAEIMSERTCAVMMEPLQGEGGLVSPSVEFVQGVRELCDKHQALLIFDEVQTGNGRTGDFYAYQGLGVTPDILTTAKSLGGGFPIGAMLTTTELAEHLKVGTHGSTYGGNPLACAVAEAVINEVSKPDVLAGVKEREQWFREGLTAINAKYPIFAEIRGKGLLLGASLTEEWQGRARDILVQAGKEGLMMLVAGTSVVRFTPSLVIEKADVDEGMARLERAIATLYNAE

SEQ ID NO: 5570 - protein, 411 aa, Arabidopsis thaliana
MRSCLLNLAALTEGSFSFSATQTSKFKGFLSLKTQVTINQEATSLTGVSGAGQPSAATPSDPPPPPVAPMFIPKTEPGICMSKKTKSKVSTLTQRKRQYLQDGDVTEIAPPLFLSCYRENRRLLAVRDRKYPELKFPSETPYSSCFLTEEGLGRYKVIGNRCFNDMRFLPLDGNNTASTQQLLFNGGLLPTVTEIDSYVHEVVMEFYANLPDGEEGDNLAYSVFVRRNMYEFSLAIINQMFQLPNPSYPLDGMSEIQVPESMDEVAIALSNGKANSWKMLTSRLLSPELALLNKICCHNWSPTVNRSVLKPERMTLLYMVAKALPFNFGKLIFDENLGRIVRSDEGDTTSSAPLKFTMEVKPVPLLQSDSPTLDAALETLIASLTTMHVRLADYLRCHTQIKRGRLKKQSV

SEQ ID NO: 5571 - protein, 195 aa, Synechococcus sp. RS9916
MANLDQAPSRSMPNLLHVLPAFADEAELRLNTIVELNSNTINKYELITETGHLKLDRVGYSSLAYPFAYGCIPRTWDEDGDPLDIEIVGVTEPLIPGSIVEARIIGIMTFDDGGEVDDKVIAVLADDKRMDHIKSWEDLGDHWKKETTYYWEHYKDLKKPGTCSVNGFFGTEKAVEIIKSCEARYMAEIDPKLVD

SEQ ID NO: 5572 - protein, 515 aa, Glycine max
MLSSLLNPSFTTTLPIHSILIPNNRRASTVVSCTSSHLTTNNHSHVSSPPNIKDEARRRPAAENDFTAKYVPFNAGFDSPETYSLDEIVYRSRSGGLLDVQHDMEALGRFDGAYWRALFDSRVGKTTWPYGSGVWSKKEWVLPEIDPDDIVSAFEGNSNLFWAERFGKQFVGMNDLWVKHCGISHTGSFKDLGMTVLVSQVNRLRKMNRPVVGVGCASTGDTSAALSAYCASAGIPSIVFLPANKISTAQLIQPVSNGSLVLSINTDFDGCMKLIREITAELPIYLANSLNSLRLEGQKTAAIEILQQFNWEVPDWVIVPGGNLGNIYAFYKGFKMCKELGLVERIPRLVCAQAANANPLYLHYKNGFKDFNAVKAETTFASAIQIGDPVSIDRAVHALRNTEGIVEEATEEELMDAMVQADSTGMFICPHTGVALAALIKLRNRGVIGAGERVVVVSTAHGLKFAQSKIDYHSGLIPGMGRYANPLVSVKADFGSVMDVLKDFLHNKSPDFNKS

SEQ ID NO: 5573 - protein, 282 aa, Tropheryma whipplei TW08/27
MVFVLTYVPSVLLGDGVSIPQFGLGTYELPPNETSSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHINKIKEAGFPLPSVNQIELHPWLQQRELVLSCRNYGIQIESWGPFARFSKDLDAFPELTRPAKEYGKTPAQVILRWHIQKGYVVFPKTVHAERLRQNIDIFDFDLTPDEISGIDSLDAGFRTGPDPSSFRAGLD

SEQ ID NO: 5574 - protein, 445 aa, Escherichia coli O157:H7 EDL933 [sequence omitted]

SEQ ID NO: 5575 - protein, 349 aa, Clostridium tetani
MILQEQELKWSLEKGKSNMTIKGITFIGGGSFGTALGIMLAKKGYNINIWDRKPHVIADINEKKENIKYLPNVVIPSNVKAYKGMKEALVGIKYVVISVPSHAIREICRNMKDYLKEDAIIISVAKGIEEHSGKRLSQIIKEELPKNPVVILSGPSHAEEVAQDIPTTVVVTSEDVKASLEVQNLFSTNKFRVYTNDDIIGVEIGGAVKNIIALAAGISDGIGYGDNTKAALMTRGINEIIRIGEKLGGQRETFWGLTGMGDMIVTCTSMHSRNRRAGLLIGKGLSMEEAIEEVGMVVEGIKACKAFYELKEKLKVSMPITDALYRVLFQGEDAKYCVYELMTRDKKDE

SEQ ID NO: 5576 - protein, 397 aa, Brachyspira pilosicoli
MGIQKYISKLDSLEFGKMYKNDFFLTWDKTFDELQAVWTVADALRFLRESNISTKVFDSGLGISLFRDNSTRTRFSFASACNLLGLEVQDLDEGKSQIAHGETVRETANMVSFMADVIGIRDDMYIGKGHEYMKEVSESVRQGYNDGILEQIPTLVNLQCDRDHPTQMMADSLHFIHELGGLENLRGKKVAMTWAYSPSYGKPLSVPQGAAGLFTRLGMDVALAYPKGYELMPEVEAIAKKNAEAAGVKLTITNDMDEAFENADVVYPKSWAPFAAMQERTDLYGKGDTDGIKALEKRLLEQNAKHKDWCCTEEKMKKTKDGKALYLHCLPADINDVSCKDGEVAASVFDRYRVPLYKQASYKPYVIAAMIFLSKFRDPQAILSKLASDGKPRVFGY

SEQ ID NO: 5577 - protein, 465 aa, Tropheryma whipplei TW08/27
MSVKKNHKIVVIGGGPGGYSAALSGALLGADVVLIENQAVGGSATLTDVVPSKTLIASAERAVFVAQGADFGIRFQNCVSADIGHINRRIMDLTRAQSADMFSTLTGAGVRVVYGHAALDGPNRVLVSVSGQEKYEFFANTVVVATGSSPRVLPNAIPDGKRILTWKQLYTLEQVPEHIIVVGSGVTGAEFASAFRNLGSEVTLVSSRDRVLPGGDEDAADLIQEVFINSGMKLLNRARAQAAAACNGGVVVTLTDGTEVRGTHCLMAVGSVPNTSGIGLETANIALNPAGRITVNRVACSSVPGVYAAGDCSDFLPLASVAEMQGQVAVYHAMGENANPIELKNLASTVFTTPEIATVGRSEKAIDKARATALKVDLATNSRAKILGIKTGFVKMIVSRETGTVLGGVVVAPNASDLIFPISVAVQNRLSADQLSQSFAVYPSLTISLWHAARASHVRTDSASP

SEQ ID NO: 5578 - protein, 508 aa, Anabaena variabilis ATCC 29413
MNQSAFTSPHNTGLLANRYQLQKLIGIGGMGEVFLATDVLLGGAPVAIKFLTQTVSDPKIQKDFAREALMSAALSQKSLHIVRAYDYGVSDTGKPFYVMEYLNGKSLKDLIPLPLNQFVHLTRQICLGLQCAHQGIQIEGKVYPLVHRDIKPANILVIPDPILGQLVKILDFGIAKFLNHTVTLSTNRGFHGTLPYCSPEQLDGEKLDGRSDIYSLGVIMFEMLTGAKPWQPETDLFGAWYKAHNFEKPRTIADVKPQLKIPQQLNDLIMACLEKKASDRPQNVGEILRTIDGLEQSDCAGLPTNISPPSYPKLISASDVIKALEQQCKELTWPQDKPKKEIVFPLPLNTHQKNLSTLWLMLPKKEIQQRANSKIYNRFIFVTSPHPMLLWVTLLYNQEQEPKWLPCYLDMQHPLNRTLVLSLADNETYPLICFTLEPPHRCIQVLSSNIETSQRQKLKIWVEQSQKLPPTSQPLASKNLLRQQYKQIQAHMLQHLSSTRRLEKLAKG

SEQ ID NO: 5579 - protein, 294 aa, Brucella melitensis 16M
MWWPAPRKTAQKISGKGYIMTVPTVKLNDGNHIPQLGYGVWQISNDEAVSAVSEALKAGYRHIDTATIYGNEEGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 5580 - protein, 487 aa, Legionella pneumophila str. Lens
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLVITYINLAKVDTFGEIEFWLALIKIISLLAFVFLAILIFFGLIHGSEPPGIIGFKYLLDDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 5581 - protein, 494 aa, Thermus aquaticus
PLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGPKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 5582 - protein, 379 aa, Prochlorococcus marinus str. MIT 9515
MNHPFKKNAKLVLSNGTTFSGYSFGAVGTTLGEIVFNTGMTGYQEVITDPSYFGQILTFTYPEIGNTGINFEDSESDNCVKGLIVRNYSNNNSNWRSQISLNQWLIDNNIIGLYGVDTRALVKILRSNGSMNGLITSENNNLDSCLKLISNAPDMNGLNLSREVSTKNNYFWKETTKTSFDIRKKDIGTKNKLKIVAIDFGIKKSILNRLVSHGCEVLVLPSHSSFEDVLGNNPDGIFFSNGPGDPSTVLDGINLAKSLINYGKIPMFGICLGHQIFGLALGGETYKLPFGHRGLNHPCGMNNNVEITSQNHGFAIDPNSLSNEIVEITHLNLNDKTVAGLKLKNKPIFSVQYHPEASPGPHDSDYLFENFVSLMLERC

SEQ ID NO: 5583 - protein, 370 aa, Rhizobium leguminosarum bv. viciae 3841
MLKELSMSDLGWNPLHGVPSYPAERYAVLADRIGGILRSRNDIVLMQAEAVVALEAAAVSLARPGLSALNIITSTYGGWFGQWLRRGGATVRDIVAEPGLPIEIEAVAKALDAGPHIDVLALVHAESASGSLNPLPEILALARARGVVTVVDAVASVGGHRLDVDDLGIDIAVIGPQKALGGPAGVSALSVSGRAWHLILRDGAPRDSILSLADQKSWVDGGRRGLPGTPAPLEFFALEKALDRIEAEGLENVVARHALAASATRAGLAALGAPAWVPAAKASNLVTAVPVPKALAPAALIAAAGQLGVELTEGVGTAPARLMRLNHTGPRAAFQTVLSNVVAYGAALRQAGHPSDIAAASEAISAAYRS

SEQ ID NO: 5584 - protein, 96 aa, Triticum aestivum
  misc_feature (28)..(28): Xaa can be any naturally occurring amino acid
FRPLVREKGWFLNLCELARIWKGGCIIXRSSFLDRIKKAYDRNGELVNLLIYHVFAQDIMDRHAAWRRVVCLAINNGVWTPGMSVSLAFFDSYRWD

SEQ ID NO: 5585 - protein, 458 aa, Aspergillus oryzae
MSNLPIEPEFEQAYKELASTLENSTLFQKNPEYRKALAVVSVPERVIQFRVVWEDDNHQVQVNRGFRVQFNSALGPYKGGLRFHPSVNLSILKFLGFEQIFKNALTGLNMGGGKGGSDFDPKGKSDNEIRRFCVAFMTELCKHIGADTDVPAGDIGVTGREVGFLFGQYRKIRNQWEGVLTGKGGSWGGSLIRPEATGYGVVYYVEHMIKHATDGKESFAGKRVAISGSGNVAQYAALKVIELGGSVVSLSDSKGALIVNGEGSFTPEEINTIAQIKVDRKQISEIASTEAFASKFKYIPGARPWTHVGKVDIALPSATQNEVSGEEAQALIDAGCKFIAEGSNMGSTQDAIDIFEAHREANKGASAIWYAPGKAANAGGVAVSGLEMAQNSARINWTSEEVDARLKGIMEDCFKNGLETAIEYATPAEGVLPSLVTGSNIAGFTKVAAAMKDQGDWW

SEQ ID NO: 5586 - protein, 1012 aa, Ustilago maydis 521
MASFFQKARERAEAAAQQLQAHHAASSATKINDTSASANVTASGAGSASSFTYTGSVPHLFRQGLASVDPRYESTRQFHLLSQAFKSFNIDHEAAGREARGLAKATFVWGQHHLPEKRDDSVGDEMLADVTDRLAYVWHELGQLETAHSQRSEQARGRLKSFEKAEMELGQRRAHRSKLRKELHALVPERAIAAGSSRVQDLETRLEQLINDDQADEEYLSRTKRQSVKEGYAAMFDSLIELGEKMALVARYGKLLTTLMPIEKSPFPGTVKQRGDNIPLWEGASKTADVRAALASALSSFRPDLSLPILPADSALAATSSLGRTDTVSYAVSHQSELQADYTAPVVSPAAAPLAQLSSPRSPGLSPDRSDMVQLANPTSQHSGSGSAQKLNLSPSALPVPLLPPRPQRSPSATTVDTLRSPAADPFADSAAAAAPSSSISAAQTEEALPPPGPPGPTVAETGVVPSGPGGPKSGTLQPRRSSASQRSVSISAGAVAYLGPTGTYSHQAALKVFGATGTNLIPMQSITGAIDFVRRGTPGNAKIAIVPIENSTFGPVRDTLDNLLGISNGDRHAFKPADGAQLHVVGEACLSVDHALLCGPKTYHHLLQLQGDTDPNAPIRDDTLSNITNVISHEQALGQCSHYLTRYMPQAKKRAVESTAAAAITALEFEAGTAPGRTSTSIDHAHESLGFSSNSLVAAVGAEVAVTAVGVRVLRSRIQDVKDNRTRFLILASEPLEALLSINALPLTISRLYSASSAARKTGRSLLSVSDTLVSDLAAEADNYSSSDSSVLDRLVAQLAKLNDVSVRKLDRRTASTSEAFAASGSSVWRSSYLVELQYAGASAAVAEDKIRRLVAELSIGSSATRLLGDTAPVKHLGSWLVDATMLRGESTDNAGGQAAQSVLTAGPSGSHLSQSTLPGSLQLTERERKETEARQEAAEVQRHAAQARLSRQQQQADLYRVEAQPSGSSTSGSRLTLPLAGLQESEAEPRLDEEEGLPAYQPLDPGSRSR

SEQ ID NO: 5587 - protein, 364 aa, Listeria ivanovii
MTTIDSSSKKDGFRMPGEFEKHTGCYIIWPERPDNWRLGAKPAQKAFVDVATAISKFEPVTVVASSSQYVNARYMIPDEIRVVEMDNDDAWVRDCGPTFVINDSGDVRGVDWSFNSWGGLVDGLYFPWDKDDQVAQKICELERKDRYRLADFVLEGGSIHVDGEGTLVTTEECLLSEGRNPQLSKKQIEMVLKEYLNLEKIIWLKRGIYLDETNGHVDNIFNYVRPGVVALAWTDDESDPQYEISKECFDILSNETDAKGRKLEVHKIHVPKPILITDEESKGVDAVEGTLPREEGDRLAASYINYYTANGGVVFPLFGDPNDELAREKLQQLYPDREVVGVKAREILLGGGNIHCITQQVPRG

SEQ ID NO: 5588 - protein, 333 aa, Aspergillus oryzae
MSSTQSRYAKAHESLGGPGDARPTALQIVQDENRVNDLTDKVIMITGCSSGLGIETAKALFHTGATLYLTARDLGKAKTALGDLVDSPRVHLLHLDLNSLASVRACAEEFKSKESTLNILIEDAGVMACPEGRTADGFETQFGTNHLAHFLLFYLLKPQFLSSSTFSFQSRLVVVASSAHRVSSVHFDNITLEGEYEPWKAYGQSKTANIWTANEIERRYGSQGLHAFSLHPGAIATELLRHVSDEQKSVWDADDWLKKYWKSPEQGAATSVWGAVARDLEGTGGKYLDNCQIASPADPTKRHGPGYATWAYNPDGEAKLWAKTLELLELKDE

SEQ ID NO: 5589 - protein, 412 aa, Saccharomyces cerevisiae YJM789
MSELHALLTFPERPISQSYYVPKLQHFLKSGIPATYTLEQVAAFEHEEKNRNGDKEFRESTDDNKTSNTTPLHVLARSLPLDIKDEELQVVMDMMNILFEYGAGWNFIDYEDKTVGDLFLERNQSRESPLYRRLVEAGVSAELLLRKLNGGDVEFLDTDELIDIEPEESVQTAVDGQKEESVGSDDDATAANQQVYLKTELEYKDDALITKENKDGVMMDWETKIMELASETLFPDPEATNSATILNIGFGMGIIDTFIQARKPYRHYICEAHPDVLAKMKMDGWYEKDNVVILEGRWQDTLNNLLDKGEVFFDGIYYDTFSEHYQDILDLYDVVVGLIKPEGVFSFFNGLGADRSLCYDVYKEIVEIDVATYGMKCDYTRYSLDEQLPDWNDVKRSYFNCNYYYHPRITFA

SEQ ID NO: 5590 - protein, 635 aa, Xylella fastidiosa Temecula1
MIDFTCYPRLSRIQTPEDLRAFQESELRAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 5591 - protein, 120 aa, Listeria monocytogenes
FNYVRPGVVALAWTDDETDPQYEISKECFDILSNETDAKGRKLEVHKINVPKPILITDEESKGVDAVEGTLPREEGDRLAASYINYYTANGGVIFPLFGDPNDELAREKLQQLYPNCEVV

SEQ ID NO: 5592 - protein, 165 aa, Oryza sativa Indica Group
SLSRLTTAVVVAAAATLAAGARLATPTMSAPSDPAVATHPQAGAAAAASSSSGLTFKLHPLVIVNVSDHHTRVKAQAACSGDGASSAAAGGQAAEGVRVRDRGAARADGGDLQQLRARPRPCLRDPRPRLLEKKQELYKKVFPDFYVLGWYSTGSDVRDTDMQIH

SEQ ID NO: 5593 - protein, 607 aa, Ustilago maydis 521
MAILSVIIALMFSTLLLIGFPVNQPVGALLDSKMRSGTQSLTASNDSKADLEITEAVGNDQHPGMASMLRPGTNTGMVTSEEYMTEDEKKTKDLKDFGYHKFQWSSLWRPAVINPLNGKSHTFPIFRIWDAYSTAFWLSTLGFFVAFLSWFAFAPLVPEAVKVDLKLSSVQVTHSNMASLGGTAIVRLIAGPACDRYGPRKVMAALLILGAIPSGMAALVQNASGLYAVRFFISILGATFVCCQAWCSTFFDKSVVGTANAFSGGWGNMGGGVTIAAMIGLFERYRHAGLSAHMAWRVCFPTLPVPALMFVAGLILLFGKDHPAGKWSQRHQFSGTAIAIAQGEKIELDSAERAEYERRTADNEKGPAKAAHFREQDPADAGKHVAAVDTAQSEPITLKRLMVILADPRVWMCIVCYLLTFGLETAMDAALPGLITTLFQSKTFTAIDAAYAASMYGLLNLYARPLGGVVSDVLFSKYGLRGRVFWLLVTSFSQGIAMIGLGFYCNRSPTLSGVLWFIFLIGTTGFLANGANYGIPAIICPSAIGTVSGLVGAGGNLGGLLYLGIFLAVPGARPKKTLGTKFWIAGVVNAGAVLPFFAVLLPGKYGV

SEQ ID NO: 5594 - protein, 368 aa, Debaryomyces hansenii CBS767
MKSILRSIVGSPKQSHYDPKLNLLFDLSYITPQIIVCSGPVTNYLQTFYRHSVEDLVKFLTANHDSHWHIWNLRGEEPGYESKDVMSKVSHFPFPDHQPPTIGIFIESTKEIDTFLSQSTKNVAVLHCKSGKGRSGTICCSYLIYKSLNLQLKICPLEAIELYTQKRMRPSAGDGVSILSQRRYLEYWFEYLNITPDLKEIYHGFTKNESMFDLKKSCITMIRINNLKPSDDIKTSCLELDLILETYVKRQDYPNGVQTKHVYQVNSSDIRKQNMNNVIVIPGNPIYISDLKDVRISVKHWCFSWFNVFFETLHSNSTNIFAIDSILDDRFIKGQYTLQWEILDGFKGTHQKGMKLFESLDICWRLYY

SEQ ID NO: 5595 - protein, 2168 aa, Ustilago maydis 521
MAPVATSHENTRQVRFVDKLNVAEQVAVHEEAISSDSLEASGFDEVERSTHFWAGSLPAAQGLYDPDNEKDACGVGFICQIKGKPAHKIVSEARFLLCNMTHRGAVGADARDGDGAGVMTGIPDTFFRRESERDLGVKLPAQGQYAVGNLFFNPKDDNARAEHVHTFTTIADKLGLRVLGWRDVPVDNSILGPASKSKEPKIMQPFVVLKDHYGSGSTPLETSKPFDEQYFGRQLYVLRKHATHTIGLQNWFYICSLSPTNIIYKGQLSPVQVYNYYYDLNNVHYASHFALVHSRFSTNTFPSWDRAQPMRWAAHNGEINTIRGNKNWMRAREGLLKSETFGDELDLLYPIIEGGGSDSAAFDNVLELLVINKVLTLPQAVMMMIPEAWQGSADHMEPEKVAFYQWAACLMEPWDGPALFTFADGRYCGANLDRNGLRPCRYYITDDDIMICASEVGTVTIDPKTVIAKGRLQPGKMLLVDTVEGRVVEDRELKLSTAQRADFAAWLENQLLRLPEIVDTVRRNTANAIAPVLDDERLSTDPKLLAFGYTAEQINLLMLPMVADGKEALGSMGNDAPLACISSAPRVIYDYFRQLFAQVTNPPIDPIRESVVMSLEQYVGPEGNLLEMKPEQCHRLLLPSPILSIDQLNAIKQIDTVHSDWSAKTIDITYDKGEGIIGYERTLDRICSETSQAIRDGYRVVVLSDRAVGADRVAISSLVACGGVHHHLIRNKERSRIALMIESAEAREVHHMCVLLGYGADAICPWLAMEAILKVSREGLVKGDLSPNQLIDNWTHAVDNGILKVMSKMGISTLASYKGAQIFEALGLASDVVDRCFAGTASRVSGSDFTLLAMDALEFHDRGYPSRDTISVPGLPESGEYHYRDGGEAHINDPMAIAHLQDAARERNQASWDAYSKASHNAVKATSLRGLLDFDYTKSRAIPIDQVEPWTEIVQRFCTGAMSYGSISMEAHSALAIAMNRLGGKSNTGEGGEDAERSIPLPNGDSLRSKIKQIASGRFGVTSNYLADSDELQIKMAQGAKPGEGGELPGHKVSPSIARTRHSTAGVGLISPPPHHDIYSIEDLKQLIYDLKCANPRARVSVKLVSEVGVGIVASGVAKAKADHILISGHDGGTGASRWTGIKYAGLPWELGLAETHQTLVLNDLRGRVTVQTDGQIRTGRDVAIACLLGAEEFGFATTPLIALGCIMLRKCHLNTCAAGIATQDPELREKFAGQPESVINFFYYLAEELRSYMAKLGLRTINEMVGRSDLLKVDDSLRTPKTANLDLSAILKPAHEMRPGAATYKVRQQDHKLYVRLDNKFIDEAEPALTQGLPVQIDCDVVNTDRALGTTLSYRVSKLYGEEGLPTDTIHINAKGSAGQSFGAFLAPGITIELEGDANDYSGKGLSGGRLIVYPPKVSPFKAEENVIVGNTTLMGATSGFAYFRGLAAERFAVRNSGAHAVVEGVGDHGCEYQTGGRVVVLGPTGRNFAAGMSGGIAYVLDMNRDFRSKCNTEMVELGPVKDPKEIAELRNLIENHRHYTGSTVADHVLHDFHHILPRFVRVMPLDYKRVLEEEAAKAAVEKKRSSHVDLLGTLSRHGSQVEILPQEDNAKDNAADGVREIPAAKPVEPAVVDVEDSMVDDETAKARLNKLDKTRGFMKYKRLGEHYRNPTKRVKDYKELSTRLSEAELKYQTARCMDCGVPFCQGDTGCPISNIIPKWNDLVFKGQWEDALNRLLMTNNFPEFTGRVCPAPCEGACVLGIIEQPVGIKSIECAIIDKGFEEGWMVPRPPKVRTGKTVAVIGSGPAGLATADQLNKAGHSVTVYERADRIGGLLMYGIPNMKLDKGVVQRRVDLMAAEGINFVTSTHVGRDVDPKQLHAQNDAIVYAVGATWPRDLKVPGREADGVHFAMDFLAPNTKSLLDSGLQDGHYLSAKGKDVIVIGGGDTGCDAQATALRHGAKSIVNFELLPQPPNERAKGNPWPQFPRVFKVDYGHAEVAAQWGSDPREYCISTTSFEKDADGKLIALNTIKVNWELDASGKWQMNKIPGSEKRWPCDLCLLSLGFLGPENDAVTALGLEQDGRSNIKADDQKGKSPYKTNVERVYTAGDCRRGQSLIVWGIQEGRACAAQVDRDLMGNTRLPWAGSIKKREFLPITGAEKTQVAATA

SEQ ID NO: 5596 - protein, 262 aa, Photobacterium sp. SKA34
MEQLFTALWQDYTQRLCPSALSIRQLLTEDAPLKNDHIALRTFALPKCGLARLAAPFIAVGYKPKGQYHFKAKKLYAEHFEHPDPDAPKVFISELQLGLCSTELQTEVRQLVDQVDDDYFANPAFLSQGKPWQLSRDSYQLLNAESEYAGWVAAHGFGANHFTVDINQLEQFNEISEVNHFLESSGFDINQAGGAVKGDPTVMLEQSATMADKVMVTFSDGEMLVSGGFYEFAKRYLQPDGEVYSGFVEASADKIFESTYNS

SEQ ID NO: 5597 - protein, 97 aa, Vitis vinifera
  misc_feature (84)..(84): Xaa can be any naturally occurring amino acid
MEASPSADAAATVESLADGLRNQRLGSENRVLLRLEDLNWDHSFVHELPGDPRTDPIPRQVLHACYTKISPSAEVENPQLVAWXESVAELLDLDPKE

SEQ ID NO: 5598 - protein, 289 aa, Photobacterium sp. SKA34
MSAKHPIIAVTGSSGAGTTTTSEAFRKMFNMMNINAAWLEGDSFHRYTRPEMDTEIRKAKEQGRHISYFGSEANDFAQLEQFFKQYGEDGTGRFRRYLHTFDEAVPYNQMPGTFTPWQQLAENTDLLFYEGLHGGVVDGEVHVAQHVDLLIGMVPIVNLEWIQKIVRDTRDRGHSREAVMESIVRSMDDYLNYLTPQFSRTHINFQRVPTVDTSNPVSAKGIPSLDESFVVIRFRGLNNVDFPYLLSMIQGSFMSRHNTLVVPGGKMSFAMELIMRPLIEKLINTGKIS

SEQ ID NO: 5599 - protein, 408 aa, Arabidopsis thaliana
MGIHFVDKADLWKSALLFNLKLRDRFRIAVDDHRGRATDLTAEEESALFRMLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 5600 - protein, 275 aa, Oryza sativa Indica Group
MAASRLALLLLVLAVAAARHALPAAGSDAHPGYDGAEDTCGVPAAAAAAAGRMEEYGGGRILNITHAYRADLPAYAPGAVTGPVVRLRDSMANGTLYNLSELKMECHMGTQVDAPGHMNQSHYAAGLDVDKLDLDLLNGPTLLVDTPRNTNITAKAMESLNIPKGVRRVLFRTLNTDRKLMWKKGGDLSYVGFTEDGAQWLVDNTDIKLVGIDYLSVAAYDHLITAHVVFFKIPNIILVEGLKLDDVKAGIYMLHCLPLRLVGSEGSPIRCILIK

SEQ ID NO: 5601 - protein, 353 aa, Triticum aestivum
  misc_feature (205)..(205): Xaa can be any naturally occurring amino acid
  misc_feature (292)..(293): Xaa can be any naturally occurring amino acid
  misc_feature (308)..(308): Xaa can be any naturally occurring amino acid
MSAFVGKYADELIKTAKYIATPGKGILAADESTGTIGKRLASINVENVESNRQALREMLFTAPGALEYLSGVILFEETLYQTAADGTPFVDILKAGNVIPGIKVDKGTVDIAGTNGETTTQGLDSLGARCAKYYEAGARFAKWRAVLKIGPGAEPSELAVKQNAEGLARYALICQENGLVPIVEPEILTDGPHDIKACAAATERXVLAAVYKSLNDHKVLLEGTLLKPNMVTPGSDSPKVGAEVIAEYTVAALRRTVPPAVPGVVFLSGGQSEEQATQNLDAMNKLPVLKPXXTLTFSFGRALQQSTXKKWAGKKENSPTRKQLLARCKALRGTSEVRGAPRWGRAASKLPSG

SEQ ID NO: 5602 - protein, 490 aa, Neisseria meningitidis MC58
MNQTSRDLTRISHNTKIVATLGPGSNNVELLEDMIRVGGLNVVRFNFSHGTPEFHQENALIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 5603 - protein, 370 aa, Gibberella zeae PH-1
MAEFVRAQIFGTTFEITSSPPFIAILTRLARRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLSPYHDPTDEPVAEEKFDWSFNDADLPVDTWKIMMYSEILDYHNVEAGVTNMEEQFNGQ

SEQ ID NO: 5604 - protein, 355 aa, Gibberella zeae PH-1
MGACMSSSNEEVDQKKKSQAIDKILEEDSKRLRKECKILLLGSGESGKSTIVKQMKIIHLKGYSEDELFNYRPTVFKNLVECAKAVIMAMQQFDIEPQNEENKAHAEFLLEYQAESGPQAHIDAKVGAAVQALWNDPAKDLLMEHQTEFYLMDSAEYFFQEAMRIVATDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLSRSPLGNYFPDYSGGNDVNKAAKYLLWRFNQVNRAHLNLYPHLTQATDTSNIRLVFAAVKETILNNALKDSGIL

SEQ ID NO: 5605 - protein, 541 aa, Xylella fastidiosa Temecula1
MQWSLSTQGGLPASSTIDNHSLYVSSSNGTLNKIDAQTGSLLWSIPLSNYTGNPHSLSLKSTAIAPQSIVVGDQNSGTLLALNKTSGTLLWKTTIEPNLNAKITSPPTIYEDRVYVGVYSGKSQSNIAALDLKTGQPLWQSNSVPNGAVINGPLTINPSKKRLYALTSNSGQASPLHNHTDTLLVLDMKNGALLLKQSLKESTDPNTDNANKNGAILFTLNINGTTRDVVAIPEAQGHYQVLDANNGTILWSTDITPGSTNRIVASSFNPYKSQIYVISNANNAQIHNGYYLTALDAKTGTILWNTKVHGNKPINAKLNTGGGIASSPDIIYTTSPNGKITMLEANTGKILWSFDTHASIISAPVMTNDALYVGATFTHNTGKLYKFTTQEHLQINNLQHNQQHSLINHISEQKETNGNSDSHGDSHSGEGSWSESGSGSWSYSHPSGGGGGGGGGGGGGGGGGGGGGGGGGGSSYGSSYGSGYGSGYGSGYGSGYGSGYGSGYGSGQGSGGGYSSGNGQNSGGVNYGSGSDSRYGANTTR

SEQ ID NO: 5606 - protein, 507 aa, Xylella fastidiosa Temecula1
MTIHNFDLLVVGGGINGTGIARDAAGRHLSVCLCEQHDLASHTSSASTKLIHGGLRYLEYYEFALVSKALAEREILLRQAPHIVRPLHFILPHQPHLRPTWIIRAGLLLYDHLGFSRRTLPRSRRLNLAQHPAGQPLKQELHTGFMYCDAQVQDARLVVLNAMDAAQRGARILTRTRCVRTRRDGAHWLTELEDAQGRQQQIRTRAIVNAAGPWAVTFLDHIAQQPHQHTLRLVKGSHIVVPRLFEHEHAYIFQQPDRRIVFAIPYEQHFTLIGTTDVDYVADPANPHIDAAETMYLCNAVNSYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTYAETLLGNATNLHTLGIHFGADLYQAEVDYLRTHEWACSAEDILWRRSKLGLHLDAHGTQRLEDYLRSCSRIPDHADTTTQ

SEQ ID NO: 5607 - protein, 120 aa, Methanocaldococcus jannaschii
GSHMAVYVKFKVPEEIQKELLDAVAKAQKIKKGANEVTKAVERGIAKLVIIAEDVKPEEVVAHLPYLCEEKGIPYAYVASKQDLGKAAGLEVAASSVAIINEGDAEELKVLIEKVNVLKQ

SEQ ID NO: 5608 - protein, 640 aa, Photobacterium sp. SKA34
MIIFSDIQLLRGGKVLLENATSTIHPGDKVGLVGKNGCGKSTLFALLKNELSLDAGNCQFPSNWEMAWVAQETPALERAAIEYVIDGDREYRELERQLLAAEQADNGTKVAELHGKMDTIGGYSIKARAAELLDGLGFSQHQMQWNLTQFSGGWRMRLNLAQALLCRSDLLLLDEPTNHLDLDAVMWLEKWLQSYRGTLVLISHDRDFLDPVVNRIIHLENQTMNSYTGNYSSFEVQRAEKLVLQQAMYQKQQKQMTHMQSYIERFRYKASKARQAQSRIKALERMEKVLPAQFDNPFSFEFREPSALPNPILMMDQVAAGYDDLLILEKIRLNLVPGSRIGLLGRNGAGKSTLIKMLSGDLPAKAGDMAYSQGVKIGYFAQHQLETLYLDDTPVQHIARIAPQATEQQLRDYLGSFGFIGDKALEKVGPFSGGEKARLVLALIVWQRPNLLLLDEPTNHLDLDMRQALTLALQSYEGAMVIVSHDRYLLRATTDDLYLVHDRQVVPFDGDLNDYHKWLTEQQRNERRDQQATKPETNKDNSAASRKEQKRLEAEFRKQTAPIRKEITKLEKQMDKLNTIITDAETALSDSSIYEAENKARMNEQLKLQGDAKSDLEDVEVAWMELQEQLEEMESQFSAE

SEQ ID NO: 5609 - protein, 601 aa, Photobacterium sp. SKA34
MTNDFLVLSVVFLAAAIIAVPLAQKLGLGSVLGYLIAGIAIGPWGLGLISDVDAILHFSEFGVVLLLFLIGLELNPKKLWQMRKPILGLGGGQVVITSGVIAVVVMSLNGFLPSLTWRDTAVIGMGLALSSTAIALRVIEEQQLSGSETGQSGFAVLLFQDIAVIPMLALLPALAGGKGGSWNDAFWMLGGIAVLLVGGHFLLRPLFRYVVMSGVRELFNVAALLLVLGIALIMQALGLSMALGAFLAGVLLAESEYRHELEIAIEPFKGLLLGLFFISVGMAVNIGLLWQYPLQILAAVLALVAVKGVVLYLLARIFGVREKSRSQMAAILSQGGEFAFVLFTAARAEGLLDAQLLAFLLVVVSISMMTTPLILTLQNRWFVRSFKASEQPEPESDIVDREPRVIITGFGRFGQVIGRLLFANKIKVTVLERDPSQIQFLRKFGYKVFYGDATQLDLLRAAGADNAEAIIICTDAPTEVMEVVAMCQQHFPHLKILARARSRVEAHQLLSQGVECFSRETFAGALDLGRQALISLGMHPYKAQRAEAHFRKIDTQALRDLLPQHSEEVNLASRQKEARKELEEIFDREMRGEEERHHGWD

SEQ ID NO: 5610 - protein, 487 aa, Acinetobacter sp. ADP1
MNARFQELLPELALYAGSKKLDVNQTFQDINPCDEILIAHIPKASVEDLNAIVAVAKQGLNSTAWHEVTPLQRENLIRCFADAIEKDSTRLAQLESIDAGKPISITQTVDIPAVVAWLKYYAGWASKIMGSAGELSNVAGSFHAYSRRQPVGVVAAITPWNFPSVLSMWKIAPALAAGCCIVLKPASDTPLTALRLAEIAREIGFPEGVFNVVTGNSDIGHALATHPDIAKVAFTGSTQTGRSILQASIADFKRVTLELGGKSPVILHKDADLDKAIPTIAMGCFFNTGQVCYAGTRLYVHHDIYDEVLARLAAFTKTLKIGSSDDPNTQLGPVVNARQQHSIQEFLNKAEQQGIESLDLSAMTLPEHGFYVRPAILKNVPAHAAIMKEEVFGPVLATAAYQSLDEAIQLSNDSIYGLAAHLWTQDLSIAHQVSAALDAGTVFVNCALLADPNFPFGGFKQSGIGRENGQEVLDAYLESKSVIMALS

SEQ ID NO: 5611 - protein, 602 aa, Physcomitrella patens subsp. patens
MCSIACCRSGTPKGDPEQDLVGEVFTIYSENERMSAEGLLKFLHTEQGDVDFTLDDAKQIMERIRKDWKKSFGLASINSDLSKEAFRKYLMNPDLNGVLHNVVHQDMTQPMSHYFIFTGHNSYLTGNQLSSDSSDTPIAAALRRGVRVVELDLWPDDKGGMKVTHGNTLTNPVSFQKCVTAIKNNAFFTSEYPVCVTIEDHLTSELQGHAAEILEQILGDALYYPPTTDALVEFPSPESLKRKIIISTKPPKEYLEACSTQKLAMENRNLVEELEKEDKLEQTTFAPLEENHILGENTPSLRKEVESNDGNDNPKHFKYARLITIRLAKHAKGTSMEHRLQVDESVKRISLSESKLEKVVEKWPEALVKFTQKNILRVYPAANRVNSSNFCPTLAWNYGAQMVAQNMQAKLFHGYGKELWQAFGKFKGNGGCGYVLKPQYLLENLPSGVPFNPTSPRNTTLILKIKVMTTLGWDKAFSKRHFDLFSPPDFFTRVIVVGVPADEAKWKTSVVDNSWAPHWNEDHEFALKCPELALLRIEVRDHDDDSKDEFEGQTCLPIHEVRDGYRCMQMYDKKGNVLKGVLMLFHFQKCKCTFQDTAPISS

SEQ ID NO: 5612 - protein, 287 aa, Synechococcus sp. RS9916
MASDDTLRVSVLSEALPYIQRFAGRRIVVKYGGAAMVHAELREAVFRDLALLTSVGVQPVVVHGGGPEINTWLKRLEIPAEFRDGLRVTDPDTMDVVEMVLVGRVNKQIVNGLNKLGARAVGLSGSDGLLVEARPWGNGSHGLVGDVARVNPDVLEPLLEKGYVPVISSVAATRDGTAHNINADTVAGELAAALEAEKLILLTDTPGILRDRDDPESLIPQLRLSEARQLIEDGVVAGGMTPKTECCIRALAQGVAAAHILDGRVPHALLLEVFTDAGIGTMVMGRG

SEQ ID NO: 5613 - protein, 361 aa, Oryza sativa
  misc_feature (31)..(31): Xaa can be any naturally occurring amino acid
  misc_feature (55)..(55): Xaa can be any naturally occurring amino acid
MASVDLTPRQARKAYGGDGGTYYEWSPADLXPMLELANIGGAKLSLNAGGLALPXSFSDSGKVAYVLQGKGTCGIVLPEASKEKVIAVKEGDSLALPFGVVTWWHNLPESPIELVILFLGDTSKAHKAGQFTNMQLTGATGIFTGFSTEFVGRAWDLAESDAVKLVSSQPASGIVKIKSGQKLPEPSAADREGMALNCLEAPLDVDIKNGGRVVVLNTANLPMVKEVGLGADLVRIDGHSMCSPGFSCDSAYQVTYFIRGSGRVQVVGADGKRVLDTHVEGGNLFIVPRFCVVSKIADASGLQWFSIITTPNPIFSHLAGKTSVWKAISPEVLEASFNATPEMEKLFRSKRIDSEIFFAPN

SEQ ID NO: 5614 - protein, 212 aa, Physcomitrella patens subsp. patens
MSPLPQRGAQRRGMFIQVESTPNPQSLMFYPGKPVMEVGSSDFPNSRAAMASPLAKSIFIVDGVVRVFFGADFVTVTKSEDVSWDILKPEIFAAIMDFYATKQPLFYDTQSQASDTAIHEDDDETVAMIKELLETRIRPAVQDDGGDIEYRGFDPESGIVSLKMQGACSGCPSSAVTLKSGIENMLMHYVSEVKGVQEVHDEDSDEETNAAG

SEQ ID NO: 5615 - protein, 444 aa, Escherichia coli O157:H7 EDL933
  misc_feature (231)..(231): Xaa can be any naturally occurring amino acid
MSSAKKIGLFACTGVVAGNMMGSGIALLPANLASIGGIAIWGWIISIIGAMSLAYVYARLATKNPQQGGPIAYAGEISPAFGFQTGVLYYHANWIGNLAIGITAVSYLSTFFPVLNDPVPAGIACIAIVWVFTFVNMLGGTWVSRLTTIGLVLVLIPVVMTAIVGWHWFDAATYAANWNTADTTDGHAIIKSILLCLWAFVGVESAAVSTGMVKNPKRTVPLATMLGTGLXGIVYIAATQVLSGMYPSSVMAASGAPFAISASTILGNWAAPLVSAFTAFACLTSLGSWMMLVGQAGVRAANDGNFPKVYGEVDSNGIPKKGLLLAAVKMTALMILITLMNSAGGKASDLFGELTGIAVLLTMLPYFYSCVDLIRFEGVNIRNFVSLICSVLGCVFCFIALMGASSFELAGTFIVSLIILMFYARKMHERQSHSMDNHTASNAH

SEQ ID NO: 5616 - protein, 400 aa, Mycobacterium sp. MCS
MSGNVGTLPQQSLPPLVEPVGELTREEVARYSRHLIIPDLGLDGQKRLKNAKVLVIGAGGLGSPTLLYLAAAGVGTIGIVEFDVVDESNLQRQVIHGQSDIGRPKAQSARDSILEINPLVNVRLHEERLEPENAVGLFEQYDLILDGTDNFATRYLVNDAAVLAHKPYVWGSIYRFEGQVSVFWEDAPNGLGLNYRDLYPEPPPPGMVPSCAEGGVLGILCASIASVMGTEAIKLITGIGEPLLGRLMVYDALDMTYRTIKIRKDPATPKITELIDYEAFCGVVSDAAAAAAADSTVTPRELRELIDAGKPVALIDVREQVEWDINRIEGAELIPKSAIEAGDGLAKLPHDRIPVLYCKTGVRSAEALAAVKKAGFSDALHLQGGIVAWAKQLEPDMVMY

SEQ ID NO: 5617 - protein, 141 aa, Synechococcus sp. RS9916
MFSALQRLSRQLMSLTLAACLGLCLMLTACSGAGASTLTGDYVEDTVAVVHTLQSTIAMGQDDEGRAEAETAATDLINDYMSRYRPRPQVNGLSSFTTMQTALNSLAGHYKTYANRPLPDTLRARVDKELGKAEKAAVRGS

SEQ ID NO: 5618 - protein, 487 aa, Glycine max
MVEKDGVGSKYLQQTLNVSIDMHQHGISKCFDDDGRPKRTGTVWTSSAHIITAVIGSGVLSLAWAIAQLGWIAGPIVMVIFSAITYYTSTLLADCYRTGDPVTGKRNYTYMDAIQSNFGGNGFKVKLCGLVQYVNLFGVAIGYTIAASTSMMAIERSNCFHKSGGKDPCHINSNMYMISFGIVEILFSQIPGFDQLWWLSIVAAVMSFTYSTIGLGLGIGKVIENGGVGGSLTGITIGTVTQTDKVWRTMQALGDIAFAYSYSLILIEIQDTVKSPPSESKTMKKASFISVAVTSIFYMLCGCFGYAAFGDASPGNLLTGFGFYNPYWLLDIANAAIVIHLVGSYQVYCQPLFAFVEKHAAQMFPDSDFLNKEIEIPIPGFHPYRLNLFRLVWRTIYVMLSTVISMLLPFFNDIGGLLGAFGFWPLTVYFPVEMYIIQKRIPKWSTKWICLQILSMTCLLMTIGAAAGSIAGIAIDLRTYKPFKTNY

SEQ ID NO: 5619 - protein, 309 aa, Brassica napus
MEITLNSGYKMPIVGLGVWRMEKEGIRDLVINSIKIGYRHLDCAADYKNEAEVGEALSEAFKEGLVKREDLFVTTKLWNSDHGHVIEACKDSLKKLQLDYLDLYLVHFPVATKHTGVGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPALKEVAEKYKKTVAQVVLRWGIQRNTVVIPKTSKPERLEENFKVFDFELAKEDMEVIKSMDRKYRTNQPAKFWGIDLYA

SEQ ID NO: 5620 - protein, 208 aa, Saccharomyces cerevisiae YJM789
MFTPIDQAIEHFKQNKFVIVMDDAGRENEGDLICAAENVSTEQMAFLVRHSSGYVCAPMTNAIADKLDLPLLRTGMKFESNDDDRHGTAYTITVDVAQGTTTGISAHDRSMTCRALADSSSTPKSFLKPGHICPLRAADGGVLQRRGHTEAGIDLCKLSGLSPVAVIGELVNDDEQGTMMRLNDCQAFGKKHGIPLISIEELAQYLKK

SEQ ID NO: 5621 - protein, 371 aa, Acinetobacter sp. ADP1
MKITAAVARQAHQDFSIEQVELDEPKDHEVLVRIEGVGLCHTDLVARDRLIPIPLPAVLGHEGAGVVEKIGKAVTKVAVGDHVLMSFNSCGECPRCKEHLPPYCTQFPQLNYVGARPDGSSTLKQNDQAVSGYFFGQSSFASHALANERNIVKVAQDLPIEILGPLGCGLQTGAGGVMRSLACPQGSTIAIFGGGPVGLAAVMGAVIQQCATIILVEPMASRRELALELGAHHVIDPAQGNITEHIRNILPQGVDFAFESSGRGEVVEAALASLGSHGLLGLVGVPPSVETTLNVNLVSLITFGHRIHGIIEGDSDLDTFLPELIQHYQAGKFPFDKLIKKYALSEINQAIQDQAQGRCIKAVLIPEHAHH

SEQ ID NO: 5622 - protein, 650 aa, Acinetobacter sp. ADP1
MTTQLTTNNITGSPNSEVAGISPPANFPDEATLSRLASEFFAALPSSGGHASGLNLDLPNVGTPPHAPQPVEPVAALSGRAPNIAYQKSLNPEYPEHIPNYPDYPERRAIASSPVIGGANLPRPPIEPHFPQAIHQQPNVPLVSPNVPLNREQSPFYFLDDLASPTKSSSDFDVTNHSTPQSSQLPQGEKLNALLREDRPNITTAHQPHTTSSGFYFLDIPKVEQSYQNYVPSQSTFVTNSAQPLDIHAIRRDFPILQERINGRPLVWFDNAATTQKPQSVIDRIAYFYQHENSNIHRAAHELAARATDAYEHARNVVARFIGAKSSKEIIFVRGTTEGINLIAKTWGEQNIGEGDEIIVSHLEHHANIVPWYQLSKKTGAKLRVIPVDDTGQILLEELPKLINERTKLVSITQVSNALGTVTPVAEVIKIAHSKGVRVLVDGAQSVSHMPTDVQAIDADFFVFSGHKVFGPTGIGAIYAKPEILETMPVWEGGGNMIQDVTFEQVIYQPAPNKFEAGTGNIADAVGLGAALEYVERIGIHNIARYEHDLLEYGQHALSSVTGLRPIGTAKNKASVMSFILDGYSTEQVGKALNQHGIAVRSGHHCAQPILRRFGVEQTVRPSLAFYNTHEEIDLMISVLNQLARNKRSI

SEQ ID NO: 5623 - protein, 450 aa, Vibrio sp. Ex25
MSHIHDTIVALQHSSPAQKEFYQAVEEVLTSLAPVIESNNKYKEQAIIQRIVEPERQIMFRVPWVDDAGNVQVNKGYRVEFNSALGPYKGGLRFHHSVNASIIKFLGFEQIFKNALTGLPIGGGKGGSNFDPKGKSDGEIMRFCQSFMNELYRHIGPVTDVPAGDIGVGAREIGYMFGQYKRLTGRYEGVLTGKSLLWGGSLVRKEATGYGTVYFAECMLNDRNDSLKGKTCLVSGAGNVAIYAIEKLYHMGATPVTCSDSRGTIYHEHGIDLQLLKQLKEVKRASLEEYLDTYPEAEYTPLGDYPNEGHAVWRYQADAAFPCATQNELTSNDALALIDNGCVLISEGANMPTTRDAANIIVDSEMAYGPAKAANAGGVATSQLEMAQNASMQNWTFEQVDSQLQTIMKNIFVNANETSREFGQPGNLVLGANIAGFRRVADAMIEQGIV

SEQ ID NO: 5624 - protein, 308 aa, Acinetobacter sp. ADP1
MAKWDISPVVQGLQQARHEWRERQNRIKEIGGRELPSKEVLKSILDDLCGILFPMRLGPADLRQETEDYYISYTLDRVLNALYGQVKLALDYELKSKSRQNYEQDSAAISQQAEIVVQNFAKTLPHIRRLLDADVCAAYEGDPAAHSVDEVLLCYPGILAIIHHRLAHQLYPHVPLLSRIISELAHSATGIDIHPGASIGSGFFIDHGTGIVIGETCIIGEKVRIYQAVTLGAKRFETDADGSLKKDYQRHPIVEDQVIIYAGATILGRITIGKGSVIGGNVWLTHSVPAGSQILQSPSESHHQKKTA

SEQ ID NO: 5625 - protein, 202 aa, Anabaena variabilis ATCC 29413
MIFWFCNQPPRVELFQCSWVPYSYSIVSTNSYWPSPDFSQAAFIAANAVVMGSVKIAAGASIWYGAVVRADVESIDIGECTNIQDGAILHGDPGLPTVLEDHVTVGHRAVIHSAHIERGSLIGIGAVILDGVRVGAGSIIGAGSIVTKNIPPLSLVVGVPGKVLRPITPEEAADLIQHAERYKKLALVHAGKGSDIGFYPQE

SEQ ID NO: 5626 - protein, 498 aa, Mesorhizobium loti MAFF303099
MTLSFDPRAKATTLYHGEFRPMFIGGKWVAAQSGQEMQALNPATGEVLTTVPRGGAADVDAAVAAARAAFEGPWSKFSPYERQCVLLRIADLFETHWEELSVSDTLDMGLPITRTLANRRRVIGMLRFYGGMATALHGEAIDNSIPGEIVSFTRREPVGVVGAIIPWNAPTAASIWKIAPALATGCTIVLKPSEEASLTPLLIARLMQEAGVPDGVVNIVTGTGAEAGARLAEHPDVNKIVFTGSTLTGQAIARAGVTNLKRVSLELGGKSPIIVCRDADIDKAVPVAAMAVFVHSGQICIAGSRLFVAREIHDEFVRRVAEFAGRLRIGHGIEAETEIGPLINARQAGKVEGYIKAGSDEGAKLVAGGSRLTGALYDGGNFIAPTVFGSVSDKMTIAREEIFGPVISAMPFDTLDEVVARANATPYGLAAGIFTTHLGTAHKLARRIRAGSVWVNMYHAIDPAVPFGGMKMSGYGREGGIEHLHEYLETKSVWIQTD

SEQ ID NO: 5627 - protein, 340 aa, Photorhabdus luminescens subsp. laumondii TTO1
MPILITGGAGYIGSHTVLTLLERGADVVVIDNLCNSSPESLRRVEKLTGKSVKFYQGDILNLDLLHKIFQENKIETVIHFAGLKAVGESTRKPLEYYQNNVTGTLVLLQAMRANSVHQLIFSSSATVYGDPEFVPLTENAKVGGTTNPYGTSKLMVEQILKDFAAAEPSFKITSLRYFNPVGAHSSGMIGEDPNGIPNNLLPYITQVAIGRLECLSVYGNDYPTKDGTGIRDYIHVMDLAEGHIAAIDYLDKQQSYEVFNLGTGAGYSVLELLHAFEKASGKDIPYKITDRRPGDIAECWSDPSRARNILGWQATRNIDDMMRDSWNWQKNNPHGFRSGK

SEQ ID NO: 5628 - protein, 484 aa, Shewanella sp. MR-7
MKFKQDFFTQLPEFYAQVYPQGISNPHWLAWSEDVAKLIDLQQPTDALLQGLSGNAAVEGASYYAQVYSGHQFGGYTPRLGDGRSIILGEALGPQGAWDVALKGGGPTPYSRHGDGRAVMRSAVREFLVSEALHHLGVPTTRALAVIGSDMPVWRESQETAAITVRLARSHIRFGHFEFFCHSERGQADKLTQLLNFTLKQHYPHLSCDLAGYKAWFLQVVQDTAKLIAHWQAIGFAHGVMNTDNMSILGDSFDFGPFAFLDTFQEDFICNHSDPEGRYAFGQQPGIGLWNLQRLAQALTPVIPSDDLIAALNQYQHALVQHYLMLMRAKLGLAERADSTAEQDQQDLELIGRFTVLMEKNQLDYSNTWRRFGQLDPSSAHSSLRDDFIDLNEFDAWYQAYQTRLGKVTDIEAWQQARNSVNPKYILRNYLAQEAIIAVEEGNLAPLERLHQVLRQPFAEQVEHEDLAKRPPDWGQGLIMSCSS

SEQ ID NO: 5629 - protein, 153 aa, Physcomitrella patens subsp. patens
MDSTLCIIKPDAMRLGYKQNICHMIHMFGFNVIAEATFKLTRVRAEQFYRAHSQMPYFETLIRFMISRSIHCMVLVKDNCCRAFRALLGPKDSNRARREAPQTIRALYGTDGRMNAVHGSDTVKEAEWEIKFFFPTGTFGPYNLLLVRSFRDS

SEQ ID NO: 5630 - protein, 273 aa, Photorhabdus luminescens subsp. laumondii TTO1
MSLEELDEVWKNIKTEARALAECEPMLASFFHATLLKHENLGSALSYMLANKLATPIMPAIAVREIVEEAYGSDQKMIVSAARDIIAVRLRDPAVDKYSTPLLYLKGFHALQAYRIAHWIWGEDRKALAIYLQNQISMSFGVDIHPAAKIGCGIMLDHATGIVIGETAVVENDVSILQSVTLGGTGKTGGDRHPKVREGVMIGAGSKILGNIEIGRGAKIGAGSVVLRSVPPHTTAAGVPARIVGKPESEKPSLDMNQHFNGINHGFEYGDGI

SEQ ID NO: 5631 - protein, 340 aa, Photorhabdus luminescens subsp. laumondii TTO1
MNSTVSMTVIGAGSYGTSLAITLARNGHNVVLWGHNPEHVGALQRVRCNQKFLPDVSFPDSLLLETDLIKALTASRDILVVVPSHVFGEVLKQIKPHLRPDSRIVWATKGLEADTGRLLQDVAREILGNEIPLAVLSGPTFAKELAAGLPTAIAISATESAFGDGLQQLFHCGKSFRVYKNPDFIGVQLGGAVKNVIAIGAGISDGMGFGANARTALITRGLAEMSRLGAALGADPSTFMGMAGLGDLVLTCTDNQSRNRRFGMMLGQGISVEEAQYQIGQVVEGYRNTKEVRALANRANVEMPIAEQIYQILYCNKNVIEAAQALLGRARKDESDNVRS

SEQ ID NO: 5632 - protein, 292 aa, Cucumis sativus
MEGKEEDVRLGANKFNERQPIGTAAQSQDDAKDYKEPPPAPLFEPEELTSWSFYRAGIAEFFATFLFLYITVLTVMGVTRSKEADGNTCNTVGIQGIAWAFGGMIFALVYCTAGISGGHINPAVTFGLFLARKLSLTRAIFYIVMQCLGAICGAGVVKGFQPKPYERLGGGANVVSDGYTKGDGLGAEIVGTFILVYTVFSATDAKRSARDSHVPILAPLPIGFAVFLVHLATIPITGTGINPARSLGAAIIFNKDKAWDDHWIFWVGPFIGAALAALYHQVVIRAIPFKSK

SEQ ID NO: 5633 - protein, 452 aa, Brucella suis 1330
MNPADEKPYAVISAGSAADIDLAVAAARRAFPAWSETPAEERIAYIRRIAEIYESRLDEMAKTISMEMGAPIKLARESQAAAGLSHTKAFIAACENFEVEEVLSPKYPNQTAVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTSQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 5634 - protein, 135 aa, Brassica napus
FGKEIWDTGAGLVAAALIAICPGYISRSVAGSYDNEAVAIFALLLTFYLFVKAVKTGSLSWALGSAFGYFYMVSAWGGYVFIINLVPLYVLVLLITGRYSMRLYVAYNCMYILGMLLAMQIPFVGFQHVQSGQHM

SEQ ID NO: 5635 - protein, 303 aa, Thermotoga maritima
MGSDKIHHHHHHMMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 5636 - protein, 138 aa, Arabidopsis thaliana
  misc_feature (2)..(2): Xaa can be any naturally occurring amino acid
  misc_feature (11)..(11): Xaa can be any naturally occurring amino acid
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (52)..(53): Xaa can be any naturally occurring amino acid
  misc_feature (57)..(59): Xaa can be any naturally occurring amino acid
  misc_feature (64)..(64): Xaa can be any naturally occurring amino acid
  misc_feature (68)..(69): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (100)..(100): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(111): Xaa can be any naturally occurring amino acid
  misc_feature (117)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (128)..(129): Xaa can be any naturally occurring amino acid
  misc_feature (131)..(131): Xaa can be any naturally occurring amino acid
  misc_feature (133)..(136): Xaa can be any naturally occurring amino acid
MXSSMLSSAAXGTSPAXATMVAPFTXLKSSAXFPXTRKNNKDITSIASNGGXXNCMXXXPPIGXKKFXXLSYLPDLRDXKLGKEXDYXLRXKGIPXGEFXLKNGXFVYXEXGKTPGXXXGXXWXXGKXXLXGXXXXLK

SEQ ID NO: 5637 - protein, 386 aa, Chlamydia muridarum Nigg
MHLHEYQAKDLLTSYQLPIPPYHVATSLSEAEVAIQAEQWRSGVVKAQVHAGGRGKNGGVIVARSPEDLLAATDRLLHMQFSSNQTAGLSLPVNKVLISPLVEIALEYYIAIVIDRKHRCPVIMLSKSGGIDIEEIAEKQPDLLLKIALPSSGKIYAYQLRHIAKFMEWDKLVADRGNHIIRKLLQCFYDNDASLLEINPLVLTKDGDLIILDAKITIDDNALYRHPQLADWYDPSQENIRDVLAKQLGLSYIALDGTIGCLVNGAGLAMSTLDILKLYGGSAANFLDVGGSASEKQIQEAISLVLSDKNVRVLFIHIFGGIMDCAVVASGLVSAMQGQQGSIPTVIRLEGTNVDKGKEIILRSGIPCEFVASMSEGAELAVKLSR

SEQ ID NO: 5638 - protein, 288 aa, Arabidopsis thaliana
MKTSLLCIAEDNSGLVVWNPYLCQTKWIRLRNTFHRYDVFALGHDNNRNHKILRFLYDAKKYRTGRGRDNDVYDFSSDSWRRVFDVNPHRGELFYYSGVSLKGNSYFFGQEVTIEEEEEEVISQPRDYLLCFDFTTERFGPRLSLPFNPPSPNFDYLTLSWARDEKLAVLYNHYNTREIIEIWISTKIEPNTVSWSTFLTVDTSLINGLPDRFSTFYGPRSFFIDEEKKVAVFFDNKGTETGCYQVAYIIGDNGYFKSVKIGVISNSQWQQGILVCSSYVPSLVQLQD

SEQ ID NO: 5639 - protein, 628 aa, Yarrowia lipolytica CLIB122
MEYAETAWSAVEEAWLDLDQYINLRDLQSLSSGSLQWENILLVSTTISVTVTLILATQRWFFGYKNAAEKPAVIHVRTPDQALPHWKGIRMDPPTLRSQEEPDMIQCYCPATGQFLGATPASTLLDIDAAIECAAAAQCQWNPSFSARNKVLKTIRKFLLENQEVVARVACRDTGKTMIDASMGEIMVTLEKINWLIKNGERALQPSSRPGSSNPLMFYKAAKVVYEPLGVVAALVSWNYPLHNLMGPILASLYAGNAVIIKCSESVVWSSQYFVQIAREALQACGHSPDLVQLVCCWPETANHLTSHPQISHVTFIGSKPVAHKVAAAAAESLVPLVVELGGKDPCVVFDDDGLDLKTIAHTILRGTFQAAGQNCIGFERVIAQPSAYKTLLDIFRETIPKLRVGAGIDQQDDVDVGACISNMHFDRLEELIADAVAQGAELVAGGHRYPHPKYPQGHYFQPTLLVGVTADMEIAQTEVFGPVLTMMQAETVDQAIDLANSTIYGLGAAVFGANTVTLRKAINDIKSGNIAVNDLAAFYVCQLPFGGCKGSGYGKFGGEEGLQGLCLAKSVAFDSVPFCKTTLPRPLQYPIPSAVKGWEFVKNVNIAGYGVGLWKRFKSLVSLGKSA

SEQ ID NO: 5640 - protein, 474 aa, Neorickettsia sennetsu str. Miyayama
MPVSIGKIVRVVGPTVDVKFEDGTLPKIENALTCDNNGKILYLEVAQQLGDGIVRAVAMDSTDGLTRDKVVKDTGKPICVPVGRQTLGRIFNVVGEIIDGGGPVPEPNKVSSIYAEPPRFDMQSTSSEILETGIKVIDLLAPYSKGGKVGLFGGAGVGKTVLIMELINNIAKAYGGFSVFAGVGERTREGNDLYSEMVESGVIDKEHPEKSKVVLVYGQMNEPPGARAKVAMSALTMAEYFRDKEGQDVLFFVDNIFRFTQAGAELSTLLGRIPSAVGYQPTLATDMGRLQERITSTKNGSITSVQAIYVPADDITDPAPATSFAHLDSTTVLSRQVAEAGIYPAVDALASSAQILSPEVLGQEHYEVAQKVKGILQSYKSLQDIIAILGMEELSEEDKLTVYRARKIEKFLSQPFHVAEVFTGQPGKFVSLKDTIAGFKELVEGKCDDMPEAAFYMVGNMNEAREKAISLREK

SEQ ID NO: 5641 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 5642 - protein, 341 aa, Mycobacterium sp. S65
MDAIVLKGTNDVGLTSVPDPAPQPGEVIIEVAATGLCGTDLHEYVAGPTFSQPPVVLGHEVSGRIVEVGAGIDRCRIGEGAAVIPMDFCGSCHYCHRSLYHLCQRPGWIGLTRNGGLASHVAVPSRLAVRVPDAVDLQEAALTEPTAVAFHAVRRAELLLGETVLVLGAGALGLTVIQCARAAGAARIYVTEPSRVRGNLARDLGATLVLDPHEPGTTARILEETRGVGVDVVFHVAGSVEAFTQGLDCLRKQGRFMEMSSWAGPASLDVNRHLLKETQLRMVFGYDMFDDFPAVLALMADGKIALTPQITTRIPLDSAVEEGLNGLLEAREGLIKVLVRP

SEQ ID NO: 5643 - protein, 273 aa, Oryza sativa Japonica Group
MAPRCSNAVFAAINVVTLLLGAAVLAAGIYYGAPHRGGGGVTECERFLRAPALALGGAIVAVSLAGLAGACCRATPLLWAYLLLTGLLILAAACFGVFALVVTNAGAGRAVSGRGFREYHLGDYSTWLRRSVEDGGHWARIRSCLVDTGVCRSLKSNQTLDEFVNSNLSPLQSGCCKPPTACNFTYQNETYWIKPPTPSNYSDPDCNSWSNDQSELCYGCQSCKAGVLGNLRSSWKKIAFVNAAFVALLLVVYSLGCCALRNNRRHKYSLVGK

SEQ ID NO: 5644 - protein, 129 aa, Physcomitrella patens subsp. patens
MQAARSSTLRALHSAVLQHLRVQPAQIGSTWGLFRAISAEAHAQGTCLSRSQVADRVLSVLKSSAKVDPLTVSETASFQNDLQLDTLDQVEIMMAIEDEFALEIPDADADNMKSTKDVIEYVVSHPRAK

SEQ ID NO: 5645 - protein, 284 aa, Cucurbita ficifolia
MAKDSEAGGFAAKDYHDPPPAPLIDVEEFTQWSFYRAIIAEFITTLLFLYVTVLTVIGYSSQSDVDNGGHICGGVGILGIAWAFGGMIFVLVYCTAGISGGHINPAVTFGLFLARKVSLVRAVLYMVAQCVGAICGCALVKSFQKGLYHRYGGGANSLAEGCSTGTGLAAEIIGTFVLVYTVFSATDPKRSARDSHIPVLAPLPIGFAVFMVHLATIPITGAGINPARSFGAAVVFNHSKPWNDHWIFWVGPFIGALIAAFYHQFILRAGAVKALGSFRSTHSV

SEQ ID NO: 5646 - protein, 341 aa, Photorhabdus luminescens subsp. laumondii TTO1
MKALSKLKAEEGIWMIDVPEPELGHNDVMIKIRKTAICGTDVHIYNWDDWSQKTIPVPMVVGHEYVGEVVAIGQEVKGFKIGDRVSGEGHITCGYCRNCRGGRTHLCRNTIGVGVNRAGCFAQYLVIPAFNAFKIPDNISDELAAIFDPFGNAVHTALSFDLVGEDVLVSGAGPIGIMAAAVCKHVGARHVVITDVNEYRLELARKMGVTRAVNVSQENLTDVMAELGMTEGFDVGLEMSGAPAAFRTLLNTMNHGGRVALLGIPPSDMAIDWNQVIFKGLFIKGIYGREMFETWYKMATLIQSGLDLTPIITHRFSIDDFQKGFDIMRSGQSGKVILNWD

SEQ ID NO: 5647 - protein, 799 aa, Arabidopsis thaliana
MTTAMMIFAVLVTVVEVEAQTECVSKIVPCFRFLNTTTKPSTDCCNSIKEAMEKDFSCLCTIYNTPGLLAQFNITTDQALGLNLRCGVNTDLSACSGSGAPPPPPDLFPPPSAQMLPPPPASSPAPPSPPSSSRPRPLPRPSMSRSFTIENKCQYTIWPATYGYRRSLETTGFVLEKGETRTIKAPSSWIGRFWGRTLCSTNSTGGFSCATGDCTSGKIKCLGIPIDPTTVVEFNLASYGVDYYVVNVFNGYNLPLLVTPENKNCRSIECVIDMNETCPSELMVNSSGLGSHHPIACMTTCQRYQLPELCCIGLSSGVVVPPGICKRTIYSRTFNNVCPSAYSYAYDVDNSSFTCPNFSNFVITFCPSSSTVPEAGNINSSTVPEAGNIKTGTEAKGNIPLRLKLILGVSSVLATMIIIVIVGKVRANNMRKSDLNEKNMEAVVMLKRFSYVQVKKMTKSFENVLGKGGFGTVYKGKLPDGSRDVAVKILKESNEDGEDFINEIASMSRTSHANIVSLLGFCYEGRKKAIIYELMPNGSLDKFISKNMSAKMEWKTLYNIAVGVSHGLEYLHSHCVSRIVHFDIKPQNILIDGDLCPKISDFGLAKLCKNNESIISMLHARGTIGYIAPEVFSQNFGGVSHKSDVYSYGMVVLEMIGARNIGRAQNAGSSNTSMYFPDWIYKDLEKGEIMSFLADQITEEEDEKIVKKMVLVGLWCIQTNPYDRPPMSKVVEMLEGSLEALQIPPKPLLCLPAITAPITVDEDIQETSSFLKPSQDTSYYSEQIVQDIVEENQDSSRSS

SEQ ID NO: 5648 - protein, 190 aa, Triticum aestivum
  misc_feature (103)..(103): Xaa can be any naturally occurring amino acid
  misc_feature (124)..(124): Xaa can be any naturally occurring amino acid
  misc_feature (143)..(143): Xaa can be any naturally occurring amino acid
  misc_feature (172)..(172): Xaa can be any naturally occurring amino acid
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYGPFVRPXIVTQPVVNIWYLPKKGVQIKXDDVISAAPEYIEPNGSKAXFELSFNKFRTTKREALQFLEEVEVERRAXAERELEARDVNPFFHPNY

SEQ ID NO: 5649 - protein, 123 aa, Neisseria meningitidis MC58
MAITKEDILEAVGSLTVMELNDLVKAFEEKFGVSAAAVAVAGPAGAGAADAEEKTEFDVVLASAGDQKVGVIKVVRAITGLGLKEAKDIVDGAPKTIKEGVSKAEAEDIQKQLEEAGAKVEIK

SEQ ID NO: 5650 - protein, 423 aa, Wolbachia endosymbiont strain TRS of Brugia malayi
MPIEILMPALSPTMSKTGGKIVKWCKKEQDRVEVGDVIAEIETDKAIMEFESVDRGVLAKILVSEGTSGVPVNQLIALMLEEGEDKSAIDNYVSVPAVNIEVKEKVVTTSSVSSNPSMSSQCLTQESKKEEGTKTTESRIKVSPLAKKIAQNEGINVRRLKGTGPYGRIIKADVLGFLDSGVQIKNRERSDEDTILEVSNMRQVIAQRLIEAKQNIPHFYLTVECQVDKLISLKNEINSADKNNKVTINDLIIKAVAFSMKKFPDINSSWIDNKILRYANIDISIAVALEDGLITPIVKNADEKGILSISKEVKDLVIRARSGKLGPEEFQGGGFTISNLGMFSIKTFSAIINPPQSCIMAIGTSKKQPIVIDEKIEIVEIITVTLSVDHRAVDGVLGAKFLNAFKHYIENPLAMLIEARVNI

SEQ ID NO: 5651 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 5652 - protein, 305 aa, Vibrio sp. Ex25
MNKLVVLGSVNADHVLQVPSFPRPGETLHGRNYQVIPGGKGANQAVAAARLKADIGFIACVGDDSFGINIRENFNMDGIDITGVKMQPNCPTGIAMIQVSDSGENSICISAEANAKLTAEAIEPDLDRIRQADYLLMQLETPMCGIEKAARVAKDAKTNVILNPAPARELSDELLACIDVITPNETEAEVLTGVTVTDNDSAQEAANVLHSKGIEIVMITLGAKGVWLSQNGRGELIPGFRVDATDTTAAGDTFNGAFVTGLLEDLPLESAIKFAHAAAAISVTRFGAQTSIPTREEVDAFLAAQ

SEQ ID NO: 5653 - protein, 175 aa, Glycine max
DPPPKDNAPYFLVAAKLDVEIPKGGRGVVLNPANLPLVRRVGLGADLVRIDAHSMCSPGFSCDSAYQVTYIVRGSGSVQVVGPDGKRVLETHIEGGSLFIVPRFHVVSKIADASGMEWFSIITTPNPIFSHLAGKTSVWKAISPEVLEASFNTTPEMEKLFRSKRLDSEIFFAPN

SEQ ID NO: 5654 - protein, 1142 aa, Saccharomyces cerevisiae YJM789
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQIKKRQSISSVSVSPSKKVSTTPQRRRNRESLISVTSSRKKPISFNKFTASSASSSNLTTPGSSKRLSKNFSSKKKLSTVVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEENLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTTTTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVEDMEPPLNKSVQKIREKNAGSQAKDHSKDHLKEHKQDKNTAIGNGSFFRKFSKSSDKTMELYAKISAKQMFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 5655 - protein, 663 aa, Saccharomyces cerevisiae YJM789
MTLGNRRHGRNNEGSSNMNMNGNDVDDVSHYEMKEIQPKEKEIGSIEPENEVEYFEKTVEKTIENMEYEGEHHASYLRRFIDSFKRAEGSHANSPDSSNSNGTTPISTKDSSSQLDNELNRKSSYITVDGIKQSPQEQEQKQGDLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIIGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAVAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPILIALYIFYKVWKKDWSLFIPADKVDLVSHRNIFDEELLKQEDEEYKERLRNGPYWKRVLDFWC

SEQ ID NO: 5656 - protein, 678 aa, Chlamydomonas reinhardtii
MAGKKLKKGKSGNAAQYITRTQAVRKLQLRLSEFRRLCILKGVHPREPKKKPKGANKTYYHLKDINWLAHEPLLNTFRSIKAHDKKVRKARAKQNKELAKRLAALTPTYRLDHLVKERYPSFVDALRDLDDSLTMVHLFATLPAESKYDIPQRTVQLCRRLALEWQAYVVRSGALRRVFVSVKGYYFQAEILGQSVTWLVPHALSQVLPPDVDYKVMLTFLEFYNTLLQFVNFKLYHNLGAALPSLRVYPLFSQLRYPPVLDPRLEEAAAELAAIMKDIAGMEEEEPEEVDSEAGDEDDDDLPVLDSGTRRRRAAAAGPAPRRWRCWVRTTRTRMTTCRWVSDRAGGACGPGVDPSDEAAVCGSLFRGRVFFLGREVPREPLMLVIRAFGGVAAWDGDGSPHAETDEAVTHQIVDRPKQGHKFLSREYVQPQWVFDSANFRVLMPTDLYAPGTVPPPHLSPFVGEADEDGYTPDFAKTVRRLQDAANAARLRAAGLALKGADGSEFVGEGADGAAAADGEGAAGEDLAAAERQYASELAKEDEEAAMADIMMTRKARKMYNNMKQKEAAKQERVQQLESKKAKLAATGAAGPMGQVKPAAAGKAAAAKAAAPAKVAASGGKGAAAKGKEAPAPAKGKGTPAAKGKEAPAPAKGKGAAAAKEAPAKGGKDAAPAKRQRR

SEQ ID NO: 5657 - protein, 92 aa, Brassica napus
SQETRASSRFDDSKRFTPDSSSNSGVDQAIGCYDTPVQELIVIDDLLSAMVGIEGRYISIKRFHGKEESIAFQVDPSMDLALQASSTQHNKL

SEQ ID NO: 5658 - protein, 502 aa, Acinetobacter sp. ADP1
MSNMHLKTAKLFIDGKFIDSKTTEWQDILNPATQEVLGRVPMATLEEVDVAIAAAKQAFKTWHLTPIQARMRIMLKLQDLIRTNMKEIAGVLTAEQGKTLADAEGDIQRGLEVVEHACSVGTLQMGEYIEGVARGVDTYTLQQPLGVCAGITPFNFPAMIPLWMFPMAIVCGNTFVLKPSEQDPLSTMMLVELAAEAGVPAGVLNVVHGGKEVVDRLCTHQDIKAISFVGSTAVGTHVYNLAGQHGKRVQSMMGAKNHVVVMPDAHQEQTLNALVGAAFGAAGQRCMALSVAVMVGETKNWVNQLVEKAKTLKVNAGHEPQTDIGPVISPRAKARVIDLINSGVQEGAELLLDGRDVKVNGYENGNFVGATIFNQVSTSMRIYKEEIFGPVLAIIHVDTLEDAIALINANPFGNGVGLFTQSGAVARTFQNAIDIGQVGINIPIPVPVPFFSFTGSRGSKLGDLGPYGKQAVQFYTQTKTITSRWFEDTQEKGEVNTTISLR

SEQ ID NO: 5659 - protein, 412 aa, Ralstonia metallidurans CH34
MSDHIVLTSHTRRDKPAEPIHWGAPTAAERGPVIASLTDPAQRNVIGTHAGAYAIYRALAVAAGSLQRAHRPDLTDTSPAEAIGPHPQWGDPDRIVSLDPWGHLVSTVFADRIAAGVDIRPTIAITRAHINMPELMAAISAGRLKPDGDILEANGDVRVTKAAVDPVWYLPGIARRFNIKESVLRRSLFEQTGGMFPELVTRPDLKVFLPPIGGMTLYFFGDVTKLGQPDTRVACRVHDECNGSDVFGSDICTCRPYLAHGIEVCIEMAQQGGVGLVVYNRKEGRALGEVTKFLVYNARKRQVGGDRAETYFERTECVAGVQDMRFQELMPDVFHWLGIRRIDRWASMSNMKHGALTAQGIEVVEQVAIPESLIPADARVEIDAKVAAGYFSRYTPPDAKELAQAKGRGLKE

SEQ ID NO: 5660 - protein, 629 aa, Physcomitrella patens subsp. patens
MSQSVQGSQLRKIVARAVQQWIWSPSVDVGRRSLHKNVKRPVIVNKRSTDILHDPWFNKGTAYPLAERDRLGLRGLLPPRIMTFDQQYERFMGNFRSLEKHTKDGAEDMTALAKWRILNRLHDRNETLYYRVLISNIEQFAPIIYTPTIGLVCQRYSGLYRRPRGMYFTARDRGEMMSIVYNWPSTQVDMIVVTDGSRILGLGDLGVQGIGIPIGKLDLYVAAAGINPQRVMPVMIDVGTNNQALLDNPQYMGLQHTRIEGDDYISLIDEFMEAVFTRWPNVIVQFEDFQNKWAFKLLQRYRNQYRTFNDDVQGTAGVALGGLLGAVRAMGKPMEDLVKQKIVVVGAGSAGLGVVNMVKSAMQRLLGGHSSETHKKAIDQFWILDKDGLVTKARDNLASDVEQYAREVEESEGSGSLKDGATLLEVVQKVKPDVLLGLSGVGGLFTQQVLEAMKESGCPRPAIFPLSNPTANAECTAKEAFQHAGPNIVFASGSPFRDVDLGGGQTGHSNQGNNMYFFPGIGLGTLMAGAHHISDGMLHAAAEELAAIMTPEQLEEGIIYPAVSRIREITARVAAAIVKEAVKEDIAEGYRDTDIKELRRLVQDDAVLLKYIEDHMWMPDYSPLVYPHV

SEQ ID NO: 5661 - protein, 231 aa, Ustilago maydis 521
MASSALQQNGAAAALQGPTLPPNASRLPQTAQLDALLTIIRDASTPRSDFIFYSDRIIRLLVEEGLNHLPTLPQTVMTPTGFEYSGVSFQGRICGVSILRAGEAMEAGLRECCRSVRIGKILIQRDEETAKPKLFYAKLPEDIAERWVLLLDPMLATGGSAIKAIEVLIENGVKAERILFLNLIASPEGLNNMYSKFPQVKVISAWVDERLDEKSYIIPGLGDYGDRYYSG

SEQ ID NO: 5662 - protein, 415 aa, Glycine max
  misc_feature (185)..(185): Xaa can be any naturally occurring amino acid
ILATSIVASGAYADDLDNSDGLIYTGQGGNVMNTDKEPEDQKLERGNLALKNSIEEKNSVRVIRGSESMDGKCRIYVYDGLYVVESCWQDVGPHGKLVYKFRLRRILGQPELALKEVKKSKKFKTREGVCVDDISYGKERIPICAVNTIDDENPPPFNYITSMIYPNCHVLPAEGCDCTSRCSRXDLEKCSCVVKNGGEIPFNHNGAIVQAKPLVYECGPTCKCPSTCHNRVSQLGIKFQLEIFKTDTRGWGVRSLNSIPSGSFICEYIGELLEDKEAEQRTGNDEYLFDIGNNYSNSALWDDLSTLTTLMPDAHTASCEVVKNGGFTIDAAQFGNLGRFINHSCSPNLIAQNVLYDHHDTRMPHIMFFAADNIPPLQELTYDYNYEIDQVRDSDGNIKKKYCYCGSVDCTGRMY

SEQ ID NO: 5663 - protein, 380 aa, Brucella melitensis 16M
MQVLVKPFDDRIMPSLGAAVFEEGPLRIRPAPEWRGRVINALGNAIDGKGALKPGTRPMAAESLAPAALRRARVDRGLRTGVNVIDIFTPLCFGQRTGIFAGSGVGKSTLLAMMTRAADFDTVVLALTGERGREVREMLEETMAGHLGKTITVVATGDESPMMRRLAPNTATAIAEYFRDLGQNVLLIVDSVTRFAHAAREVAIAAEEPPVARGYPPSVFSQLPRLLERAGPGSAEAGGSITGIYSVLVDGDDHNDPVSDTIRGTLDGHIVLDRAIAAQGRFPAVDIPASVSRLAKHNWTPEQRKLVMQLRSMVARFEETRDLRAIGAYQKGHDGLLDQAVDFVPRIYEALQQSPETGLSDDPYNDLAAALRGDRQAQNA

SEQ ID NO: 5664 - protein, 607 aa, Nicotiana sylvestris
MAVVTASSAGPSYAPEDPTLPKPWKGLVDGTTGFIYFWNPETNDTQYERPVPSSHAVSAPAHKSSVFVSSSVEKPSQGQRYDADGGHNRGSNNKIARSSSDRFHDGTSVHEGYGSLGVGSDISQESYCRRNEISVTGGDVPAPLTSFEATGFPSEIVREMHQAGFSAPTPIQAQSWPIALQGRDIVAIAKTGSGKTLGYLMPAFIHLQQRRKNPQLGPTILVLSPTRELATQIQAEAVKFGKSSRISCTCLYGGAPKGPQLRELSRGVDIVVATPGRLNDILEMRRVSLGQVSYLVLDEADRMLDMGFEPQIRKIVKEVPVQRQTLMYTATWPKGVRKIAADLLVNSVQVNIGNVDELVANKSITQHIEVVLPMEKQRRVEQILRSKEPGSKIIIFCSTKKMCDQLSRNLTRNFGAAAIHGDKSQGERDYVLSQFRAGRSPVLVATDVAARGLDIKDIRVVINYDFPTGIEDYVHRIGRTGRAGASGLAYTFFSDQDSKHALDLVKVLEGANQCVPTELRDMASRGGGMGRARNHWGSGPGGRGGRGGPYNSSYVGRNGGHGYDRGSRDSDRYGHGTYNADAPRKRSRSRSPNIGSGWSGKKSRFTD

SEQ ID NO: 5665 - protein, 384 aa, Physcomitrella patens subsp. patens
MVSKHWLEVEPMECNGEAQERKQRWILVTGGAGYIGTHTVLQLLMEGYCVVIIDNLDNSCEEALHRVRKLAGEFGENLKFVKGDLCKVEDVLKVFKLHRFDAVIHFAGLKAVGESVSKPLRYYSNNLISTINLMDVMSKNNCKNLVFSSSATVYGQPECVPCTEDYPLHVMNPYGRTKLFNEDIMRDVHHADSEWKIVLLRYFNPVGSHPSGEIGEDPMDYPNNLMPFVQQVAVGRREMLTVFGKDYKTRDGTGVRDYIHVMDLASGHTKALDKLFTTPDIGCAIYNLGTGKGTTVLEMVAAFEEASGKKIPLRFAGRRPGDSSEVFASTEKAEKELGWRAKFGIKEMCRDQWNWAKTNPYGYRGQQELEVTTQKSMSNGHRKL

SEQ ID NO: 5666 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 5667 - protein, 321 aa, Bacillus thuringiensis serovar kurstaki
MRIVNKKIIFFGDFGIDDAVALIYANKTCKLDILGIVAEYGNVSRDIVTENVYFLERYYATQVKIIEGASRPMTAEEPLFFPEIHGDHGLGPIIPPEMRICKRENFCELIKLIEPCPEDIIIVATGRLTTLATLFLLYPNIMDRICSYYIMGGAFLFPGNVTPVSEANFYGDPIAVNIVMKYAKNASIYPLNVTQGALITPEMANIIDKQGTGQAKLIKPMIDFYYENFYKKEYPGIGGSPIHDLLPFISFINDSIFEYKKSAVWISTTNDVTRGQSVADFRKIAEPTRFDDRPIQRIAVGFNYAAFKEEFMRTILKPDCP

SEQ ID NO: 5668 - protein, 708 aa, Photorhabdus temperata
MLIPTSTSVGLTSVSLGVIRSMEQKGVSLSVFKPIAQSRCCGAQDQTTAIIRSHSSIKTAEPLDMAYVESLLTTNQKDVLMEKIVALYHENTKDAEVILIEGLVPTRKHPFSQSLNYEIAKTLNAEIVFVLALGNDSQEQLKERVELARAEFGGSKNQNITGVIINKLNAPVDDQGRTRPDLSEIFDESSKAIVANIDPNKLAKNSPLPILGCIPWNFDLIATRAIDMAKHLNARIINEGAIKTRRVKSVTFCARSIPHMLEHFRPGSLLVTSADRPDVLVSACLAAMNGVEIGAILLTGGYAIDEPIKQLCERAFGTGLPVFMVDTNTWQTSLSLQSFSLEVPADDHERIEKLQNYVAQHINKEWIDSLTANSERPHRLSPPAFRYQLTELARKAGKRIVLPEGDEPRTVKAASICADRGIARCVLLGDPEEIRRVAAAQGVELGTGIEIVDPVAVRERYVPRLVELRKNKGMTEVVAREQLEDNVVLGTLMLEQGEVDGLVSGAVHTTANTIRPPLQLIKTAPGSSLVSSVFFMLLPEQVLVYGDCAINPDPTAEQLSEIAIQSADSAKAFGIEPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQSEQEKE

SEQ ID NO: 5669 - protein, 406 aa, Clostridium tetani E88
MFFITLSKKNTIGVMFMNPFISVGMAIIIGVLFGKIMNKFKIPAVAGYVIAGLVLGISGVNVISGEMSEKLSFIGDFALGIIAFNIGSELEYSVLKKLGKPIFIIAFFEATFAFILVTLVTILLGEKIYTALILGAVASATAPAATVMVLNELKAKGPLTSTLLGVVAVDDAICLMIYAIASSLAKVFIKHTSINVYSLIYLPIKEIVLSILSGFVLGIILVYIVNKLHKESEIQIVALGFIITLTGLSMKYHLSPLLSCMSLGVAVSNLCAHSNDVFATIEKFDAPIITAFFVLAGAKLDISLIPKIGLLGICYLIFRIIGKISGAYVGGIISKAPKTVKKYIGYGLFSQIGVAIGLAIVVGREFKGTGLDLKVITILLATTIITEIIGPIFTKQAIIKAKEANI

SEQ ID NO: 5670 - protein, 130 aa, Wolbachia endosymbiont strain TRS of Brugia malayi
MSYNEKILDHYENPRNVGSLDKNDPSVGTGLVGAPSCGDVMKLQIKVNDKGVIEDAKFKTFGCGSAIASSSLLTEMIKGKTIEDVTKIKNTQIVEELSLPPVKVHCSVLAEDAIKAAIHDYQSKHSKNES

SEQ ID NO: 5671 - protein, 518 aa, Neorickettsia sennetsu str. Miyayama
MTVNRSIRYNTTCLSGTFSMQKSLQLSLDESTKAQATTSKLTARERLEILFDDGKFVEIDSLVRHRCTNFGLEKKSVDGDGVIAAHGQINGRSVFAYSQDFSVFGGSLSERNAAKICKIMDLAAKTRAPIIGINDSGGARIQEGVDSLGGYGEIFLRNVRLSGVVPQISLIMGPCAGGAVYSPALTDFIFMVKETSYMFVTGPKVVKTVLKEDLTQNELGGSEIHTKKSGVCDRAFENSVELLIAVRNFLDFLPQNNTETPRQRECTDPVCRQIEWLDRATPVVSNLPYDMSNIIRAIVDDGEFFELSPDFAKNVLTGFAHIGGIRIGIVANQPSVLAGCLDINSSRKAARFVRFCDAFNIPILTLVDVPGFLPGSSQEQNAIIKHGAKLLYAYAEATVPKVTLIIKKAYGGAYIVMGSKHLGGDVNFSWPNAEVAVMGPEAAVEIVFRREIDTPNKIAELAADYRTQIANPRVPAARGYLDDIIKPSDSRKKIVEAFRMLASKTMEKPWKKHDNLPL

SEQ ID NO: 5672 - protein, 552 aa, Clostridium tetani E88
MLKPEFLSILKNEKGNLTKEGLIKDFIAGIIVAIIALPLSVALGIASGVSPEKGLITAIIAGFFISFLGGSRVQIGGPTGAFVVIIYGIIEKYGIDGLIVATLMAGIMLVIFGLLKFGSLIKYISYPITVGFTAGIAVTLFSTQVKDFLGLSINKVPSEFLPKWSMYISNMGTINWVTLALGIFSLAVIIVWPKFNEKIPGALVALILSTFIAYFFKLNVATIGTQFGEISSKIPVPKLPIVDIITLQKLIKPAFTIAILAAIESLLSAVVADGMIGEKHDSNMELVAQGVGNITSALFGGIPATGAIARTAANVKSGGRTPIAGMVHAITLLLIMKVLMPLAKYIPLTTLAAVLIVVSYNMSGWRTFRDMLRAPKSDVLILLATFFITVIFDLVIAIEVGIIISMCLFMRRMALAIEVNELDGSYCSKKLRLEGIHTNKIGDEILIYDIKGPLFFAGIDSFISSIESLNTESKVVILRMKNMPVLDVTAYGELKKIEKLCMDEEIKLIMSEVQKQPMKVMKNMGMVSRLGERRFIKTLEEAIRTANNCCID

SEQ ID NO: 5673 - protein, 220 aa, Neorickettsia sennetsu str. Miyayama
MHRMIKISPSLLSADFLNLHSDVKLLEESGADSIHIDVMDGHFVPNLTFGPVIIEQIKRITSIPIEVHLMILNAEQTFQDYINAGADTIFVHSEACFHLDRMVNAIKSQSVKVGVALNPATSEEALRYLYNSIDAVLIMTVNPGFASQVFLTSQLAKVSLVRRRIVELGVDVTLAVDGGINAETANLVVSAGAGTLVTGSYLFSNRKNLGAKIASLRVLA

SEQ ID NO: 5674 - protein, 168 aa, Neorickettsia sennetsu str. Miyayama
MYRVGFGYDVHKIDKPVKTGNTCIVLCGVSVPCEYKVIAHSDGDVALHALVDALLGAACIEGANDIGMLFPDTDEKWRGKSSSYFVEHVVTLIQRAGYVVNNADLTIVCETPRIQQYKSEMQQQVADLLCVRKEQINVKATTTEKLGFEGRKEGIAAYAIVSLTKIRP

SEQ ID NO: 5675 - protein, 532 aa, Chromobacterium violaceum ATCC 12472
MPILESKLSPRAANFVANADKMRALVDDLKDKVAQAALGGGEKARAKHTARGKLLPRERIDLLLDPGAPFLELSQLAAYGMYGGDAPGAGMIAGIGRISGVDCLIIANDATVKGGTYYPMTVKKHLRAQEIARDNRLPCVYLVDSGGAFLPLQDEVFPDKEHFGRIFYNQANLSAAGIPQIAVVMGSCTAGGAYVPAMSDETVIVKEQGTIFLGGPPLVKAATGEVVSAEELGGGDVHTKISGVADHLAQTDAHALAIARRIVSDLNWKKQGELDRAEPKPPRYAAEEIYGVIPADPKKPFDVREIIARLVDDSDFDEFKQNYGTTLVTGFARLNGYRVGILANNGILFSESALKGAHFVELCCQRGIPLIFLQNITGFMVGKKYENGGIAKDGAKLVTAVACAKVPKFTVLIGGSFGAGNYGMCGRAYSPRFLWMWPNSRISVMGGEQAAGVLAQVKKEQLGDAFTPEQEEALKAPVRQQYEEQGHPYYASARLWDDGVIDPAQTRDVLALALEAALSAPVEATRFGVFRM

SEQ ID NO: 5676 - protein, 266 aa, Xanthomonas campestris pv. campestris str. ATCC 33913
MIRIPMELRETVIAIARQAGDAIMEVYAQDFAVEIKADASPLTQADLAANRVIVEGLRRVTPDVPVLSEESVHVAWEERQYWTSYWLVDPLDGTREFVKRNGEFSVNIALIHMGAPVLGVVQAPVDGRVWYAARGENAYRRDGDRDEMLHSRTPAAAPLRVAASRSHRDARTAAALERMGQIDVVAQGSSLKFCRIAEGELDVYPRFGPTSEWDTAAGQCVLHAAGGALLAAGTGKPFRYNRRDTLLNGDFIALGDPGLPWRDWLV

SEQ ID NO: 5677 - protein, 410 aa, Yarrowia lipolytica CLIB122
MGCVPSKPEYGAEHDQHLLIEENMRFRVGKLSSSRSFDDSKPPKLLLLGTGESGKSTILKQMKLIHGQGFTHQERSLYAQVMWEQAFVQMMEIVRQARFLGISLDCDDPHSVLNSHMTLLTNADPNDSAMPDWDALYEDIKSQRRFMEGENLPMVYTDSPLKFADNVLKVSPAERPQIAHAISELWTKDTGIKQCFARSNEYQLEDAASYYFDNVHSLADPYYLASDEDVIRGRIKTTGVSETPFLVGGQMLSIIDVGGQKSERKKWMHCFDDVTSVLFVVALSEYDQVLYEDSGVNRMQDSICLFDYICNFKTFIDKPIILFLNKCDLLEAKLKKSPVRKYFPSFNGPNEVTAVKAFFKNLFLAQNKCGPSKEIYVHFTCATDTENMRFVMAAVTDMVLSAQLRETGII

SEQ ID NO: 5678 - protein, 488 aa, Bacillus thuringiensis serovar konkukian str. 97-27
MTKNNEAGWNLDHSYTTLPQSFYTEIPPTPVSSPELVKLNHSLAISLGFNPEELKKEAEIAIFAGNALPEGAHPLAQAYAGHQFGHFNMLGDGRALLIGEQITPSGKRFDIQLKGSGPTPYSRRGDGRAALGPMLREYIISEAMYALDIPTTRSLAVVTTGEPTYRETKLPGAILTRVASSHIRVGTFQYAAARGSIEDLQSLADYTIKRHYPEIEAHENRYTALLQEVIKKQASLIAKWQLVGFIHGVMNTDNITISGETIDYGPCAFMDNYDQGTVFSSIDTQGRYAYGNQPYMAAWDLARLAESLIPILHEDEEEALKIAQDEISKFSVQYENNWFLGMKKKLGLFSKEEQDHSLIEQLLKMMEKYKADYTNTFRSLTLNTIENTALFESPEFKEWYKLWQSRLEKQEESKENAYEMMKNNNPSIIPRNHRVEEALEAAVTNGDYSVMEKLLEALANPYAYSTDQEEYCVLPTPTNRPYRTFCGT

SEQ ID NO: 5679 - protein, 330 aa, Chlamydomonas reinhardtii
MEAIAPKPHKELVKTVQLEGQVLLKIIQHCTEALPQNVTGQLLGLDVGQQLEVTDCFAFPATVADDDSEAESAGANYQLEMMRCLREVNVDNNTVGWYQSANMGTFQTVELIETFINYHENIKKCVCIIYDPQRSSRGSIALKAIRLKESFIELSKEQKLTLKGFREANLSWRDIFVELPIRIRNSNLVQALVADLMPAPTATQADVERLNLSSAPFLERNIQSLLECVDDIVAEQQKVTMYHKNVARQQQAYAVWLAKRRQENQQRQADNQEPLPEEDPNLFKPIPEPSMLDNYLVTNQIATYCDQVNVAAGETIQKLFLMEGMQKAGL

SEQ ID NO: 5680 - protein, 316 aa, Bacillus thuringiensis serovar konkukian str. 97-27
MPKKVLIFCDPGIDDTMALLLAFFIDEIEIIGIVADYGNVPKKMAVQNAHFLTNETRNRNIKIFGGSERPLTGAPPAFFTEVHGKQGLGPIIPNGNVTNGEMENFFEVIPLIEQYKDELIIVSLGRLTSLAILFIMCKQLMKQIKSYYVMGGAFLHPGNVTPISEANFYGDPTAANIVLQSAANMYIYPLNVTQYSVITPEMAEYIEAKGKAPLVKPLFDHYYYGYYKNALPDLKGSPFHDTMPILALLDNSMFTYHKSPIVVMAESYAQGASIGEFRSLGKPKPFMDWPSHQIAIDFDYNRFFKHFMSLMTGEQF

SEQ ID NO: 5681 - protein, 784 aa, Bacillus cereus G9241
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSEGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLMKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLLAKGESILIGSQEHIETTSYKNLFLHAIHGIGIHTMECKEMNESLFQYSIQDLQCAGGVFIQLENEKEVVIKLYGKDGVQLTYKQQKVIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESTGNIYPMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 5682 - protein, 201 aa, Desulfitobacterium hafniense Y51
MITIRKAEFVTSAVNIKGYPELTGPEIALAGRSNVGKSSLINKFINRRNLARTGNTPGKTQMLNFYRINDQWSFVDLPGYGYAKVSKEIKANWGKMMEEYFSRRENLRAVIQVVDIRHVPSVEDQEMHAFLRNRGIPVLVVATKADKISKGQWGKHLSQIAKALHIPDWHIIITYSAETGLGVPELHEAVEEILSMDNEDS

SEQ ID NO: 5683 - protein, 500 aa, Petunia x hybrida
MVLSKTVSQSDVSIHSTFASRYVRTSLPRFKMPDNSIPKEAAYQIINDELMLDGNPRLNLASFVTTWMEPECDKLMMDSINKNYVDMDEYPVTTELQNRCVNMIAHLFNAPLEDGETAVGVGTVGSSEAIMLAGLAFKRKWQNKMKAQGKPCDKPNIVTGANVQVCWEKFARYFEVELKEVKLSEGYYVMDPEKAVEMVDENTICVAAILGSTLNGEFEDVKRLNDLLVEKNKETGWDTPIHVDAASGGFIAPFIYPELEWDFRLPLVKSINVSGHKYGLVYAGIGWVVWRNKDDLPDELIFHINYLGADQPTFTLNFSKGSSQVIAQYYQLIRLGYEGYKNVMENCQENASVLREGLEKTGRFNIISKEIGVPLVAFSLKDNRQHNEFEISETLRRFGWIVPAYTMPPNAQHITVLRVVIREDFSRTLAERLVRDIEKVLHELDTLPARVNAKLAVAEEQAAANGSEVHKKTDSEVQLEMITAWKKFVEEKKKKTNRVC

SEQ ID NO: 5684 - protein, 265 aa, Moritella sp. PE36
MTLIPELKKIARATGAVIYDIYQSGEFEQEMKLDHTPVTSADIAAHNYLSTQLALLTPDIPILSEEDCDIAIAERQSWDTYWLLDPLDGTQEFISRSGDFATIIALVHNNKPILGMIYGPKDDVLYWAVDGEGAYKETRDGEEKIFSHTCPKPLTSLNVVVSRVQNPDNIRNLVADDIDLELQSLGSASLKGCLVAEGKADCYIRFGITGEWDTAGTQCIVAEAGGAILDLNLNPLSYNQRDTLKNPDFIVLGDRNLTWSEILTG

SEQ ID NO: 5685 - protein, 533 aa, Triticum aestivum
PAIAIKAYPGDLIEQVCTKKQAGTASGIPWDIVDPRVRVCLLLHLALRSLNPSSVSGRRLPPGPRGVPVLGALPLVGPAPHSGLAALARKYGPVMYLKMGTCGVVVASSPSAARTFLKALDERFANRPAVASAEDMSYGCQNMVFANYGPKWKLLRKLSSVHLLGSSAVAGWASVRRDEAGRALRAILEVAEAGRPIVVPEMLVCALANIVGRITRRERVFDTQGDESNTYKEMIVSLLTGTGVFNISDFVPALSRLDLQGVQARLRRVHRQFDGLITKLLAEHAATAEERAREGRLDFVDRLRASSGEDGETITEVNIKGLIFDMFTAGTDTSSIIVEWAMAEMINNPSIMARAQEEMDRVIGRDRRLEESDIANLPYLQAICKEAMRLHPSTPLSLPHFSFEECEVDGHHVPANTRLLINIWAIGRDPAAWEDPLEFRPERFLSGPAAKIDPMGNNFELIPFGAGRRICAGKLAGMVFVQYFLGMLVHAFEWRLPDGEEKVDMAETFGLALPKAIPLKAIVTPRLVPAAYT

SEQ ID NO: 5686 - protein, 241 aa, Citrus x paradisi
QMGLAENLLCHELVEDWLMNNPKASICSAEGLNEFKGIAIFQDYHGLPEFRNAVAKFMGKVRGNRITFDPDRIVMSGGATGAHETVAFCLADPGDAFLVPTPYYPGFDRDLRWRTGVQLVPVVCDSSNDFKVTMEALEAAYEKAQESNIRIKGVLITNPSNPLGTFLDRETLKDIVSFINEKNIHLVCDEIYAATVFTKEPSFVSLAEIIDQDLHAIAISFTLYTVFLRTWDSLALGSVSF

SEQ ID NO: 5687 - protein, 469 aa, Brucella melitensis 16M
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEADKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 5688 - protein, 141 aa, Candidatus Protochlamydia amoebophila UWE25
MASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 5689 - protein, 184 aa, Brucella suis 1330
MLGIGDKLPSFKVTGVKPGFNHHEENGVSAFEEVTEQSFPGKWKVIFFYPKDFTFVCPTEIAEFARLASEFEDRDAVVLGGSTDNEFVKLAWRRDHKDLNKLPIWSFADTNGSLVDGLGVRSPDGVAYRYTFVVDPDNVIQHVYATNLNVGRAPKDTLRVLDALQTDELCPCNREVGGETLKAA

SEQ ID NO: 5690 - protein, 472 aa, Dechloromonas aromatica RCB
MAETLNPDDLPDHSARWNSFLQNCSTAASNAQPLWPVGRLTRINGLVMEAAGLKLPLGSTCKIYPSSGIPIEAEVVGFAGEKLYLMPSDDVYGLAPGSKVVAVESPNMLPKLGGPPPFRRRAIDRAKQGPVGEELLGRVLDGVGRPLDNKGPLIAAETRPLQSRPINPMSRAAIHQPLDVGIRAINALLTVGRGQRMGLFAGSGVGKSVLLGMMARYTEAEVIVVGLIGERGREVKEFIEQILGEEGMRRSVVVAAPADTGPLMRLQGAAYATTIAEYFRDQGKHVLLIMDSLTRYAMAQREIALAIGEPPATRGYPPSVFARLPQLVERAGNGQEGGGSITAFYTVLAEGDDQQDPIADSARAILDGHIVLSRTLADAGHYPAIDIEQSISRAMVNLIDAPHLDQIRKFKVLFARYQRSRDLISVGAYAPGSDPVLDQAISLYPRMESFLQQQLIEQSDFPSSLEALKTLF

SEQ ID NO: 5691 - protein, 464 aa, Zea mays
  misc_feature (68)..(68): Xaa can be any naturally occurring amino acid
MDRLPESTRSMRKYASEAGGLRAARQGPHGRSLTARTAHSMSTTALRTKSKSAASLLRRVPFAPLRPXLANLQEVFLGTKLAVLFPAVPLAIAAQCAHFGQVWVFTLSLLGLIPLAERVSFLTEQIAIYTGPTVGGLLNATCGNATELIIALFALMGGQIEVVKCSLLGSVLSNLLLVLGTSLFCGGVVNLGSDQPYDRTQADVSTGLLILGVLCQSLPLMLRYAVGAGEHSHSVAAPTTVLDLSRACSVVMLLAYVAYLFFQLKTHAQLFEPQEVDDGCEAEEDEQAVIGFASGFFWLAFNTVLIAILSEYVVGTIEPTSKSWGLSVSFISIILLPIVGNAAEHAGAIIFALKNKLDITLGVALGSATQISMFVVPLSVIVAWIAGIQMDLDFKLIETGSLFVSVIVTAFTLQDGSSHYLKGILLLLCYIVIGACFFVTRQPASNNNGAGLSLPTGTLSAQAA

SEQ ID NO: 5692 - protein, 142 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5693 - protein, 128 aa, Chlamydomonas reinhardtii
MALSSAANVVRSAVLQHLRVTVTSSLQSSSLPTFTNIISRGFGGGFLDKDSVTERVLHVTKHFEKIDASKVSPAASFEKDLGLDSLDVVELVMALEEEFGLEIPDAEADKIASVGDAINYICSNPMAK

SEQ ID NO: 5694 - protein, 285 aa, Bacillus thuringiensis serovar konkukian str. 97-27
MKLSVYVASAFSKDHKGGNKAGVVFIENALTTTQKMAIAKQLGYAETAFISGSEIADYKFEYFTPKEEVDLCGHATIGSFAILMHLNKLFRNRYTIETNSGVLTITIKDDSIFMEQNNPIFYDVVSPNEFIDCFDMKAIDNKYPIQIVSTGLKDILIPIKSETRLHALQPSFEKIKEISKYYNVVGMHLYTFNDDRIICRNFAPLYDINEEAATGTSNGALACYLHEQHNLQKEVYVFEQGYSLQSPSEILVKLATNSKNEIEKVYVGGKGYYCETKCLNVENME

SEQ ID NO: 5695 - protein, 511 aa, Triticum aestivum
  misc_feature (469)..(469): Xaa can be any naturally occurring amino acid
  misc_feature (481)..(481): Xaa can be any naturally occurring amino acid
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRGLDSAEELSSQLGELFEEDQLYRIDHYLGKELVQNLLVLRFANRLFLPLWNRDNVDNIQIVFREDFGTDGRGGYFDQYGIIRGIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAXGKLKAVSYKPGXSRGPKEADELSEKVGYMQTHGYIWIPPTLA

SEQ ID NO: 5696 - protein, 361 aa, Chlamydomonas reinhardtii
MASQAASQAAGLGPPAASQPFAEIAEPSEAATLPSGPVLQGRVGGLRSAVIHIVPGEDHTVHSSEGGNEHFGYGLACTQGHRTGMEDAHSVELDLDPETGTALFGVFDGHGGRQVADLCAANVVDAVLSSPAYQRGDVGEGLREAFFELDNRALACAEAHLAGATATVALVRGDRLYVAGVGDSRCVLSHAGTAQVLTNDHKPDDPKERARIQNAGGFVVWGRVNANLNISRALGDASFKQDKNLSASEQQVSPDPDVRCVTLTRHDTFMVLACDGLWNALPEQQVVAYVQRRLNLRHTLGAVAEGLVAEAMQPQRCAHDNVTVVVVQFNDAVQASQMTIGSGAVDSTTSADAAAATASPP

SEQ ID NO: 5697 - protein, 153 aa, Arabidopsis thaliana
SMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 5698 - protein, 346 aa, Prochlorococcus marinus str. NATL1A
MTNTQAPQEATSAVPSDRLWLRSELMGTQVITRDTGRRLGLVGEVVVDIDRREVVALGLRDNPLTRFLPGLPRWLPLDQIRQVGDVILVDTIDSLSENFVPDRFNKVINCQVITESGDQLGRVLGFSFDIETGELLTLVMGALGVPLLGEGVLSTWEMPVDEIVSSGPDRIIVYEGAEEKLKQLNSGFLEKLGVGNSGWEESERERYRVNLVPVENQLTSGESVNDDQRLLEQSQEIFEEEEMEYVELQDSEEQQYNKELRYLDEPNQSSIYSEIDEDQVNYSESNFKNRTDDFQAKFSSKNTKNQSKIIRDKEPIDVEPLEDLTTNNSQDMISNDKELIDIEDPW

SEQ ID NO: 5699 - protein, 243 aa, Triticum aestivum
  misc_feature (213)..(213): Xaa can be any naturally occurring amino acid
MYSWIPLLATFAPQALASCAYGTHLHRRADAIQAPKFGYSAANGPANWYNLDPEANKLCATGTHQSPINLSNGTHKVLSGSDLQIEIPDFHDGAEFENLGSTVEVVTEGMGGKLTLDNTVYHLKQFHFHLPSEHLDNGTSMAMEMHMVHQSEDKKLAVIGVYIDLDDGLPNATYKAKAAAREATGKDCKTTQAQRSTVATTVLNSVDKIATLXQTTHTKPLKMSEIVSLLEAGEFQSYSGSLT

SEQ ID NO: 5700 - protein, 462 aa, Glycine max
WVYEGVIDGPYGEFFIAEDKSLQKESLTQDYEAKYWRQRYSLKDGIPSFLANIAGAILTTGKYLNVMRECGHTVQAPPSENSKLMSFGSNHHYLECIKAAYNFASSELLNLIMEKYDLTGRLRSIKHYLLLDQGDFLVHFMDIARDELAKKPDEVSVEKLQSLLDLALRTTAAAADPFHEGLTCVVERSSLIRRLGTFNDLEVTQRNSGNNVLEEPVSITGLETFSLSYKVHWPLSIVLSRKALTKYQLLFRFLFHCKHVDRQLCGAWQVHQGVRALNTRETAISRSSLLCRSMLKFINSLLHYLTFEVIEPNWHLMYNRLQSANSIDEVIQQHDFFLDKCLRECLLLLPELLKKVERLKSMCLQYAAATQWLISSSIELHNPEEPIDESIGLNKAKGKSGQVLKSTTRNVAVTDSVLKFEKEFNTELQSLGSILSSNSQAEPYLSHLAQWLLGVKNEKNGL

SEQ ID NO: 5701 - protein, 606 aa, Rhodopirellula baltica SH 1
MLNFFRQQTSSFKNDLLSGLTVALALVPEAIAFAFVAGVSPLIGLYSAFFLGLITAVVGGRPGMISGATGAMAVVVVALVADHGVEYLFPTVILCGVLQIIIGLLRLGKLIRMVPHPVMLGFVNGLAIVIGMAQLGSFKTLSESGTLVYLNGLPLFAMLALVGLTMAIIWLLPKVTTAVPASLAAILSITLIAVAVNQSQQNESGDNLVATVGDMLRTNTIAAETKAANEAIAAEEAEAALHAGQFNPVSSGDGSTTLISAVVAQDGPSIKDSFASATDTPDIEMPPADPAAEDTAGSESGISGGLPMPFWMEFEMVPFNLATLKIIFPFAIVLCGVGLIESLMTLSLIDEITETRGQGNRECIGQGTANLVCGLFGGMGGCAMIGQSLINVNSGGRGRLSGITAAICLLLFVLFLAPWIEQIPMAALVGVMFMVVIGTFEWASLKMLRRMPRSDMFVMILVAGYTVFMHDLASAVILGVIVSALVFAWQHATHIGADVKINEFGSKIYQLHGPLFFASVSSFKEMFNVAEDPDDVVIDFYYSRVYDQSGLEAINGLAEKYQAAGKRLHLTHLSQECRSLLNQAGDLVEVNVSEDPHYHVATDRLA

SEQ ID NO: 5702 - protein, 478 aa, Francisella tularensis subsp. tularensis SCHU S4
MRRTKILATLGPASESREALTEMIKAGVNAVRCNFSHGSAEDHRKRVDLIRQIAKEQDTHVGILADLQGPKIRLSKFKNGSVEIKKGQKFTLDADLGINDGDENTVGIDYKELIQDVKKGDILLVDDGKIVLEVDSVKGNKAVTKVVVGGKVSNNKGINKKGGGLTAPALTEKDKEDIKIAAMLQVDFLAVSFVRDGKDMEYARQLVHEAGWRPAMVAKIERAEAVLEDNLKSIVDASDLVMVARGDLAVEIGDENVPTVQKLIISTARRNEKGSITATQMMESMIENSSPTRAEASDVANAVFDGTDAVMLSAETAVGKYPVETVSAMSRICKSAEKSKYTHISKKQKIADCDRIDHAVSVAAVKIANDIGAKGLIVLTEGGNTSRWMSRINTDLPIYALSRNATTLGAMTLFRGVVPIYFDSTRMSKLYVNRSACMELESRNLAKDGDIFVLTSGDSMGVHGSTNKIKVIIAGQVR

SEQ ID NO: 5703 - protein, 129 aa, Oryza sativa Japonica Group
CADLFFQSQVAGTQEGQTGTAQSVLTEDGPDVPLSDNIVLRKLLRIPRYFDPGETLLETCFNCGEEGHVAVNCPMEKRKRPCFVCGLFGHNSKQCTQVGLPSSKALLLGDLGSRLFHLQKRRSYCERLP

SEQ ID NO: 5704 - protein, 642 aa, Clostridium perfringens str. 13
MNLITLENISKSYSEKILANNISLGINEGEKIGLIGVNGTGKSSFLKIVAGVEEPDEGTVTKGNRVRIEYLAQTPDYDDNATVLEQVFKGNSEEMRILREYEELLEKIDKGEVKENDSERLIRLQGKIDALNLWDMESEAKNVLTKLGITNFEEKVGNLSGGQKKRIMLAAALITPCELLILDEPTNHLDNETISWLEEYLNSRKGALLMITHDRYFLDRVTNRILELDRGRLFSYDGNYSVFLEKKMERIAIEKASEEKRQNLMRKELAWVRRGAKARTTKQKARLQRFDELVNQEGFIENENIEISVMGTRLGKKIIEIEHLNKSFGDKKIVDDFNYIVLRSDRIGIVGPNGIGKSTLMGMIEGKVKPDSGEIIKGETVKIACFSQEDTHMHPEMRAIDYIKEAGEYLQTATGERITASQMCEKFLFDGTLQWTMIGMLSGGERRRLHLLRVLMEAPNVLLLDEPTNDLDIETLNRLEDYLDDFGGVVITVSHDRYFLDRICNKIFSYKGNGKIDIYTGNYGDYLLSKEEEIVNNKEKEVAVDKNKKEPSVDKNKNKGKVLKFSFKEQREFETIDEEIMTLEEKIEELDSLMAKHASEYGRLQELMEEKAKIEEELAFKYERWEYLNELAAQIEENKKNK

SEQ ID NO: 5705 - protein, 885 aa, Solibacter usitatus Ellin6076
MLSPGTAIGPYEILSLLGSGGMGEVYRARDQRLARTVALKVLPPEFAADSIRRQRFEQEARAASALNHPNILSVFDMGSQDGLVYIVSELIEGESLRDLIRRGPLPQSRAVEIAGQVADALAAAHAANIVHRDLKPENIMLTRDGRAKILDFGLAKQVQPRVPGSDETQFLTRTSPGAILGTAGYMSPEQVRGEPVDPRSDIFSFGLVLYECLSGRAPFERQTGAEMMTAILREDPPELPETVFPALRQIVHHCLEKDAVRRFHSANDLAFALRTVQTSGTASRSGISLAPAEVNAPRRRWLWPTLAIALALLLAVPHFMELDPIDLAAYRFIPFANDHEAESGPAWSPDGKSIAYLKTVAGIPQLMVRGLESPTAIQLTRSTTRVSSAFWSPDSAVVYCIDRAGKGELWGISPSGGHAVKILEDLHTADISPDGKSLAIWRATESGGAVKSSLWISSPPGAAPRPYLPAPFEVPLESNGGSLHFSPDGKSILLVASGIAPQVWVLPFPASSGAPRRVFSATNFNFVPRGAWMPDSRHAVLSFSTGGAQPALWFADLEREKLRKLTASTAAEEFPSLAPDGRRLVFTSVTDDFDLIELPLDGTAPRTLLANSRNMYSPAWSPDGDQLLYATDRSGASEIWSRNVKASIDRPMVTARDFPPGTTTALTHPVFSPDGSRFAFVRYATDQPATIWVEPTVGGAPIRMASEYMVSPTWSPDGNSIAGLMHRDRPWQPAIVEVGANMSPHVIASAPTCLMPMEWSPTGEWLACEARTGIELFSRDGARRRTLPRLNSSAIAFSRDGGTLYAAGRDAGRTFLKAIDLATGAIRDIAQHSGTMVISGGATYQARLSLSHDGRSLVTSAVESQSDLWILEGYPHPRPWWQLIK

SEQ ID NO: 5706 - protein, 300 aa, Zea mays
MLRSTHPLSPSRSSGGSSAPASSSGEAMVGGAPSGAKLLQILNVRVVGTGERVVVLSHGFGTDQSAWSRVLPYLIREHRVVLYNLVCAGSVNPDHFDFRRYNNLDAYVDDLLAILDALRIPRCALVGHSVSAMIGILASIRRPDLFAKLVLIGASPRFLNDSDYHGGFELEEIQQVFQAMSANYEAWAKGYAPLAVGADVPAAVQEFSRTLFNMRPDISLHVCQSVFKTDLRGVLGMVQAPCVVVQTTRDVSVPASVAAYLKAHLGGRTAVEFLQTEGHLPHLSAPGLLAQVLRRALARY

SEQ ID NO: 5707 - protein, 151 aa, Physcomitrella patens subsp. patens
MLQERSYVMVKPDGVQRGHVGEIISRFERKGFQLIGLKLFKTPKELAEEHYGELKEKPFYGKLVDYIISGPVVCIALEGPGVVASARKLIGATNPLNAEPGTIRGDLGIEVGRNVVHGSDSPENGLRELGLWFDQDELIEWEQHMTPWLKE

SEQ ID NO: 5708 - protein, 167 aa, Borrelia burgdorferi
MLLQKTLCIVKPDGVRRGLIGDVVSRFERVGLKMVAAKMLIVDESLAKKHYLYDDIVFRHSEAVWNSLIKFISNSPVFTFVVEGVESIEVVRKLCGATEPKLAIPGTIRGDFSYHSFKYSNEKGFSIYNVIHASANEADAMREIPIWFKDNEILNYKRDDECEHYYC

SEQ ID NO: 5709 - protein, 266 aa, Brucella suis 1330
MTAHSRQDLETRLALAEKIVQEAGAKALDYFNRRETLVIETKRDPQDVVSIADRDVEQLIRARVSESFPQDGFLGEEYGLNAGSSGYTWVVDPIDGTSPFVNGMPNWCVSIAVLKDGEPVVGVILAPCFNELYVSAKGQGATLNGRKLALDPSRNIRNAVTGIGANNYVTPQLVTKVVENLLEAGGTFIRNGSGALMIAYVAAGRLVGYYEPYMHAWDCMAGFCLVREAGGYIYPFPTDGENLTKGNRVFAAAPGAVDDLKKVAGL

SEQ ID NO: 5710 - protein, 172 aa, Neisseria meningitidis MC58
MAKHEIEERGDGLIEKMVAVNRVTKVVKGGRIMAFSALTVVGDGDGRIGMGKGKSKEVPVAVQKAMDQARRSMIKVPLKNGTIHHEVIGRHGATKVFMQPAKEGSGVKAGGPMRLVFDAMGIHNISAKVHGSTNPYNIVRATLDGLSKLHTPADIAAKRGLTVEDILGVNHG

SEQ ID NO: 5711 - protein, 178 aa, Triticum aestivum
  misc_feature (140)..(140): Xaa can be any naturally occurring amino acid
MGPNVMGSLDTSVALFQGLKSTDGLPVRRRSNGASLGSVSNGGRIRCMQVWPIEGIKKCDTLSYLPPLRTEALVKHVDYLIRSKWVPCLEFRKVGFIFREQNASPGYYNGRYWTMWKLPMFGCTDATQVINKVEEVKNEXPDAYVRMIGFYNMLQVQCVRFIGFKQPGLQGLRQRLNR

SEQ ID NO: 5712 - protein, 605 aa, Chlamydia muridarum Nigg
MIKNRKIVLRKSSLPLFSLDKFLSTIRKEPSFSNTEEVLVKVSLSFKHLVPKLVTCLKEGYSFNTLKKDFIAGLTAGILAFPLAIAIAIGIGVSPLQGLLASIIGGFLASALGGSRVLISGPTSSFISILYCIGVKYGEDGLFTITLMAGIFLIIFGLAGLGTFIKYMPYPVVTGLTTGIAVIIFSSQIRDFLGLQMGDGVPLDFIGKWVAYWDYLWTWDSKTFAVGLFTLLLMIYFRNYKPRYPGVMISIIIASTLVWILKIDIPTIGSRYGTLPSSLPGPVFPHISITKMLQLMPDALTIAVLSGIETLLAAVVADGMTGWRHQSNCQLIGQGIANIGTSLFAGMPVTGSLSRTTASIKCGASTPIAGIIHAICLTFILLLLAPLTIKIPLTCLAAVLILIAWNMSEIHHFIHLFTAPKEDILVLLTVFILTVMTTITSAVQVGMMLAAFLFMKRMSDLSDVISTAQYFDESEQPQNDLLFSKNEVPPFTEIYEINGPFFFGIADRLKNLLNEIEKPPRIFILCMTRVPTIDASAMHALEEFFLECDRQGTLLLLAGVKKTPLNDLRRYHVDELIGVDHIFSNIKGALLFAKALIKLESKSSQ

SEQ ID NO: 5713 - protein, 382 aa, Nostoc punctiforme PCC 73102
MTQTISINDSGRLQLTPLEIPSRLLLGPGPSNAHPTVLQAMNTSPVGHLDPAFLALMDEIQSLLRYVWQTENPLTIAVSGTGTAAMEATIANAVEPGDIVLIGVAGYFGNRLVDMAGRYGADVRSITKPWGQVFNLDELKTALETHRPAILALVHAETSTGARQPLEGVADLCREFGTLLLVDTVTSLGGVPLFLDAWGVDLAYSCSQKGLSCPPGASPLTMSARAVEKLQQRQSKVANWYLDMLLLGKYWGAERTYHHTAPINLYYALREALRLLAEEGLANSWQRHQKNVEYLWEGLENLGLSMHVEQEYRLPTLTTVRIPAGVDGKAIARQLLNEHNIEIGGGLGELAGLVWRVGLMGFNSRKESVDQLLAALRQVLPK

SEQ ID NO: 5714 - protein, 98 aa, Zea mays
MLDIDGTQNKSKLGANAILGVSLSVCRAGAGAKGVPLYKHIQELAGGEERVMPVPAAKGRNGGSHAGNNLAMQELMSLPGGATTFAVALRMGSEVYHV

SEQ ID NO: 5715 - protein, 113 aa, Zea mays
  misc_feature (71)..(71): Xaa can be any naturally occurring amino acid
MLCVDILMAPAPCGHTLQMVLHLHMGKSEGNKNMNELLGDKGANLPDIASIRLSEPTWFIVSTEACQHYQXAGRALPPSLWSEVLNRLRWLKYYITSSLRHPRCPLLLSNRSG

SEQ ID NO: 5716 - protein, 295 aa, Zea mays
VSRARLDRLATASTGDDAEWEDMRLKRILVDYMLRMSYYNSATKLAETSGIQDLVDIDVFLDAKRVIDSLQNNEVSPALAWCAENKSRLKKSKSKLEFLLRLQEFVEFVKVKNFIQAIAYARKHLAPWGSVHMKELQRVTATLVFRSNTNCTPYKILFEQDRWDYLVDIFKQDFCKLYGMTLEPLLNIYLQAGLTALKTPFCSEGSCPKEDPLSLEGFRKLAEPLPFSKQHHSKLVCYITKELMDTENPPQVLPNGYVYSEKALQEMSKKNDGKITCPRTGDVYDVSECVRAFIS

SEQ ID NO: 5717 - protein, 392 aa, Francisella tularensis subsp. tularensis SCHU S4
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNSGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSDVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 5718 - protein, 348 aa, Francisella tularensis subsp. tularensis SCHU S4
MFNKLSQDNILRRLKMRVVINGFGRIGRLAFRQMFGKDNIEIVAINDLTNPEMLAHLLKYDSAQGRFSKAAVTVVKESSIVVDGKEIKIYAEKDAANLPWGELNVDVVLECTGFYVSKAKSQAHIDAGAKKVVISAPAGNDLPTVVFGVNHDILSADDKIISAASCTTNCLAPMAKALHDLATIESGFMTTIHAYTGDQNTLDAPHAKNDFRRARAAAVNIVPNSTGAAKAIGLVIPELAGKLDGAAQRVPVATGSLTELVAVVSKKVTAEDVNAAMKAAANKSFGYTEEELVSSDIIGISEGSLFDATQTKVTSLGDKSLVKVVSWYDNEMSYTNQMVRVVEYFGAL

SEQ ID NO: 5719 - protein, 716 aa, Thlaspi caerulescens
MRKGVLNPDRDRQIVEHELQETGFSPESEKATKKNVEEDEDEEEEEESVEKIFESREVPSWKKQLTLRAFVVSFVLSILFSFIVMKLNLTTGIIPSLNVSAGLLGFFFVKTWTKMLHRSGYLKQPFTRQENTVIQTCVVASSGIAFSGGFGTYLFGMSERIANQSGDASRGFKDPSLGWIMGFLFVVSFLGLFSVVPLRKIMVIDFKLTYPSGTATAHLINSFHTPQGAKLAKKQVRVLGKFFSISFFWSFFQWFFTGGENCGFSNFPTFGLKAYQYKFYFDFSATYVGVGMICPYIINISVLLGGILSWGIMWPLIETKKGDWFPADVPSSSMHGLQAYKVFIAVAIILGDGLYNFCKVLSRTLSGLFVQLRGTASVSRTTSLTAEEDPPASPLSPMQSYDDQRRTRFFLKDEIPTWFAVGGYIIIAATSTAILPHMFHQLRWYYILVIYICAPVLAFCNAYGAGLTDWSLASTYGKLAIFTIGAWAGSEHGGMLAGLAACGVMMNIVSTASDLTQDFKTGYLTLSSPKSMFVSQVIGTSMGCVVSPCVFWLFYKAFDDLGLPNTEYPAPFATVYRSMAKLGVEGVSSLPRECLVLCYAFFGVAILVNIVKDSLWSRWGRFIPLPMAMAIPFFLGPYFAIDMCVGSLILFIWERVDAAKAEAFGTAVASGLICGDGIWSLPSSVLAIAGVNPPVCMKFLPAATNLKVDNFLQRPS

SEQ ID NO: 5720 - protein, 397 aa, Bacillus sp. SG-1
MFNKIEEALEDLKAGKVIIVIDDEDRENEGDFVALADKATPEVINFMATEGRGLICTPITLEKASQLQLNPMTDQNTDPYGTAFTISVDHVNTTTGISAFERSTTILEMIKEDAKPSDLKRPGHVFPLIAKNGGVLKRAGHTEAAVDLAALSGSTQAGVICEIMNPDGTMARVPQLKEIAEKFNMKMITIQDLIAYRRKEEKLVEKEVEIELPTEFGHFKAVAYTEKLTGQEHVALVKGEISPGEPVLVRVHSECLTGDVFGSNRCDCGPQLHAALSQIEKEGKGILLYMRQEGRGIGLVNKMKAYKLQEEGLDTVEANHKLGFADDLRDYGIGAQILKDLGVSKMRLLTNNPRKITGVKGYGLEVEERVAIQMPSKEENEKYLKTKHSKLGHLLQF

SEQ ID NO: 5721 - protein, 391 aa, Clostridium perfringens str. 13
MASKFYLHKGKNKKAEQGRPWIYIDEINEYDGDYENGDIVEVYNHKGYFLGKGYINDRSKITIRIMTKDIDEEIDEDFFKRRFKTAWEYRKKVIDTSSCRFIFGEADFLPGLTVDKFEDYYVIQISTLGMDKYRDLIVKILVEEYGAKGVYERSDIKTREIEGLEQRKGFLTEPFDTDIQIVENGVKYIVDLENGQKTGFFLDQKENRAAMHRICKDMDVLDCFTHTGSFALNAGIAGAKSVLGIDVSQHAVDCATRNAELNNLQDRVKFEKHNAFDVLGDWSREGKQFDVVILDPPAFTKSRNTVKQAIRGYKEINLRGIKMVKEGGYFATCSCSHYMDEEQLKKTVAEAAHDARRTLRQIEVRTQSADHPILWNSDESYYLKFFIFQVF

SEQ ID NO: 5722 - protein, 156 aa, Bacillus sp. SG-1
MKTIYEGNLVGSGLKVAIVVARFNEFITSKLLGGAEDALKRHGMDEADITVTWVPGAFEIPVIAKKLAASKKYDAVITLGTVIRGATAHFEYVSGEVAKGVANVGLQEDVPVIFGVLTTDTIEQAIERAGTKAGNKGWEAAVSAIEMANLIRQIEQ

SEQ ID NO: 5723 - protein, 298 aa, Neisseria gonorrhoeae FA 1090
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 5724 - protein, 416 aa, Prochlorococcus marinus str. NATL1A
MNNLVKNIAEKSRNDFPLFNRDINKNLIYLDHAATSQKPKQVIDSLKKYYSFQNANVHRGAHQLSAIATEKFENSRKLTANFINSKNEKEIIFTRNATEAINLVAYTWGNYELQENDEILISLMEHHSNIVPWQLIAKAKKCKLIYINIDKNGELDFDDFRKKLSDKTKIVSLVHVSNTLGCCNPIEEISSLAHQKGSLVLLDACQSLAHKQVDIKKLGIDFLAGSSHKLCGPTGIGFLWGREEILKKIPPFLGGGEMINEVFKDNSTWAELPHKFEAGTPAIGEAIGMGTALKYLQSIGLNEIHNYEKELTKYLFEKLEEIDDLKILGPSPFIQPDRGPLATFYIKGVHSNDVAELLDNSNIYIRSGHHCCQPLHRFYGIKSTARASLSFTSTPSEIDYLAEELKSVISFLKKNS

SEQ ID NO: 5725 - protein, 94 aa, Francisella tularensis subsp. tularensis SCHU S4
MSTHNEDSKKNNADEKAKIFSRVNHIIVEQLGVKEEDLKPEASFIDDLGADSLDTVELVMALEEEFDTEIPDEDAEKIRTVKDVYDYIESKDVG

SEQ ID NO: 5726 - protein, 306 aa, Photorhabdus luminescens subsp. laumondii TTO1
MAGLLPITVIAAAAGDIVLSLPRLPRSGADQEAKEIDRQIGGSGFNVARALVRLQIPVINGIPVGNGCWGEQITKEMQDLGLEVTLTNPYLDNGWCLAMVEPDGERSFVSVSGCEVDWSTAMLSSIVLPERGYIYSSGYVMASKSTAILCDWLLASPSGQTLLLDFGPRLPEIDPTFLDALPADRTILTLNRDEVAILCGEGDPAVQASRYSSERKITIICRLGSQGTWICLPDRKPEYVAAYKVKVVDTIGAGDAHSGGMLAGLSQGMSLRDAVELGNRVAAIVVNRSGAAGAPTIKELEEFVFE

SEQ ID NO: 5727 - protein, 287 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYYRSGSGSRRSSERHRSHDSDGSRRRRGRSRSRSRSPVREGSEERRAKIEQWNREREAAQV

SEQ ID NO: 5728 - protein, 637 aa, Erwinia carotovora subsp. atroseptica SCRI1043
MTDLFTSFSDLGLSAPIINALTDLGYEKPSPIQAECIPHLLNGRDVLGMAQTGSGKTAAFALPLLNNLKPELKAPQMLVLAPTRELAVQVAEACSDFAKHMHGVNVVALYGGQRYDVQLRALRGGAQIVVGTPGRLLDHLKRGTLDLSNLSGLVLDEADEMLRMGFIEDVENIMAQIPATHQTALFSATMPEAIRRITRRFMKDPQEVRIQSSVTTRPDISQSYWTVQGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNVERTMKLAIPEVELPNAELLGQRRLAKFAAKVQLQLESSDLDMYRALLTKMQPQEELDIETLAAALLKMAQGERPLILPPEPAFRPRREFRDRDESRSDSRGDRRREPRDARDSREPRDGDRPQRRERRESGEMELYRIEVGRDDGVEVRHIVGAIANEGDISSRYIGNIKLFGSHSTIELPKGMPGDLLSHFTRTRILNKPMNMQLLGDAVAQPERRGGGRPAGAGTGGERRDGAAPRRSFGGGERREGNANGGERRERSVNRDAAPRAPRRRPADA

SEQ ID NO: 5729 - protein, 318 aa, Photorhabdus luminescens subsp. laumondii TTO1
MLTELIASNRRSAAIHAFVDTGLSTHFKDGIYVDISELSRKSGVNYARFSRLCDFLVEMGVLVSNDNKFRLSDECHVFANPESFESFMIKLEICSHYSNAWLMYGKSLFEDDGKSAFEMAHGRPFFEYLDGNKFLKSNFDALMTRVSNLIVEKLLGIYDFNQHNRILDVGGGEGELLVRISEKVKGKHYAVLDRYSELPVSDNIDFINGNFLNSIPSGYDLYILKNVLHNWSDSDSILILENFRKAMDKNSSLLLINMVKEPEFSRSFDILMDVLFLGKERSFTEFEYLANQAGLVVQETKVIDQSYSPYSFIKLQIK

SEQ ID NO: 5730 - protein, 129 aa, Glycine max
  misc_feature (24)..(24): Xaa can be any naturally occurring amino acid
  misc_feature (43)..(43): Xaa can be any naturally occurring amino acid
QFWPLLPNPNASPNSTSPLATLSXATRLRHRAISAVVNASQPXSPSAPAPRAITDYDEHSHSLPCIQNIRGKSIVVKYGGAAMNAPELQACEINYLVLLSCVGLRPVLIHGSGPDINSCLGRLNIPDDF

SEQ ID NO: 5731 - protein, 317 aa, Photorhabdus luminescens subsp. laumondii TTO1
MLIDLITSCRKSTVIYAFVDMGLSVHFKDGACVNISELASQYGLDHSRFSRLCEYLIKIGVLVSCNEGVALSEECSALADPESMESLMIRCEVSPEYWKAWSMYSKSLYENNSKTAFEIAHGKPFFEYLDHHELFRSNFDSFMSKNSDKIIEKLLDIYDFSQHNRILDVGGGEGNLLIRINEKIKGKHYAVLDRYNETPVLEDIEFINGDFFKLVPSGYDLYILKNVIHNWSDSNAILILENCRKAMDDNATILLIGTVKKLKLEIIDSTDILMDVLLLGKERYLNELEDLAHQAGFVVKDIKEINEKYSIIELGVK

SEQ ID NO: 5732 - protein, 113 aa, Triticum aestivum
  misc_feature (47)..(47): Xaa can be any naturally occurring amino acid
  misc_feature (52)..(52): Xaa can be any naturally occurring amino acid
  misc_feature (105)..(105): Xaa can be any naturally occurring amino acid
LVYLRGHEGRGIGLGHKLRAYNLQDDGRDTVEANEELGLPVDSREFXIGAQXILRDLGVRSMKLMTNNPAKYVGLKGYGLSIVGRVPLVTPITTENQRYLETKRXKMGHVYSN

SEQ ID NO: 5733 - protein, 348 aa, Physcomitrella patens subsp. patens
MDVKAAGSVAQDQFSKHADDMMAILMAFQAPEIEVIGLTTIFGNVNTDLATINALHLCEMAGHPEIPVAEGPSEPLKRVKPRIAYFEHGSDGLGETYQAKPNFQKLSKDAADFLIENVTEFPGEVTVVGLGPLTNLALAIQKDSNFAKNVGQLVVLGGSFNASGNVNPAAEANVSLKRQKSHSRNLFGDPEAADIVFTSGMNTLAIGIDLTTQVIFNEDDLCEIRDSGGDYGKYIYDCCRFYHDWHLSSDHLDVMGLTYLPMVTGIFLHDPTCMAALLDPTLFTFKNGAVRVETEGPCLGHTILGMGLKNWVKETSWTGVPPIDVAITVDADGVRNLVKKLLCSSRLK

SEQ ID NO: 5734 - protein, 317 aa, Photorhabdus luminescens subsp. laumondii TTO1
MLAELITSYRKSIAIYTFVDTGLSVHFKNGTYMDINELASQYGIDYSRLNRLCDFLIEIGVLVSSNDRVALSEECRVLADPESMESLIAKWEFNSGLWNAWLMYPKSLLENNGKSAFEIANGKPFFEYLDSNKLLKSKFDSLMSKDSDKMIEKLFNVYDFNQHDKILDVGGGEGNLLIRMSEKVKEKHYAVLDRYNELPDYGNINFIDGDFFKSIPSGYDLYILKNVIHDWPDNDAILILENCRKAMGNNATILLITLMKKPQSNIIKYFDILMDVSSLGKERDLTEFEYLANQAGLVIQDVKDIDESYSIIQLGVK

SEQ ID NO: 5735 - protein, 189 aa, Clostridium tetani E88
MLWKKLISNLKAGILPCFYFNYIKNNRSIYMNITIISVGKLKEKYLKLAVEEYSKRLSRYCKLNIIEVTDEKTPDNASEKEELQIKEKEGDLILKNIKDNMFVIALDLNGNELTSIDFSNFINDLGIKGESNLTFVIGGSLGLSSKVLSRSNYKLCFSKMTFPHQLFRVMLLEQIYRGYRIMNGEPYHK

SEQ ID NO: 5736 - protein, 482 aa, Idiomarina loihiensis L2TR
MNNEQVLQPDNVELIKNSRVGTSTKSSIAVDDPATGHVIGHVPDLTPRQILRAIESAETAFYKWRDVPLRERCEKLFRWYQLMHEKEEELAGILTSEQGKPLSESRGEIRYAASYIQWYAQPSLQDQGSVLPYSSIDESMIVITEPVGVCAAITPWNFPAAMITRKVAPALAAGCTMLVKPALETPLTAIAIAELAIQAGIPEGVLSIVTGDGEAIGKIFSESAVVRKLSFTGSTRVGRLLMASSASTIKRLSLELGGNAPFIVCETADVERAVQGAIQSKFRNAGQTCVCANAFYIHTKVYDEFTEKFIACVNQLMLGNGKNESVDIGPLINENALEKVEQIVADAVKKGAVIACGGERWVNSERWYYPTVLLNADSSMRCVNEEIFGPVAPIVRYNDETALLEELRQQQTGLAAYFYSQNLGQVNRLSRALEVGMIGVNSGVISDAAVPFGGVKSSGIGREGGRHGIEEYLETKYIKLSY

SEQ ID NO: 5737 - protein, 509 aa, Myxococcus xanthus DK 1622
MALPDLKALSLLNHVPPRLLSAAERYLKAVPGVKGLLNRETGSLLSELESGLKPYRGKMQSFDHLPPTGRSREDVLRELQALESQEEYRWREGRVSGGVYNGDAEHIAFLNRVYALHSQSNPLHADLWPSATKFEAEVVAMTASMLGADVANAGQPEEARICGAMSSGGTESIMLAMKTYRDWARETKGITRPEMVAPASAHPAFDKAAHYFGIKMVRVPVGPDYRADVAAMRKAINRNTIVLIGSAPGFPHGVIDPIEALSEIARKKRIGFHTDACLGGFVLPFAMKLGYDVPPFDFRLPGVTSMSVDTHKFGYAAKGSSVVLYRGTELRSHQYFTATDWPGGIYFSPTFSGSRPGALIASAWAALVSTGEQGYLDATRSILETAAAIKKGIRDIPELHVLGDPLFVIAFGSESVDIFQVMERMSEHGWNLNGLHKPSAVHLCVTLRHTQPGVAEQFLVDLRDAVDYVKSHPSAKGTMAPVYGMAASVPFRGLVSDLLKKYMDLLYKV

SEQ ID NO: 5738 - protein, 165 aa, Zea mays
MMSRERKKAAALQEKLKILRSITHSHALSNTSIIMDASAYIKELKQKVVRLNQEIACAQDALRHKSSSSYPTVTVEALGVQGSSFLVNVFSDKSCPGLLVAVLEAFDELGLSVLQATASCADSFRLEAVGGENVADNVDEHVVKQAVLQAVRSCSEGGSEHDDEE

SEQ ID NO: 5739 - protein, 143 aa, Zea mays
  misc_feature (56)..(56): Xaa can be any naturally occurring amino acid
MAKCSSKIRYIVWLRQTLRRWRSRAAARAAVPAGHVAVCVGGAARRFVVRAAHLKXTPVFRELLRQAEEEYGFPSGACAGPIALPCDEGLFEHVLRHLSSPSKSARFVTLEDLESGALSCCCVAAAGDSLPLLRGISADKAVW

SEQ ID NO: 5740 - protein, 248 aa, Physcomitrella patens subsp. patens
MVRNMPSSDIFGSKQRSPVPMRRRDEINATEDAATTELVKADGAEVRDTLTVRTGSSSPRSESTSPRFRDQGTTGPAEVSVEKKNEFFEIKGNMSMGVDPDIAYEILTDYENNPDIFKTVSKVEVEHRDNSKFVTQHAHWHLMFWSGTFEMRMKVEEDPSERAVSMKLTDPGFLKIFNGYWSIEPRVVDGKSMGCNVVVTQEVLPSMTPPGPLASVVSRILGNQVKAVLQDLCAEAERGQQMRRVSAE

SEQ ID NO: 5741 - protein, 321 aa, Rhizobium leguminosarum bv. viciae 3841
MRMLVNGKWTEDWQPVQAKDEKGGFVRQTSSFRNWVTPDGSAGPTGEAGFAASAGRYHLYVAYICPWASRTLIGRKLKGLEDIISVSVVEPLLGKQGWRFGDYPGATEDHVNGVTYMHEIYTRAAPDFTGRATVPILWDKQKTTIVNNESADILRMLNSGFGGLAKNPIDLYPAVRCTEIEAFNDRIYPDLNNGVYRAGFATTQIAYEEAFADVFACLDWVEQQFEGRTFLFADHPTESDIRLFVTLVRFDVAYHGIFKCNLRRLSDYANLRAFCRRMLDWPGIGETVNLDHIKRGYYSIESLNPTKIIPSGPDLAEIFRA

SEQ ID NO: 5742 - protein, 374 aa, Wolbachia endosymbiont strain TRS of Brugia malayi
MSKKDYYKLLGVDRNASTDEIKKAYKKLALKYHPDRNPGNKEAEEKFKEITAAYEVLSDSEKRAGYDRYGHEGASGGFDFSQGFGSAGDFSDIFNDFFGGEFGSSSRSKAKRSTTGVPGADLRYDLEITLEDAFKGIQAPIHYVTNVKCDMCQGRGSEGATKPVQCHTCQGSGRIRTQQGFFTIERTCTTCYGEGEIIQNKCKKCNGSGRRRDEVNISVSIPKGIEEGAKVRVSGKGEAGAKGGKSGDLYVYVKITPHKIFTRNKADLHCKVPIRMTLAVLGGEIDVQSIDGAKIKVKVPEGTQTSTKLRCKEKGMPYMNSYARGDLYVQIIVETLNPNNLTKKQIELLKALEEEENASIQQQSEGFFSKVKKK

SEQ ID NO: 5743 - protein, 455 aa, Brucella suis 1330
MAGQLTFDELKKAVAEGRIDTVLACIVDMQGRLIGKRFYGQFFVESGYDETHGCNYLLADDIDMEPVPGYEAAGWDKGYGDFVMKPDLSTLRLAPWLEKTAIVLCDVLDHHHDDLSHSPRAVLKKQVQRLHERGYRAYFASELEFYIFDETYKSARAKRWHEMETASPYVQDYVIHLTTREEPVLRAMRNHLADAGIPVENSKGEWGPGQQELNVRYCKALEMADRHVIMKNAMKEIAEAHGKCITFMAKYDYARAGSSSHVHNSIWSADGKEPLFFDPKAPYTMTPLMRSWVAGQIKYATDYTYFLAPYINSYKRFQAGTFAPTKIMWSQDNRTAGFRLCGEGTKGIRIECRIGGADINPYLAFAALIAAGLKGVDEKLELDEPFVGDAYSAVRLKEIPYTLREAAAALKGSAFLKEAFGEDVVNHYTHTAHWEQIEYDRRVTDWELYRGFERY

SEQ ID NO: 5744 - protein, 769 aa, Xanthomonas campestris pv. campestris str. ATCC 33913
MSNDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEDVKLATTGMGAAGISCVNMLVSLGLKSENILALDRDGVIHTGRTDLDPDKQRYARDTDKRTLAEIVEGADIFLGLSAAGILKPEMVATMARQPVIFALANPNPEITPEAAKAVRPDCIIGTGRSDYPNQINNVLCFPYLFRGALDVGATGINEDMKIACVKAIAAMARREASDLGAAYGGETPSFGPEYLIPRPLDPRLLVELSSAVAQAAMDSGVATRPIADMAAYRDRLSQFVYRTSLMMKPVYDRARADKQRVVYAEGEEEVVLRAVQNVIDEGLALPILIGRPDVIEARIQRMGLRIRAGEDFEITNIHDDPRFNDYWQYYYALTERRGVTVTAAKELMRSRPTLIAAVMVARGEADAMLSGVVGRFHKKLGYARSVIPLEPRVSSTSAMTGVINQQGMFFFLDTHVQEDPTVEQVVEATLQAAYRLKLFGIEPNIALLSHSNFGSHDSRDALKMREVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKQRDAEKHNAEKNGG

SEQ ID NO: 5745 - protein, 463 aa, Lentisphaera araneosa HTCC2155
MNKKKILIVDDEIHTCQGLARALKYEWETFTASNGKEAIKIFEDNPVDIILTDVKMPGMNGIELLRQLKNIRPETPAIVMSAYNETETVVDAVKAGAYDFITKPFRLDDLDGVLKTAVQASPSFQLPSTKKATSAQLPAIAQTAKGSKNSPQIIYQSVAMENVLRTVQQIAPARSSVLITGETGTGKEVIAKAIHAASTRSKKAFIAVHCAALNANLFESELFGHEKGSFTGANEKRIGRFEAADGGTLFLDEIGEIDAATQVKLLRILESRSFERVGGNETLYSDARLIAATNRDLRKMVQAGEFREDLYYRLDVINLELPPLRDRREDIPALLQHWLISSVTENQLNVKGFTADAMARLCTYDWPGNVRELRNVVERMAVLSQQEYLDLPNLPDHVLLGEQQLSETAKIEDKDKALDVAENEKVLILKALKESNNNRTLAAERLGMSRRTLHRRLKQFGIT

SEQ ID NO: 5746 - protein, 349 aa, Zea mays
MVGGGRRGGAAAEEVKLNTGNVFAALESLKKKKKGDKGRAAGPSSRKKHGAGAAQQQQEPPQKDVFWAPAPLTTKSWADVEDDDDDDYFATTAPPRPVWAAAAAAEPAKEEEDVEDAVRAALQECKKNYHIDTEPNCTERKRFSQQDVESDDEDLDDEDLDDGAEHEVEDAPAELAVKTVEALAAPPKDTERQLSKKELKKRELAELDAVLAELGLSGNSTSAAQDAEKEGANQAGDAEKKEDATVPSESKTSKKKKKKDKSSKEGRKETQEAAEGSEETASAGPDEEDTTAVDVKERLKKMASMKKKRSSKETDTGAKIAAAEATARSARLAAAKKKEKSHYNQQPVR

SEQ ID NO: 5747 - protein, 571 aa, Bacillus licheniformis ATCC 14580
MKGRRRVSHNKLNEQVIETRLRGFEVLATPLLNKGVAFPPEERDALGLTGLLPPKVLTLEEQAKRAYKQFQSQPDDLSKNVYLTALHDRNEVLFYRLLNDHMTEMLPIVYTPTVGTAIQQYSHEYRKPRGLFLSVNDPEGMKTAFENLAAKRSRIDLIVATDAEGILGIGDWGVGGIAISIGKLAVYTAAAGIDPNRVLPVVIDAGTNQERLLNDPLYVGNQHSRIRGERYESFIDQYVQIATETFPGVLLHWEDFGTQNARQILKKYKDKICTFNDDIQGTGAVTLAAVLAAVKISKMPLKDHKVVIFGAGTAGIGNAEQIRAALVQEGVSEEESYRRFWCVDRNGLLTDDMNDLQDIQQPYARPADEVKDFSRNGPGDAIDLLEVVKRVQPTILIGTSTVSGAFTEEIVKEMAKHVKRPAIFPMSNPTPLSEARPEDLINWTEGRALVATGSPFAPVEYSGTRYAIGQANNAFVFPGLGLGTLVSKARLITDNMFYASAAAIAGMVDTGRPGAALLPEVEDLRTVSATVATAVIKAAIEDGVAENEPDDVIQAVQDAMWHPVYRPIRAI

SEQ ID NO: 5748 - protein, 135 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 5749 - protein, 416 aa, Myxococcus xanthus DK 1622
MAIFEFKLPDLGEGVMEGELVKWHVKAGDSVKEDQVLAEVMTDKATVTVPAPKAGRVVKTHGNEGDMAKVHQLLVTLEVEGAAPAQAGGHSEASAPAAAPVAGGHVGGAPASASKVLATPVTRRMAREHGLDLASIAGTGPQGRVTKADVVAALEGGEKNVVAAPAEQKARPAAPAVSSGAADERVPLRGLRKKIAEKMVRSKFTAPHFAFVEEVDATELVALRARLNAQLAAAGENIKLNYLPFIIKATVAALKKFPHLNANFDEASQELVVRGEFNIGMAAATPDGLTVAVVKSADRLTLAELARETARLGAAARDRKLKMEELTGGTFTISSLGQSGGLFATPIINHPEVGILGVHRLKKRPAVVGDQVVVRDMMNLSLSCDHRVIDGSVAADFTYEIIKYLEKPDLLFLAMA

SEQ ID NO: 5750 - protein, 183 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 5751 - protein, 746 aa, Zea mays
GNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 5752 - protein, 133 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 5753 - protein, 367 aa, Glycine max
LASENNSLNSVVNDATHRSKVTVIGSGNWGSVAAKLIASNTLRLSSFHDEVRMWVYEETLLSGEKLTDVINRTNENVKYLPGIKLGKNVVADPDLESAVKDSNMLVFVTPHQFMEGICKRLVGKIREDAEAISLVKGMEVKMEGPCMISSLISQQLGINCSVLMGANIANEIAVEKFSEATVGYRLNREVAERWVQLFYTHYFIVTAVRDVEGVELCGTLKNVVAIAAGFVDGLEMGNNTKAAIMRLGLREMKAFSKLLFPSVKDSTFFESCGVADLITTCLGGRNRKVAEAYARNGGKRSFDELEAEMLQGQKLQGVSTASEVYEVLSHRGWLELFPLFSTVHEISTGLLPPSAIVEYSEKLPRSF

SEQ ID NO: 5754 - protein, 262 aa, Francisella tularensis subsp. tularensis SCHU S4
MKPILNSVTTIARKAGKIILQAQNDLSSIKISQKLDNTTVSNIDIAVENFIIDNIKKSGFNDYFITEENGEFGNKDSRFTWIIDPIDGTNNFVHGLPHCCISIAAKKDDDIVLGVIYNPFLDLMFCAYKGQGALLNGKKIRVAQNQDLKNTLISASLKYSRRIFNDSYVAELIKLQQTISGYRYSGSIAMDMAYLAAGYIDGLWACGNVKIWDLAAGYIIMKEAGAVVTNIHGTSDLDSGLIVAGNKKIQPKLIKILAKHIK

SEQ ID NO: 5755 - protein, 567 aa, Streptococcus pneumoniae TIGR4
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVNKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 5756 - protein, 154 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLAAKNLYDLPP

SEQ ID NO: 5757 - protein, 347 aa, Streptococcus pneumoniae TIGR4
MADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGKIERIPMTPMRKVIAQRMVESYLTAPTFTLNYEVDMTEMLALRKKVLEPIMEATGKKTTVTDLLSLAVVKTLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 5758 - protein, 323 aa, Rhodopirellula baltica SH 1
MTNHPASYSYATEAITTPIAPVKLSDDGPVIWCKLEYHNPSGSTKDRIARFILGKAIRSGLLGRGDAVVEASSGSTSISLALMCAQFGLRFTAVMPRGVSSERIKMIRAFGAEVILTPAEEGVGGAMALADEIAGRGEAFASKQFENPDNPAAHRYQTAAEIIAQVPSRSVDAVVSGVGTGGTLVGLYQGFCDFGCITRPVLARPVCSDGLYELECSSFSKKIPGVVESASAIFRDAHLPGLRQVDVKDSVALACCRQLIRRGFPVGPSSGLNFAAALEAARDLPPDSTIVTVFPDRMERYFSTPLFSDSVEELECDPAQTCC

SEQ ID NO: 5759 - protein, 727 aa, Oryza sativa Indica Group
MGLSSAIEWWQESQLRILVIASTIIQLLLFLTANRRKHITYPRFRFIVWLAYLGSDAMAIYALATLFNRHKNEDSTEQGNSSILEVVWAPVLLIHLGGQDSITAYNIEDNELWRRNVVTMTCQITVSIYVFCKSWPGGDKKLLQAAIVLFVPGVLKCIEKPWALRSASINNLVSSDMHVPRTGKGDKKGDSISLQSYVERARNLVLRIEKEGNTVESLMEEAIDFFTSDSGDIFPHANDNISEPYKVFVDLPQPYSIRLAALKSWWKVEPDFLHMDLGKTLADTFYCLYTKAKMLNKQNINKFGWYLRLGSAYLPFASIGLFHNSHREAYNSCDVKVTYMLLCCTAVIEYSSAHGWSTLIDCCLPWNDNVSQSRLIGSYAGIIIKPCGLSKEITGLVLQHVKSGWISYITDGVTYREFNDHRGQWALRRNNCDQDLGWSLRVPFDESVLLWHLATEFCCARTGCTYEEGIIEISNYMMYLLLHNPEMLLAGTRRNIFTTAIQELKDILGEEKPLEYQGLAEKIIAKVESKGACCPSFIRDAWAIAEVLLNLGNKKMKHVIKGVWVEMLCFSASRCRGYLHAKSLGAGGELLTYVWLLLLSMGMEPLAERLQRADLPSGEGNDAITTDAPLPSDNTLEERPRKAEVPNNIDVAAQLPSDEILTEKPLKTEVPNREVNNINAAAHLSSDEILAERTLNTEVPNGEGNISDVPSTSQDSIAIDIEEDNAS

SEQ ID NO: 5760 - protein, 489 aa, Rhodopirellula baltica SH 1
MSTTLPEIAPPKVRHTQLFIDGQWRDSASGKTFATINPATEEEIVQVAEGDKEDIDAAVKAARKAFESGPWRTMDARDRGRLMMKLADAIENEIDELAQLETLDNGKPLRESRHADLPLVIDALRYYAGYADKIQGETVPIRGNYLCYTRKEPVGVVGQIIPWNFPMLMVAWKWGPALATGCTIVMKPAEQTPLTCLRMAQLAKEVGFPDGVINVVPGFGPTAGGALVDHPGVDKIAFTGEHRTAQLIMKNSAQSLKRLTFELGGKSPNVIFSDADLDAAVQGSFVGLYLNQGQCCCAGSRVFVEESIHEAFVEKLTDLTNKRVVGNPFEHTTEQGPQIDQAQFDKIMSYIDKGNQQGASCVSGGKRSGDRGYFIEPTVFTDVQDDMAIARDEIFGPVMSVLSFKDSDDILKRANDTMFGLAAAVWTQDIKKAHHFAANVRAGTVWVNCYDVFDAAAPFGGFKMSGQGRELGTEGLKAYLESKTVTVAL

SEQ ID NO: 5761 - protein, 788 aa, Zea mays
  misc_feature (329)..(329): Xaa can be any naturally occurring amino acid
  misc_feature (391)..(391): Xaa can be any naturally occurring amino acid
MLLILVFLLSFSSLDLQISGATTDTLTLGQSLPWNQTLVSKGGNFELGLFSPGNSKKHYIGIWFKKVSKQTVVWVANRDSPILDPSASRFTLSNRGELLLHATPSNTLLWSSNASSPSPRTTVATLQDDGNLVVRSNASSALVAWQSFDHPTDTWLPGARLGYDRARGVHSFLTSWTDADNPAPGAFSMEIDPRGQAKFDLLAGGTHQYWTTGVWDGEVFENVPEMRSGYFEGVTYAPNASVNFFSYKNRVPGIGNFVLETNGQMQRRQWSPEAGKWILFCSEPHDGCDVYGSCGPFGVCSNTSSAMCECPTAFAPRSREEWKLGNTAXRLPGGSAEAAGAPRSDKMCALSCLRDCSCTAYAYEAAKCLVWNGELVSLRTLPNDQGVAGGXVLHVRVAASEVPPSAAHHSWRKSMVILSSSVSAVVLLLAGLIIVVAVAVVVRKRRGKGKVTAVQGSLLLFDYQAVKAAARDFTEKLGSGSFGSVYKGTLPDTTPVAIKKLDGLRQGEKQFRAEVVTLGMIQHINLVRLRGFCSEGNKRALVYDYMPNGSLDAHLFKNSSGSKVLSWSQRFGIAVGVARGLSYLHEKCRECIIHCDIKPENILLDEEMGAKVADFGMAKLVGHDFSRVLTTMRGTMGYLAPEWLAGAPITAKADVYSFGLLLFELISGRRNNGSSETGSNSAVYFPVHAAVRLHAGDVVGLLDDKIAGDANVELERVCKVACWCIQDEEGDRPTMGLVVQQLEGVADVGLPPIPSRLHMLAMMNKCAVGGEAEVEPCSNSGSKIDTEV

SEQ ID NO: 5762 - protein, 399 aa, Bacillus anthracis str. A2012
  misc_feature (4)..(4): Xaa can be any naturally occurring amino acid
MRSXVTVKIKPKFIKEIKSGYPLILKDAIQNLNDVQEEGTIIKVVDEKNHFVGKGYYGKQNKGYGWILTRKESEQINQSFFESKIKSALHKRKQFYKSSDTTAFRALNGEGDGLGGLIIDYYDGYYVVSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEIDYEAQDIIVEDVFLYFKYAAKKKMKFDMVVLDPPSFARSKKYTFSAAKDYKNLLKETIAITENNGIIVASTNCSAFDMKKFKGFIDTAFKEMNGKYKVLEEHSLPEDFRTIDQFKEGDYLKVVFIEKIKG

SEQ ID NO: 5763 - protein, 334 aa, Xylaria polymorpha
TSIHWHGIRQKGSTDQDGVASITQCPVAPGDSTTYTWKATQYGTTWYHSHFSLQAWNGVFGGIIIRGPASAPYDEDKGMIVLSDWLHQTTDELYGIASTSGPPTANNGLINGLNVYSDGGSRFQTTFESGKSYRLRLVNTAIDTMFKFGIDNHTLTVIAADLVPIVPFDVQMVSIGIGQRYDVVVTADQTPGNYWMRSIPQLTCSANEMTLNIKGIVTYDDLAVADPTTDAYEYIDDCSDFPVESLVPSVSLDAGDATTQQVMEVGLSIVNSFFKWTLNSNTFLSDWGEPLEKVLTPGTVFSDAENIITLNETNTWTYLIIESQLGLHPFHLHG

SEQ ID NO: 5764 - protein, 596 aa, Bacillus anthracis str. A2012
  misc_feature (95)..(95): Xaa can be any naturally occurring amino acid
MVESLLLSIVIIITLGIASQWTAWRFQLPAIVVMAVAGLLIGPVFGIINPKEVLGDVFSPLVSLSVAIILFEGSLSLDIRELRGLSKPVFRIVTXGAFIAWIAGSLAAHYVAGLDWAVAFIIGGLFIVTGPTVIIPLLRQARLKPRTAAILKWEGIIVDPFGALLAVFAFQIVNFLTKENVQLHTLLYFFAGSLFAMVLGYIFSIFMSYMILKGKVPEYLKAPILLVTVLLCFGIADEVMHETGMLAVTVMGITLARMKKYISSIGDIRHFNENISVLLTSTVFIILTASLPRTTIMEIFSWPIISFVLMMLFVVRPLSIWISTIGTELTKAERALVGWIAPRGIVALTVSSYFATELLQEGYKDASILTALTFALVITTVCAHGFSIGFLAKRLGLANTEPPGILISGASTFSSAFALHCKEMGVPSLIVDVSEEHLQCAKVKGLNTYNGQVLSEQLQFEVDMNQYEYLIAVTDTDSYNVLVANTYVPQFGHHNTFLLPIHDVEKIEQERISLSKKAHLLFGQNEIYEELNRKIEDGYTFKTIQVAEEQKINKEEINSEDLILFIRHRDGSLTFSTLYKYIAVMPGDELVVLAKQ

SEQ ID NO: 5765 - protein, 150 aa, Arabidopsis thaliana
MLIIDESNASYDLLIWALENQKDTIESSKVYIFAKQPQNSFTPPTVLSSSVGFAQIFYPFSPNSELIRLAQEKNMKIALGILEKAKKICLNHGIKAETFTNVGDPKDLIRKIIQERNINLIVTSDQQSLKKCTQNTDCSLLVVKKRLRKD

SEQ ID NO: 5766 - protein, 461 aa, Pseudomonas putida KT2440
MTTESTAFATLPLSTAMLANLEALGYASMTPIQAQSLPVILKGQDLIAQAKTGSGKTAAFGIGLLNPINPRYFGCQALVLCPTRELADQVAKELRRLARAEDNIKILTLCGGVSLGPQIASLEHGAHIIVGTPGRIQQHLDKGTLVLDGLNTLVLDEADRMLDMGFFDAIASIIGKTPSRRQTLLFSATYPAGIKQLAADFMRNPQQVKVESLHTDNQIEQRFIEIDPQQRLEAVTRVLGHYRPQSCVAFCFTKQQCEDVVAHLTAKGIVAQALHGDLEQRDRDQVLTMFANRSSSVLVATDVAARGLDIDGLDMVINVELARDAEIHVHRVGRTGRAGEKGVAVSLVAPAEGHRAQAIEALQNSPLRWDQLDSLKNKGGEPLLPVMTTLCIAAGRKDKLRPGDILGALTGDAGIPGKQVGKIAIFDFQAFVAVERALAKQAMQRLNSGKIKGRALKVRII

SEQ ID NO: 5767 - protein, 160 aa, Oryza sativa
  misc_feature (31)..(31): Xaa can be any naturally occurring amino acid
  misc_feature (74)..(74): Xaa can be any naturally occurring amino acid
  misc_feature (133)..(133): Xaa can be any naturally occurring amino acid
ARGLVPNSARGVAGDNSVDILTNDIGVVVVXDSAREPVGFNIYVGGGMGRTHRLDTTFHRLADALGYAASEDLXVWYKSKRRHTEGRRTDRVTRLCITMKDLTDDRGIDKPASAIYKDYGKMVEHTRPLPGWXGNRLLRWLEQGDGKLFYGVHVDNGRVA

SEQ ID NO: 5768 - protein, 273 aa, Haemophilus influenzae R2846
MTAIAIGALNAAPAPLANTAGIIPATIAMVVIKIGRTRSEYGTYGEIVNMPVHAVVKHPENLTMEQAAASWMMFVTAYGGLIEFGKVQKGDFVVLGGATSSVGIAAIQIAKMQGANVIALSRTHAKGDVLLQKGADFVIATKEDDVTAKLLEITNGKGVNLVFDPLGDKEAAKIINAMTQDGKYIIYGALSHDDIAVPVFPILGKHLTVRGYELFEITTVPEKLAQAKKFVFDGLASGQLKPEIDKVFAFDEMAEAHRYMESNAQIGKILVKV

SEQ ID NO: 5769 - protein, 459 aa, Ralstonia eutropha JMP134
MSANSEHLQRGLGERHIRLMALGSAIGVGLFLGSANAIRMAGPAIMLAYLIGGAMIFLIMRALGEMAVHNPVAGSFCRYAQDHMGPLAGYLTGWNYWFLWLVTCVAEITAVAIYMGVWFPDVPRWIWALAALATMGSVNLLTVKAYGEFEFWFAMIKIVTIVLMLFGGGAMIVFGLGNGGIATGISNLWAHGGFMPNGASGVLMSLQMVMFAYLGVEMIGLTAGEAKNPRKSIPDAINSVFWRILIFYVGALFVILSLYPWNEIGAQGSPFVMTFERLGIKTAAGIINFVVLTAALSSCNGGIFSTGRMLYNLAQQGQAPAAFARVDRNGVPRRALLVSIGALLCGVLLNYLVPEKVFVWVTSISTFGAIWTWAIILVTQMQFRKNLSPAERDKLAFRMPFWPYGSWIALAFLALVIALMAYFPDTRIALYVGPAWLVLLTVLYYRLGMQARGPVTYQA

SEQ ID NO: 5770 - protein, 470 aa, Escherichia coli O157:H7 EDL933
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 5771 - protein, 418 aa, Oryza sativa Japonica Group
MMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 5772 - protein, 434 aa, Sinorhizobium meliloti
MAGHGRTFAVHHGEYWRMRDHIQKMQGEEQFSCGVVIVAAGRGERAGQSAEGPKQYRTIGDRPVIAHTLDIFATWPGAGPVVVVIHPDDEELFAAARKRMAGALELTVVHGGATRQLSVLAGLEAVAATGVEYVMIHDAVRPFFDHTLLDRCGAALRDGAQALLPAIAVADTLKRTKAAGLVAETVPRTDLYAAQTPQCFRLEPILSAHRRAAASGRSDFTDDASIAEWAGIPVLLVEGAVDNFKLTLRRDLSMADEKLTRMAIPDVRTGNGYDVHQLVDGDGVTLCGVFIPHGRKLSGHSDADVALHALTDALLATCGAGDIGDHFPPSDPQWKGAPSRIFLEHAARIVRERGGTVTNADISLIAEAPKVGPHRQQMRENLAAILGISLDRCSIKATTNEKLGFVGRNEGIAAIATATVVYASRSKPDVDDRY

SEQ ID NO: 5773 - protein, 338 aa, Moritella sp. PE36
MLIHKTLGEFIVENQSDFPHAKGDLTALLSSIKLAAKIVNREINKAGLVDIRGASGIENIQGEEQQKLDMYANEVFKNALIARGEVCGIASEEEDHYVFFDNENSRNANYVVLMDPLDGSSNIDVNVSVGTIFSIYRRISPVGGPVSMEDFLQVGRKQVAAGYVVYGSSTMLVYTTGNGVHGFTYDPSIGVFCLSHEAMTFPKSGKIYSINEGNYSKFPLGVKKYIKYCQEEDDTTNRPYTSRYIGSLVSDFHRNLLKGGIYIYPQTAQAPTGKLRLLYECNPMAFLAEQAGALATDGYTPILDLKPTELHQRVPFFTGSVDMMDTAHQFMKEYKEEA

SEQ ID NO: 5774 - protein, 313 aa, Oryza sativa Indica Group
MQASVAVSEALEAGKLSAAPRDGAADFAVAWLAVVVVSLAVAATCVVVSFDAHARQPGRLRRMLDLGPSVRGARLLLAIFAGLLAAAEVLRLPFFSRAVVSPPRHVVPCLAYPLVAHGVAEPCFLATVLLLLRASTGGARLPAAALAVPFACLPFLSAHVAVLVLPAAVAPYPGQLAHAADVDARCAYPAYAAALLVALAALYAPLLLSACWTVAAVAINRRMRARAYALAALVVVPLPVQVVALALSSVWETPRRTSPVAAFLGFLAVGIAAAAALTILVLLPVYDALFLGDDEQLPVAVAAAGEEARELDR

SEQ ID NO: 5775 - protein, 364 aa, Shewanella sp. MR-7
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGDFIADAVKAGV

SEQ ID NO: 5776 - protein, 414 aa, Galdieria sulphuraria
MAFLSTSCVNLVGSHRCYKDKTSQAICQRSFLKRRSFLCGSDSTGYSLFTSSFVSYHNRDLDLSSKTNANQRWVMQAKVRVAINGFGRIGRNFLRCWATRPSSHLDVVAINDTTGAKTAAHLLKYDSILGTFEKDVRAGEDCITVDGKEIKVVSNRDPLQLPWKDLNIDLVVEATGVFVDSKGAGKHLQAGAKKVLITAPGKGEDVGTFVIGVNEHSYDHQVHHIVSNASCTTNCLAPFIKVLHEEFGIVKGTMTTTHSYTGDQRLLDAAHRDLRRARSAALNIVPTTTGAAQAVALVIPELKGKLNGLALRVPTPNVSVVDMVCQVGRKTFKEEVNGAFLKASQGSLRGILRYSDEQLVSCDYRKTNESSIIDASLTMVLGDDLVKVVAWYDNEWGYSQRVVDLGELMASKWK

SEQ ID NO: 5777 - protein, 371 aa, Acidovorax sp. JS42
MKSRAAVAFKAGEPLQIVELDVAPPRKGEVLVKITHTGVCHTDAFTLSGDDPEGIFPAVLGHEGAGVVVEVGEGVTSVKPGDHVIPLYTAECGECLFCKSGKTNLCVAVRATQGKGVMPDGTTRFSYNGQPVYHYMGCSTFSEYTVVAEVSLAKVHPDANPEQVCLLGCGVTTGLGAVKNTAKVQPGDSVAVFGLGGIGLAVIQGARLAGAGRIIAIDTNPSKFDLARTFGATDCVNPKDFDKPIQQVIVEMTGWGVDHSFECIGNVNVMRAALECAHRGWGQSVIIGVAGAGQEISTRPFQLVTGRKWLGTAFGGVKGRSELPGMVEDAMAGKIELAPFVTHTMGLTDINQAFDLMHEGKSIRSVVNYAA

SEQ ID NO: 5778 - protein, 1104 aa, Coprinopsis cinerea okayama7#130
MAIHDTKARPAHPRRTIPKFGPYLLLQTLGEGEFGKVKLGLHCQWGEEVAVKLIRRGNVDSSVRMSKVEREIEVLRTLKHPNIVRLYDVIETDKYIGIILEYASGGELFDHILAHRHLRERDAAKLFSQLISGVWYIHQKKIVHRDLKLENLLLDRHRNVIITDFGFANRFEHRSDDLMQTSCGSPCYAAPELVISEGLYVGSAVDIWSCGVILYAMLAGYLPFDDDPANPDGDNINLLYRYIVNTPLSFPDFVSAEARDLLSLMLVPDPTRRANLDTVMRHPWLSAYHGTPRTDGVPNAFGKSVADLEKAAMEQHQQKRIAYQKQMKANAVLNNTSAPSPRSHSHRPEPTSAAPTSGRSRSVQPEFIYDSSVDQSISAPVPSANANATPKHNGTTPKAFDSPAALGLADDDPFAPPPGTKVNSGVATATSPSKQRPSEDSARTPAAGLSPTDNKTPSKGHRSSTSGGGRDIRHTIQVEYDEPKSAKRSDDKRRDRSGSQGQPSQASAQPNGVLPNVQNGQPATRERRPSHGGATKPLPPQPVAPSAYKPPPTPATPKGSSHQQPSATPVKAASGGDVPTVNVSSPPQTPSFHQLSHPKDKDKDASSQNSASSKRGHKKGKSSIDKIGLGKIFGSGNSAPAPPVPPLNGSEHNLQSPSAPSSRVPSESQGSASSLQAPQEPAPPKDGKKSRRNTLTVMVEPFIGTIRNRKGRPPTTPATAEPVPTAQTSVNATHPPVPSSATVPALPTAPHDADLTHPDIPVEDGPGLSASSNKAKKVMQWFRTKSKGRESVGIGLGGEAEHHDSLSTPITEQKYKKGFSASSSTVNQTSTPASAMSPQVVVTQAQQATTPKTPKVSAPGHPQRAASSATETPSFVARFRNSVTVGGGSHSHSSKHSNQPGGQLRIHQGAVDQTTITTRPPPEVMAKVKAVLEGMGVEIQLESEYKYRCIRHKKKKGATSAAGTAPNGAPANLAAVQVTGSAASNGVDRRGLPLPSPSAFSATGGMLRGLLMRRQSSQVSSSSQPSLAFDDETSVVVSEPLLMSDITYGDPSQDAGDEVRFSVELTRIDRLNDTYSLDIRRLKGNLRSYKYLYDTIRQRADLQR

SEQ ID NO: 5779 - protein, 310 aa, Bacillus licheniformis ATCC 14580
MRAVQNIAELIGETPLVKLNRVQPENAAQVYIKLESFNPSGSVKDRAAYQMILDAEEKGLLKPGSTIIEPTSGNTGIGLAMNAAARGYKAILVMPDTMTKERINLLKAYGAEVVLTPGDERMPGSIKKAQELARQIPGSFIPMQFDNEANPEAHRRSTALEIARAIEEIGKPLAAFVATAGTGGTITGTGEKLKALFPGITVHVAEPAGSPVLSGGKPGKHKLVGTSPGFIPNILNENVYDEILKIKDEEAYEMTRRLAREEGILVGPSSGAACFAAVETAKKLPPDKVVVCMTADTGERYLSSDLFQFD

SEQ ID NO: 5780 - protein, 141 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 5781 - protein, 486 aa, Myxococcus xanthus DK 1622
MGKPTGFIEWERVHADKRDKADRLGDWREFALPLAPDEAKRQAGRCMDCGVPFCHQGCPLGNLIPDFNEAVYRGRWREAYDLLSRTNGFPEMTGRLCPAPCEAACVLAIDRDPVTIEQMEKEIVERAFTEGWVKPRPPARRTGKTVGVVGSGPAGLAAAAQLNAAGHTVTVYERDARAGGLLRYGIPDFKLEKSVVDRRLALMEAEGITFVTGVDVGGALSYRELRAKHDALVLAMGARRPRELEVPGRELSGVVQAMEYLEHQNRLVSGHGQKDPRLDAAGRHVVVLGGGDTGSDCLGTALRQGAASVRQVELLPAPPPVRAEGNPWPRWPVIFRTSTSQEEGGERRFALMTKRLTGSDGRLQTLHAVEIEFQPGPGALPRLIERPGTEVTFETDLLVLAMGFTGPEAGNLSEELGVKLSPRGTVQVDARFATSADGVFCAGDASRGASLIVWALSDGREAAKACDAYLSGGRSALPTRGTDCAF

SEQ ID NO: 5782 - protein, 238 aa, Vibrio harveyi
GNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIA

SEQ ID NO: 5783 - protein, 152 aa, Triticum aestivum
SSGVSHLLERMAFKSTVNRTHLRLVREVEAIGGNVSASASREQMSYTYDALKSYTPEMVEVLIDSVRNPAFLDWEVKEQLQNIKSEIADASANPQGLLLEALHSVGYSGALAKPLMASESAVNRLDVSSLEEFVAEHYTAPRMVLAASGVDH

SEQ ID NO: 5784 - protein, 134 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5785 - protein, 399 aa, Bacillus thuringiensis serovar konkukian str. 97-27
MDTLIFEVGTALVLVAIAAVIAGKFKFSVIPFLIVLGMLVGPHAPTIGVIDFKFIESANVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRMEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 5786 - protein, 324 aa, Neisseria gonorrhoeae FA 1090
MDTLTRFLPEHLQQNQLPEALGGVLLSVVSACTEINAKVRLGALAGVLGMAGTGNIQGEDQKKLDVIANNIMIDTLKANPAVAGLASEEEDTFVSAGENGRYLVLFDPLDGSSNIDVNISVGTIFSILAKPEGALATESFLQTGRQQLAAGYVLYGPQTQLVFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 5787 - protein, 395 aa, Burkholderia xenovorans LB400
MRALCWHGKKDVRIDNVPDPMIEHPRDAIIKVSSCAICGSDLHLFDGFMPTMKSGDVLGHEFMGEVVEVGAENQKLKIGDRVVVPFTIACGECDRCRRGFFSVCERSNRNKEMADKVFGHSTAGLFGYSHLTGGYPGGQAEYVRVPFADFTPVRIPDGLTDEQVLFLGDIFPTGWQAAAQCEIEPTDTVSIWGAGPVGQFAIRSAILLGARQVISIDRVPERLAMARAAGAITINFDTESVLDRLNELTQGKGPEKCIDAVGMESHATRSFDALYDRAKQALMLETDRPHVLREMIYVCRPAGILSIPGVYGGLIDKIPFGAAMNKGLTFRMGQTHVNRWTDDLLRRIQEGQIDPSFVITHTVPLEQGPEMYRVFREKEDGCVKVVLKPSPSMGQ

SEQ ID NO: 5788 - protein, 170 aa, Yarrowia lipolytica CLIB122
HRLMSDYEVTLVNDSMQEFYVRFEGPEETPFQGGIWKIHVELPNEYPYKSPSIGFVNKIFHPNIDELSGSVCLDVINQTWSPMFDMVNIFEVFLPQLLRYPNPSDPLNGEASGMLMREPKQYEEKVKDYVTKYASNDSVSAEKDISDDDDLSSIGSFSDDDEEPAGELEV

SEQ ID NO: 5789 - protein, 1466 aa, Myxococcus xanthus DK 1622
MHHLLEETPMPPDMMAGTRRLLTCLLSALLMVGCEPSGALAKPETPHATRTQRVVVTAPPMRIAAGTQHSLYLSPGGDVWAWGGNGSGQLGGAETSLQGLAPVRLAALENIVSVVSGDAHSLALGADGSVWTWGGNSSGQLGDGTTTDRATPMRVAGLDSVVAVAAGDFHSLALREDGTVWAWGTNFHGQLGRGHTQPGLTPEQVPGLNGVVALAAGFDFTLAVLEDGTVRAWGSNGSGQLGDGTSTQRLSPVKVSELSGITEVRAGTYHALALGKDGGVWTWGSNASGQLGDGTWNDRAVPMQVPGLERVKAVASMDSDSLALLDTGAVFAWGANGSGQLGDGDTTDRATPGPVPGLNAVASVVGGAQHALVLRKDGTLWAWGGGLSGQLGHGGSERHVVPAPVMRLAGVTSMATGSFHSLAALGDGSVWAWGRNTYGQLGDGSTAERHAAVRVEGLGGVRSVASAAHHSLAVGMDGTVWAWGRNAAGQLGDGTTLDRARPVAVPGLTSVTAVAAGGSHVLALRSDGSVWAWGYNALGQLGDGTTVDRLTPVRVSGLGAVVAVAAGSYFSMALQSDGTVWTWGEGFEGQLGDGGGVQRLSPVRVEGLANITRVAAGSAHALAVRGDGTVWAWGDNGEGQLGDGSWADRFRPVQVPGLQGITAVSGGRSHSMALQGDGTVRAWGYNGYGQLGDGTLTSRVRPALIPGLTGIQALHPSHLHVLALHADGTLRGWGYNRFGQLGLGAAGWSAVPVQVRGIGRVDRLSVGRAHTLMVRADGTVMAWGENGSGQLGDGTSTHRTGPVSVPGVPCVRSVASGIQHSLALACDGTVWAWGANARGQLGDGTTTPRVTPGLVEGLRGVVALAAGGDASVALRADGSVWSWGGNASGQLGDGTLTDRALPAHVEHLSNAVAVAVGETHALAVGEDGALWAWGANGSGQLGDGGTAPSLTPVRVKGLERVASVAAGRAFSVAVRDDGTAWAWGTNPSGQLGDGTNHARSVPNQVTSLKGIRAMSAGAHHVVALSADGTVWTWGDNTLGQLGDGSSSPTGMWPRQVPELRGVEAVAAGEQFTVAVLLDGTARAWGSNEYGQLGDGKTGPQLTPMAVKIEGPKIRPPVRTVRAWGQHAVVQMSDGTVQTWGDNTFGQLGDGTTTRRAVPLTVYGLASVVAVSSGAWHSLALLSDGTVWAWGANGFGQLGDGTSTPRTRPVQVAGLGDVVAIGSGGYHALAVCSDGSVWTWGYNAFGQLGDGTAESRSLPTRVEGLEGVVAVAGGDHYSLALHSDGTLSAWGNNASGQLGDGTGTTRYSRVAVKGVDGVVDVRAGATHTVALRGDGTVWTWGDNAFGQLGDGASGTRMRLVPRPVPNLSSVSAVGAGARHTFAVALKGTVWTWGRNSHGQLGLGDNTNRTEPLRVRELSDVTVVSGGADFSLAMKRDGTVLSWGSSLYGSLGLGATGHRSSPGQVALP

SEQ ID NO: 5790 - protein, 501 aa, Clarkia modesta
MASPALISETEAWKDLKAHLEDIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFV

SEQ ID NO: 5791 - protein, 349 aa, Clostridium perfringens str. 13
MKAKLILENGVVFEGKAFGYLKECVGEVVFNTGMTGYQEVLTDPSYYGQIVTMTYPLIGNYGINLEDLESKEPKVRGFIVREKCQYPNNFRCELELETYLAQNKVLGLDGIDTRALTKILRNNGTMKGIIVLDNSNLEDVKDKLEAFSNRDAVSIVSTNEKYEISGEGKKVAIIDFGIKQNIIRNFVKRGCNVTVFPYDFKAEEVLEINPDLVFLSNGPGDPEDMGEAVNEIKKIVGKKPIVGICLGHQLLALTLGGETKKLKFGHRGCNHPVKDLINNRVHITSQNHGYYVATLPENMEITHVSMNDGTVEGMKHKELPIFSVQFHPEACPGPKDSEYIFDEFMKYAL

SEQ ID NO: 5792 - protein, 569 aa, Clarkia modesta
MATPSLISETEAWKDLKAHLEGIKRTHLRELMGDTERCQSMMVEFDNIFLDYSRQQASPDTINKLYKLADAAHLKQKIDRMYNGDNINSTENRSVLHVALRAPRNSAICSDGKNVVPDVWNVLDKIKDFAERVRNGSWVGATGKELKNVIAIGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGANSIDQYFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 5793 - protein, 387 aa, Pseudomonas putida KT2440
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVAVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAESAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 5794 - protein, 494 aa, Geobacillus stearothermophilus
SSIAAPKLKEKVEKFLSGKKKMYINGSFVESASGKTFDTPNPATGERLATVYEGDAEDIDRAVKAAREAFDRGPWSRMSAAERSRLMYKLADLMEENKEELAQLETLDNGKPIRETINADVPLAIEHMRYYAGWSTKIVGQTIPVNGPYFNYTRHEPVGVVGQIIPWNFPLLMAMWKLGAALATGCTVVLKPAEQTPLSALYLAELIEEAGFPAGVVNIVPGFGETAGDALVKHPQVDKIAFTGSTEVGKLIMANASKSLKRVTLELGGKSPNIILPDADFSKAIPGALNGVMFNQGQVCCAGSRVFIQKKQYDNVVADMVSHAKSIKQGFGLKADTEMGPLVSSEQQNRVLGYIEKGLEEGAELLTGGQKPSEQGYFVEPTIFANVEDSMTISKEEIFGPVIAALPYEDIDELIERANDTNYGLAAGVWTRDVTKAHYIANKLRAGTVWVNCYNVFDAASPFGGYKESGIGREMGSYALDNYTEVKSVWIAQN

SEQ ID NO: 5795 - protein, 352 aa, Pseudomonas putida KT2440
MPHRPYKVALNGYGRIGRCVLRALFERGAKAGFEIVALNDLADQASLEYLTRFDSTHGRFPGEVKVDGDCLHINGDCVKVMRSATPEGIDWAALGIDLVLECSGAYNTRADGQRFLEAGAPRVLFSQPMASEADVDATVVYGINQACLTGSERLVSNASCTTNCGVPLLRVLDQAFGIEYVQITTIHSAMNDQPVIDAYHHEDLRRTRSAFQSVIPVSTGLARGIERLLPELAGRIQAKAVRVPTVNVSCLDITLQTARDTSAAEVNRVLREAALEGPLKGLLAYTELPHASCDFNHDPHSAIVDASQTRVSGPRLVNLLAWFDNEWGFANRMLDVAEHFLHVVHPTRTKQP

SEQ ID NO: 5796 - protein, 181 aa, Oryza sativa Japonica Group
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 5797 - protein, 837 aa, Oryza sativa Indica Group
MPPPLYVLLLLSGLLLSSLHTPPCSAAIADGDTLMVGQALSVGEKLVSRNGKFALGFFQPQPTAGISKSINTTTNTLPGWYLGIWFNKIQVFTTAWVANRENPITGPELKQAQLKISRDGNLAIVLNNNNTSSESIIWSSTHTIVNRTTGSSSTNTSALLMNNGNLLLMASSNVVLWQSFDYPADVGLPGAKLGRNKITGLNRRFVAKKSLIDMGLGSYILEMDTNTVLRLRRRKPPVVVYWSWSSGQLAYTLVPLLNELLDMDPRTKGLLKPAYVHNNEEEYFTYTSLDESASVFVSIDITGQVKLNVWSQPKMSWQTIYAEPSDPCSLHDVCGPFTVCNGNSVPFCGCMESFSPKSPQDWDAGDPIGGCIRDTPLDCASGKQNNTSSTDMFHPIAPVTLPLYPQSMEDASTQSDCEEACLHDCACTAYTYNGNRCSIWHGELRSVNQNDGIDNHSENVLYLRLAARDSQSLRKNNKRRPRVVAIVSIVVSFGFLMLMLLLTIWINKSKWCGVPLYGSQVNDGGIIAFRYTGLVRATKCFSEKQGGGGFGSVFKGMLGDQTAIAVKRLDGARQGEKQFRAEVSSIGMIQHINLVKLIGFCCEGDKRLLVYERMLNGSLDAHLFQSNATVLNWSTRYQIAIGVARGLCYLHQSCRECIIHCDIKPENILLNESFVPKIADFGMAAIVGRDFSRVLTTFRGTVGYLAPEWLSGVAITPKVDVYSFGMVLLEIISGRRNSPEVSASNSYHGAYFPERAINKLHVGDVRSLMDPRLHDDFSLEEAERVCKVACWCIQEIESDRPTMGEVVRAIEGLHELDMPPMPRLLAAIIEHSDVASI

SEQ ID NO: 5798 - protein, 693 aa, Aspergillus nidulans FGSC A4
MGLGNIIYFAFHPSELRSIIQWKVWHNPVHERNEKNETETQKACFKFLDLTSRSFSAVIKELHPELLLPVCVFYLALRGLDTIEDDTSIPLETKEPLLRNFKDFLEQDGWTFDGNRPEEKDRELLVQFHNVVTEFRNMKPAYQVIIKDITDKMGNGMADYARKATFEDASVKTVEEYDLYCYYVAGLVGEGLTRLFVEAEFGNPALLKRTRLHKSMGLFLQKTNIIRDIREDEDDGRRFWPKSIWSKHVDNFEDLFKPENREAALNCNSEMVLNALEHVEDCLFYLAGLREQSVFNFCAIPQAMAIATLELCFRNYTMFERNIKITKGDACQLMTESTQNLRVLCDVFRRYVRRIHKKNTPKDPNFLKISIVCGKIEKFIETIFPSQDADAAKRRVEGTLSEAEAEKARQDAETRKDVLFMMGLMGVMALIVTAIMALVFVESDWQGLQIALLALQAFLYIDPGFRKSIYLFPDSYRQLQFLSFRTHHSPENNLMDQQSQSESLPNMEPLSPADFRIYNRLAEQMENIHNGFRATWAELKTACDPPPSQSQFPTPSALAAGNPDSTDSEIILLGLSFCSGLSSHHSIEERYIFPLLAERMPEFAAGGVLTEQHEVIHDGLTRLGAYLRSCERKLDDDEDGWRLDRGVLRRLLEGEDGKFESVIWEHLDQEVELLRPESLRRMWGVEDVRRFAI

SEQ ID NO: 5799 - protein, 291 aa, Clostridium tetani E88
MNNGMYYNKIIRKKQMGDIMEKFTRNQRISAITKILIENPNKIVNLNKFTEMFNAAKSTISEDLIAIKDVLNKLSLGKIETVSGAAGGVKYICGISEEESLKFAEELCIILKDRERIIPGNFLYVTDLVFNPQIIQRAGLILATEFNAMDIDYVVTVETKGVSLAYEVARMLGVQLVVVRRENKVTEGSTVSINYVSGSTNRIQNMSLPKRAIKSGSKCIFIDDFMKAGGTALGIINLLKEFDSELLGMGVLVDNVGIDKKLVSEYISIIEFDGLDQDNNSIIYPSKKFKI

SEQ ID NO: 5800 - protein, 382 aa, Bacillus subtilis subsp. subtilis
MIYLDYAATTPICEEALTVYQKLSMDMYGNASSLHDAGGKAKHILEYCREKIANIIGGEASGIYFTSGGTESNFLAIQSLLNGLPKTKRHFITTAMEHQSIHNCAAFLEQQGYDVTVIEPNEYGLITEEILLTHIRPETGLVSIQHANSETGIIQPIQHLSSYLHNKGILLHCDAVQTFGKIPINTKNLGVDALSMSSHKIHGPKGVGAVYIRPDVPWKPVYPLTTHEYGFRAGTVNVPGIGAFTAAAELIVSEMEKQISRNEALRTYFLDQIRIRSLPVTLAADTSKAECLPHIIGCFFHSFEGQYVMLECNRSNICISTGSACSAGYHGPSETMKALRKTEQEALQFIRISFGRHTTAEQLEQLLHTFTVLWEQKKGEFD

SEQ ID NO: 5801 - protein, 506 aa, Pseudomonas putida GB-1
MIYAQPGTPGAVVSFKPRYGNFINGEFVPPLAGQYFTNSSPVNGQPIAEFPRSTAQDIDRALDAAHAAAQAWGKTSVQDRALMLLKIADRIEQNLEVLAVTESWDNGKAVRETLNADVPLAADHFRYFAGCIRAQEGGAAEINEGTVAYHIHEPLGVVGQIIPWNFPLLMAAWKLAPALAAGNCVVLKPAEQTPLSITIFAELIADLLPAGVLNIVQGFGREAGEALATSKRIAKIAFTGSTPVGSHIMKCAAENIIPSTVELGGKSPNIFFEDIMQAEPAFIEKAAEGLVLAFFNQGEVCTCPSRALIQESIYEPFMAEVMKKIAKITRGNPLDTETMVGAQASEQQYDKILSYLQVAKEEGAQLLTGGSAERLQGDLASGYYIQPTLLKGNNTMRVFQEEIFGPVVGVTTFKDEAEALAIANDTEFGLGAGLWTRDINRAYRMGRGIKAGRVWTNCYHLYPAHAAFGGYKKSGVGRETHKMMLDHYQQTKNLLVSYDINPLGFF

SEQ ID NO: 5802 - protein, 320 aa, Clostridium tetani E88
MVMIHERKSLKIFAGNSNDKLAKDIADIVGVPLGSAEVGRFSDGEITVNINETVRGIDAFIIQSTSAPVNDNLMELLIMIDAFKRASAGRITAVIPYYGYARQDRKTKARDPITAKLVADILTAAGADRVLTMDLHASQIQGYFDIPLDHLLGVPILGKYFAENGFDQREDVVVVSPDLGSVTRARKFADRIHAPIAIIDKRRPKPNVSEVMHIIGDIKDKTCILIDDMIDTAGTITNGANALVERGAKDVYACCTHAVLSGPAMERIDNSVIKELITLNTIDISKIKPSDKIKVLSVAPVFAEAIRRIYEEISVSKLFD

SEQ ID NO: 5803 - protein, 537 aa, Dechloromonas aromatica RCB
MSYQVLARKWRPRNFSTLVGQEHVVRALTHALSEQRLHHAYLFTGTRGVGKTTLARILAKSLNCETGITATPCGTCSACQEIDSGRFVDLLEVDAATNTRVDEMRQLLENAVYAPTRGRFKVYVIDEVHMLSNSAFNAMLKTLEEPPEHVKFILATTDPQKIPVTVLSRCLQFNLKQMPVLAITGHLGHILQAEGIPFDQPALALVARSAAGSMRDALSLLDQAIAHGAGRVEEAQVRSMLGTVDQDYLFTILEALHGAEPSALLQVAADLGIRSLSFSAALQELGALLTRLQIAQCVPGAIDDDEPERDRLKGLAAALSPEFVQLAYQIVNAGRNELAAAPDEYAGFVMTLLRLYTFRPSTVADVVGAAVPRVNAAGAMPKAVRATPATQSRGDSIPEPVIIPKLPPIASGEMDWHQIVASLSLSGLARELAQNCELRQLSENQCLLRLSPAQGHLQMRPNPDRLQQALSDFFGRPLQVRIELAQNENVTPAETVGRQRQEQQERAATAIAQDTFVRDVIESFDASLVESSIKPIA

SEQ ID NO: 5804 - protein, 498 aa, Chromobacterium violaceum ATCC 12472
MTTVQASFSATGTPRRDSAVWQAIEWLVDSGSFYQLDALSEHDCQHFGTAGRKVPGDGLVTGHGRIDGRPVLVYAHDRDFLGGSSSRVHAVRIGKLLDMALQLGLPVIGLNDSSGIRIHEGVDAGAQFSEVFHKTVKASGVVPQISVILGDCAGGAAYAPALTDFIVMAGAESTMFLTGPSVIRSATGESVTKEEIGGAQLHAEVTGLAHFNCDGREQAVALVRELLGYLPQNNASPTPRVDRGDTGPRRTPRLERLIPAHQNEPYDVLDVVAEIADNNEFLEIQAQYAPNLVTGFARFGGRTVGVLASQPLQRAGCLDVDSSLKGARFVRLCDSFDIPLLTLLDVPGYLPGREQETRGIIGAGAKLLHAYCEASVPKLAIVLRKAYGGAYPTLANWSATDFTFALEQAEIAVMGPQGAVDIIFRRELAAAADPASLREKLLDDYRAAHANASYSAKKGYVDGLLAAAEVRNAVLSHLQLLADKVGGTPARRHSNIPL

SEQ ID NO: 5805 - protein, 142 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 5806 - protein, 577 aa, Streptococcus pneumoniae TIGR4
MTEMLKGIAASDGVAVAKAYLLVQPDLSFETITVEDTNAEEARLDAALQASQDELSVIREKAVGTLGEEAAQVFDAHLMVLADPEMISQIKETIRAKKVNAEAGLKEVTDMFITIFEGMEDNPYMQERAADIRDVTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKELPYFDMPHEMNPFLGFRALRISISETGDAMFRTQIRALLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 5807 - protein, 468 aa, Geobacter sulfurreducens PCA
MSDKHDLIILGSGSTAFAAALRAHSRGARVLMVEKSVLGGTCINWGCVPSKTLIHGALFYQEGRLGARLGLGECGNAVDLAPLMTRKEEVVKHLRTTRYLDILRNTPGLELAKGTGRFLGSGRLEVVDQVYRCDRYLVAVGGTPRIPKIPGLESTPFLTSRGALLLKRFPASLIIIGGGVIAVELGQMFQRLGTRVTILEHGPRILAPIEPEPALAIRNVLRDEGMEIICHSPVCAVSGDGSAVSVEVEREDGRRTYTAEKLLLAVGTTPATRGIGLELAGVETDGRGFVTVDERMRTTAPGIWAAGDCTGGMMIATVGAREGIIAVDDMFATGCGCAMDHLSVPMAIFTDPEVGAVGYTEQGARDAGLDPIVSILPVSAIPKAHVTGHTAGVIKLVAERATGRLLGAHLACHRGAELINEAALAIRLKATFEDLANALHVYPSIGEGLRLCAQGFTRDVSKLSCCAE

SEQ ID NO: 5808 - protein, 131 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 5809 - protein, 572 aa, Prochlorococcus marinus str. NATL1A
MLRLEKISKIYPTGEVLKDVSWEIRNGERIGLVGVNGAGKSTQLKIIAGLEEATDGSLISEGDPSIAYLKQEFDVDLSRTVREELFAAFKEASDLLHSQKLVQEKMESELASKDLDYLDLLIKELSVIQSKFESINGYDLESKVEKLLPTIGFNQNEADRLVGDFSGGWQMRIALGKILLQSPDLLLLDEPTNHLDLETIEWLENYLLNQKIAMVIVSHDRSFLDKICTRIVNTERGKSKSYLGNYTSYLQQRDFELESTKVAYEKQQKDIQVQKAYIERFRASATRSTQAKSREKLLDKVEKIEAPENNLKGPNFKFLEAPRAGRDILNIKDLTHSYEDNILFLGAFLELEPGERIAFLGPNGSGKSTLLRLIMGLEEPDEGSITIGKYNIIPSYFEQNQAEALELEKTVIETISQSVPDWTQTEIRSLLGSFGLTNDSVFKEVSQISGGEKARLALALMIIKPSNLLILDEPTNHLDIPSKQMLEQALSNYNGTALIVSHDRYFISKVANKIVEIRDGQLIKYQGDYKYYKEKKIEESQEKEKELQLAERERKRLANREKQRRKKKTKQK

SEQ ID NO: 5810 - protein, 392 aa, Zea mays
MSDNLMDKVSAFGERLKITGTEVSKKMTAGMSSMSFKMKELFQGQTPADKIVEGATSEDLDGPDWNSNLEICDMINTEKVDSVELIRGIKKRIMLKDARVQYLSLVLLETIVKNCDKAFSEVAAERVLDEMVRLIDDPQTVVNNRNKALMLIEAWGESGDELRYLPVYEETYKSLKSRGVRFPGRDNESLAPIFTPARSVAEADVDASLPQQVFEDVHVHTYTAEETKEAFDVARNSVELLSTVLSSSPEQDALQDDLTTTLVQQCYQSQHTIQMIIETVGDNEAVLFEALSVNDEIQKVLSKYEEMKQPRASEHAEHVPVVIPIAAEHEDLNAVGNEDALVRKPAAARATSGGDDDILDDLDEMIFGKKGGSSSQEGPKKPDPKKDDLISF

SEQ ID NO: 5811 - protein, 395 aa, Vibrio vulnificus CMCP6
MFSQLPTPALDPILSLTVAFRNDPRDQKVDLGIGVYKNNKGETPIMRAVSQAQKIVADTQTTKSYVGLAGCEEFNQSMVNLLLAGTSVLDRVSAIQTPGASGALRMLGDLMKVAQPDTTVWISNPSYVNHKPVMEAAGLKVRYYRYFSPETKQVDIGQMLDDLATAGPKDVVLLHGCCHNPTGADIDFAAWQAITDLAVKNGFTPFVDIAYQGFGDGLEEDAKGLQFMADRVEEMLITTSCSKNFGLYRERTGAAIVIGKNAKESSNAKGKLLTLARSTYTMPPDHGAALVKTILQNVELTTTWKQELCEMQQRLLNLRQTLCNELRNQHNTSQFDFIESHKGMFTVLGFTPEQMGTLRDEYGIYGVGDGRINIAGLTEAHIPYVADAIVKVSQR

SEQ ID NO: 5812 - protein, 365 aa, Thiobacillus denitrificans ATCC 25259
MKDQAGTRPDVSAELGALRARIDSIDDTLLALISERAALAQQVGHAKQGERIYRPEREAQIVRRLRESNPGPLSGETVERLIREIMSACRAVEEVTRVAYLGPAGTFSEQAVHKQFGHEVDALAEADIDACFHAVETGRADFAVVPVENSTDGAVGRTLDLVVASPLSICGEVMLPIHQTLMRKHGDLDGIRRVYGHAQSLAQCQHWLSRHLPDAERVSVVSNSEGARRAAAEPVAATLGSEAAAALYGLSVVAARVEDEASNTTRFLVLGAHDAAPSGRDKTSLVMGAKNQPGAVVKLLQPLADAGVSMSKFESRPARSGTWEYLFFVVCEGHRKDARLAAALAEIDSRAAFLKILGSYPAASA

SEQ ID NO: 5813 - protein, 172 aa, Mycobacterium tuberculosis
MGSSHHHHHHMQFDVTIEIPKGQRNKYEVDHETGRVRLDRYLYTPMAYPTDYGFIEDTLGDDGDPLDALVLLPQPVFPGVLVAARPVGMFRMVDEHGGDDKVLCVPAGDPRWDHVQDIGDVPAFELDAIKHFFVHYKDLEPGKFVKAADWVDRAEAEAEVQRSVERFKAGTH

SEQ ID NO: 5814 - protein, 339 aa, Zea mays
MSSESDSLASRRSKKPKYSKFTQQELPACKPMLTPGIVIGAFSLIGVFFVPIGLASLSASHNIVEVIDRYDAECVSANDKVGFIQDTKTDKACTRKITVPKPMKGPIHIYYQLENFYQNHRRYVKSRNDMQLRNKGDASTIANCEPEATSEDGGKPIVPCGLIAWSLFNDTYSFSLNSKAVQVNKKNIAWDSDKIKKFGSDVYPSNFQKGGLIGGAKLDEKIPLSEQEDLIVWMRTAALPTFRKLYGRIEADAMASDEITVVIQNNYNTYSFGGTKALVLSTTSWIGGRNNFIGVAYVAIGGVCLFLALAFVILYVIKPRALGDPSYLSWNRENPDHPN

SEQ ID NO: 5815 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 5816 - protein, 527 aa, Ralstonia eutropha JMP134
MPAQAADLATEYRDVHAPDVADQNSYLRRILNARVYDVARETELELARNLSARTGNAIWLKREDNQPVFSFKIRGAYNKMANLDAQALQRGVITASAGNHAQGVALSARHLGVRAVIVVPTTAPQVKVDAVRAHGGPTVEVVQAGASYTDAWRHAMHLQQQLGLTFIPAFDDPDVIAGQGTVGAEILARHRGPLDAIFVPVGGGSLAAGIATYVKAVRPEIRVIGVQTQDSCAMAQSLRAGRRVELGDVGLFSDGTAVKLVGEETFRLCRAYLDDVMTVSTDAVCAAIKDVFEDTRSVLEPAGALAVAAAKQYAQQHGLQGRTLVAVTSGANVNFERMRFVAERAEIGDAREAVFAVTMPEARGTFLRFCDLAGSRSITEFSYRIADAQTAHVFVGMRVRDRTEAAQIAGTFSAQGFATVNLTGDELAKQHLRHMVGGRSVLAGGERLFRFAFPERPGALMTFLRALPADWNISLFHYRNDGGDAASVLVGIQMPEAAAQRSDAVLAALGYPYWEESANPAYRLFLA

SEQ ID NO: 5817 - protein, 326 aa, Zea mays
  misc_feature (172)..(172): Xaa can be any naturally occurring amino acid
  misc_feature (189)..(189): Xaa can be any naturally occurring amino acid
LEACVWLEETLKKFDRILVVISHSQDFLNGTRSELEENQMKQFRWEQEQIASMKEYIARFGHGSAKLARQAQSKEKTLAKMERGGLTEKVVRDKILVFRFTNVGKLPPPVLQFVEVTFGYTPDNLLYKKLDFGVDLDSRIALVGPNGAGKSTLLKLMTGELVPLDGMVRRHXHLRIAQFHQHLAEKLDXDMSALQYMMKEYPGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKACLSD

SEQ ID NO: 5818 - protein, 318 aa, Carica papaya
MENFPVIDLSKLNGEERALTMELIHDACENWGFFELVNHGISHDLMDTVERLTKEHYMKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVSNYPPCPKPDLIKGLRAHTDAGGIILLFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 5819 - protein, 502 aa, Atriplex hortensis
MAFPIPARQLFIDGEWREPLLKNRIPIINPSTEEIIGDIPAATAEDVEVAVVAARKAFKRNKGRDWAALWSHRAKYLRAIAAKITEKKDHFVKLETLDSGKPRDEAVLDIDDVATCFEYFEYFAGQAEALDAKQKAPVTLPMERFKSHVLRQPIGVVGLISPWNYPLLMDTWKIAPALAAGCTTVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 5820 - protein, 452 aa, Methanococcus voltae
MSMLNLSKEEFKNKFKNGEITVAVYGQGKMGLPLANVFSEAGVNVIGVDICEEVVQNLNKGINHITEEPFLSELVAKNVKNGTYTATTDGKLAAEKADIMIILVPTLTDEKGNIKLEPVYNVAEIIASGLKEGNIVITEATMPPSTTESLIPILEKNGLKLNDGDFGLAHAPERTMTGTALRDIKGQYPKIIGANDSKTLEILSGMYETINSAGIVPISSIKGAEAVKVFEGVYRDVNIGLANELALWCEEHDVEALEVFESANTQPYCHIHTPGAGVGGHCIPVYPWFVINSSKEFNPRITKTARELNDYMAHHMVELTIKGLNSFEKSLKNAKILVLGLTFRGGVKEFMKSAAIPIISELNSWDADVYTFDPLCNEEDAERFGAKWTELEAHMWDAVIITSDHAEFKNMNLGDLKNNMSVPLIVDGRNIIDPVVAREKGFKYLSAGNFKL

SEQ ID NO: 5821 - protein, 411 aa, Pseudomonas putida KT2440
MLELVAAFICLTTLLTYVNYRFIGLPPAIGVMVTALLFSLILQGLSLVGFPGLEERVEGLMNQIDFNDLLMHWMLAFLLFAGALHVNLSDLRSYRWPIGLLATLGVLIATVVIGYLAHWVFALFGWQVPLIYCLLFGALISPTDPIAVLGALRTANAPKPLKTTIVGESLFNDGTAVVVFTVLLGIIQLGETPSMADTAILFAREAIGGVVFGGLIGYATYRMIKSVEQYQVEVMLTLALVIGGSAMCYELHVSAPIAMVVAGLIIGNLGRNLAMNDMTRRYMDGFWELIDDMLNALLFALIGLELLLLPFNWMHLAAGGVLALAVLLSRLLTVAPAIVLLRRWRPVPKGTVRVLTWGGLRGGVSVALALSLPLGEERDLLLSITYIVVLSSILVQGLSIGRVVRKVSAQP

SEQ ID NO: 5822 - protein, 464 aa, Listeria monocytogenes EGD-e
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 5823 - protein, 164 aa, Triticum aestivum
HGENSQQDPRATESRSIAALANGLAHAHADVASPSSLRQPFVIGVSGGTASGKTTVCDMIIQQLHDHRVVLVNQDSFYRGLTAEESARAQDYNFDHPDAFDTEQLLECMGQLKRALPVNVPIYDFKNHRRCSERFRKVNASDVIILEGILVFHDQRVRNLMDMK

SEQ ID NO: 5824 - protein, 361 aa, Zea mays
  misc_feature (202)..(202): Xaa can be any naturally occurring amino acid
MGSTAADMAASADEEACMYALQLVSSSILPMTLKNAIELGLLETLVAAGGKLMTPAEVAAKLPSTANPAAADMVDRMLRLLASYNVVSCTMEEGKDGRLSRRYGAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIXVDVGGGVGATVAAITAHYPTIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFAAMKTTYIYANAWAIEFTK

SEQ ID NO: 5825 - protein, 363 aa, Roseovarius nubinhibens ISM
MSLRPDISETLARARADLRMGVPIALIGEAGSALALAVESASDARLADLRALEGTIGVAITARRAETIKARAYDGDIARICLPKRADMVWLQALADPADDLATPMKGPFHTLREGSADLHRLAVALTKSARILPAAIVIETEHAARLAAENFLTVVPASDAILRMTQASAMDPVASARLPMEVSTAGRLHVFRPEDGSEEHYAVEIGRPDRDKPVLARLHSACFTGDVIGSLKCDCGPQLRGALAQMGSEGAGVLLYLNQEGRGIGLANKMRAYALQDQGFDTVEANHRLGFEDDERDFRIGSSILRQLGFSSVRLMTNNPGKIEMMEQMGITVAERVPLKLGENDHNRAYLATKAQKSRHML

SEQ ID NO: 5826 - protein, 626 aa, Pseudomonas putida KT2440
MSFASLGLSEALVRAIEAAGYTQPTPVQQRAIPAVLQGRDLMVAAQTGTGKTGGFALPILERLFPAGHPDKSQRHGPRQPRVLVLTPTRELAAQVHDSFKVYARDLPLVSACIFGGVGMNPQIQAIAKGVDVLVACPGRLLDLAGQGKVDLAHVEILVLDEADRMLDMGFIHDVKKVLARLPAKRQNLLFSATFSKDITDLADKLLHNPERIEVTPPNTTVERIEQRVYRLPASHKRALLAHLITLGAWEQVLVFTRTKHGANRLAEYLEKQGLTAAAIHGNKSQNARTKALADFKANSVRVLVATDIAARGLDIDQLPHVVNFELPNVEEDYVHRIGRTGRAGRSGEAISLVAPDEEKLLKSIERVTKQRIADGDLMGFDASQVEAEKPEARERPQNNGRGGRNQQARGEGGKDTNGGRKDKGKDKGKARQQAAAKPDDKEKSGDKQQPRKPRDKKSRPQQASNNSVPKPPADRDPEEFLDDELDNFGNRADYVSPYQGKNQGRNRRPGGAGQGQGQGNGQRSNAGGQGQARNGGQPRSGGGEKRPPRANNGGGARRDGGGGRGRPARDDAARQEPAVRNPRQPEKQPVIIRKESKLDRFPTPEQLDDLPSRPRGERPALLTRKG

SEQ ID NO: 5827 - protein, 167 aa, Klebsiella pneumoniae subsp. pneumoniae MGH 78578
MAHIEKQAGELQEKLIAVNRVSKTVKGGRIFSFTALTVVGDGNGRVGFGYGKAREVPAAIQKAMEKARRNMINVALNHGTLQHPVKGTHTGSRVFMQPASEGTGIIAGGAMRAVLEVAGVRNVLAKAYGSTNPINVVRATIDGLENMKSPDMVAAKRGKSVEEILGK

SEQ ID NO: 5828 - protein, 352 aa, Bacillus subtilis subsp. spizizenii
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRLEGQKTAAFEVCEQLGEAPDVLAIPVGNAGNISAYWKGFKEYHEKNGTSLPKMRGFEAEGSAAIVRNEVIENPETIATAIRIGNPASWDKAVKAAEESNGKIDEVTDDEILHAYQLIAREEGVFAEPGSCASIAGVLKQVKSGEIPKGSKVVAVLTGNGLKDPNTAVDISEIKPVTLPTNEDSILEYVKGAARV

SEQ ID NO: 5829 - protein, 103 aa, Zea mays
  misc_feature (52)..(52): Xaa can be any naturally occurring amino acid
RKAMEAQTIITEELRRFEAWRDSLETVPTIKKLRSYADRIRASELEKCLQKXHLRCDGSDSRTLDETLENMHALNRMFSLDMEKAIIEQKIKAKLRRPEAPGV

SEQ ID NO: 5830 - protein, 384 aa, Arabidopsis thaliana
MAAQLATPEAMAFIVRHGTGIVCVSMKEDDLERLHLPLMVNQKENEEKLSTAFTVTVDAKHGTTTGVSARDRATTILSLASRDSKPEDFNRPGHIFPLKYREGGVLKRAGHTEASVDLTVLAGLDPVGVLCEIVDDDGSMARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 5831 - protein, 446 aa, Idiomarina loihiensis L2TR
MTFTVAKFGGTSVADYASMLRCAEIIQSNSSIRLVVVSACAGVTNRLVAIADLQGRQIEKLLNEIYEIHFAIQKRLKNASQVQKSLEQLHHKLALHCQKTTEDQASWRDELLSFGERCSSLLFSSLLVEQGLCSSTLDARQLLKTNSDFGRAQPDEVTTKSHCLEQKQKLESGCVRVTQGFIGSDENNQTTTLGRGGSDYSAALLAAGFNATDLQIWTDVAGIYTTDPRICPSARAIAEMSFSEAAELATFGAKILHPSSLAPAIKNDIRVFIGNSQDALSGGTYISASPTSRPDVRAIALRRDQTLVTVHSLNMLHASGFLARLFEILARYNVSVDLVTTSEVSIALTLDEGGSAANGQALLPAAALEELEQFCRVEVETGLSLVAIIGNGIGRDAHISQLTFNTVNDYAVRLICQGASEHNLCFLVADNEGENVIRTLHDRILR

SEQ ID NO: 5832 - protein, 251 aa, Zea mays
  misc_feature (225)..(225): Xaa can be any naturally occurring amino acid
  misc_feature (233)..(233): Xaa can be any naturally occurring amino acid
  misc_feature (249)..(249): Xaa can be any naturally occurring amino acid
VRLQVPVRNSRVDPRVRFDTRAPMAAQGMVETRVFLQYLPAIRALWEDSGIQNAYDRRREFQLGESVKYFLDNLDKLGVPDYIPSQQDILLARRPTKGIHEYDFEIKNVPFKMVDVGGQRSERKRWFECFDSVTSILFLVSSSEFDQVLMEDRQTNRLTESLNIFETIVNNRVFSNVSIILFLNKTDLLEEKVQVVSIKDYFLEFEGDPHCLRDVQKFLVECFRXKRRDQQQXPLYHHFTTAINTEKHXLV

SEQ ID NO: 5833 - protein, 449 aa, Salmonella enterica subsp. enterica serovar Paratyphi A str.
MTEIVVSKFGGTSVADFDAMNRSADIVLSDANVRLVVLSASAGITNLLVALAEGMEPGERFATLDAIRKIQFDILDRLRHPNVIREEIERLLENITILAEAASLATSAALTDELVSHGELMSTLLFVEILRERDVQAHWFDVRKVMRTSDRFGRAEPDVAALAELAAQQLLPRLSETLVITQGFIGSESKGRTTTLGRGGSDYTAALLAEALHAARVDIWTDVPGIYTTDPRVVPVAQRIDEIDFEEAAEMATFGAKVLHPATLLPAVRSDIPVFVGSSKDPQAGGTLVCNKTQNPPLFRALALRRNQTLLTLHSLNMLHSRGFLAEVFGILARHNISVDLITTSEVSVALTLDTTGSTSTGDTLLTQSLLMGLSALCRVEVEEGLALVALIGNNLSKACGVGKEVFGVLEPFNIRMICYGASSHNLCFLVPGDDAEKVVQKLHQNLFE

SEQ ID NO: 5834 - protein, 549 aa, Salmonella enterica subsp. enterica serovar Paratyphi A str.
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEVLRPYKNHLTMHFVSNVDGTHIAEVLKKVNPETTLFLVASKTFTTQETMTNAHSARDWFLKTAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 5835 - protein, 283 aa, Mycobacterium sp. JLS
MTSTRGEAAGIPSVSLNDGHSIPVLGLGVGELSESEAERSVAAALEAGYRLIDTAAVYGNEAAVGRAVNASGIPREEIYVTTKLAVADQGFGTSQDAARASLERLGLDYVDLYLIHWPAGDHGKYIDSWGGLMKAKQDGVARSIGVCNFNAEHLSNIIDLSFFTPAINQIELHPLLNQAELREVNAGYGIVTEAYGPLGVGRLLDHAAVTGVAQAHDKTPAQVLLRWSIQLGNVVIARSANPDRITSNLEVFDFELTDDEMATLNGLDEGTRFRPDPETYTGP

SEQ ID NO: 5836 - protein, 602 aa, Myxococcus xanthus DK 1622
MDCSDSARRAEPVKDTSFRGAVLKRGLLAAVMMVACVAQAARPYRGGAVATAYPQASAAALEMLEKGGNATDAAVAAAFVAAVVGPYHSGVGGGGFALVHDAKSGDTKVLDFREVAPKAATRDMYVKDGKVVPGLSTDGALSVAVPGAVAGYLELLKAHGKLKPAVVLAPAIAAARKGMWVTPRYRTMAEGRLACLSRDAEASRVFLVKNAQGQWEPPPVGHVIRQPDLARTLSSIAKGGAKAFYAGPVAKAIATSVQAGGGILTQEDLAAYKTRSATPLEGTYRGHRILTMPPPSAGGVAVIQVLTAMEQLRPQGVTFRDAEALHLYAEAVRRAYVDRAKYLGDPAFVDVPLARLVSPGHVADLAGSIDPKKATPSASLLAPKEGVRGSTLTDEPTTLTPEPEKKNTTHISVIDKDGNAVAMTTTVNYGFGSCVVAKGTGVLLNDEMDDFAAQPGVPNAYGLVTGEPNAIAPGKVPLSSMAPTLVFSKEDPRRVMLAVGSPGGSTIPTTVIQVISNVVDHGMDVARAVNEGRVHHQYLPDELWVDKWGLEPATLSVLEAKGHKVRRVEQWGDAEAVYSDPKTGLRFSASDPRNEGAALGQD

SEQ ID NO: 5837 - protein, 276 aa, Mycobacterium sp. JLS
MGAPLVALNDGNSIPQVGLGVWQTPPEDTERAVAAALAAGYRHVDTAAAYGNEEQTGRAIAQSGLDRSQVYLVTKLWNSEQGYDATLAAFEASVDRLGVDYLDLYLIHWPVPEKNLFVDTFRAFARLREDGRIRSIGVSNFEPEHLRVLIDSTGIVPAVNQIELHPLLPQRELRELHAQLGIATEAWSPLGQGSLLAHPTVTGVAESHGKTAAQALIRWHMQLGNIVIPKSVNPQRIESNFDVFDFELSEQDMASISSLEDASRLGPDPKTFNFTG

SEQ ID NO: 5838 - protein, 340 aa, Mycobacterium sp. JLS
MTLRTLPVLPDRVKRALLGFRSVTVDGNTLDTTLQLLLAAQRAAGINGLVASDDVVVARRQLRLTAAMFPADIVADVTELSIPGPAGAIPARLYRPTSTDPDGPLLVFYHGGGFVIGDLDTHDDLCRVICRDGGITVLSVDYRLAPEHKAPAAADDAYAAFRWASEHAAELGVAADRIAVGGDSAGGNLAAVVCQRARNAAAPLPALQLLIYPVVDVGSETRSKTLFADGYFLTARDIAWFMDLYLEGASVDRTDPDVSPLLADDLSGLPPALVLTGGFDPLRDEGNRYAEALRAAGVPVDLREERSLIHAFANFFPLGGDSATATAAMISALRAHLSRG

SEQ ID NO: 5839 - protein, 141 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 5840 - protein, 483 aa, Acidovorax sp. JS42
MPPLPLLIDGAPRPASGGATFERRNPLDGRIATTAAAATPEDAVAAVQAAARAFPAWAALGPAARRDLLQRAAQALTARADAFAATMAAETGASAAWAGFNVHLAANLLQEAAALTTQIAGEVIPSDMPGSLAMGVRQPAGVVLGMAPWNAPVILGVRAIATPLACGNTVVFKGSETCPATHRLIAEALHDAGLPAGVVNFITHAPGDAADVVEAMVAHPAVRRVNFTGSTKVGRLVAQTCARHLKPVVLELGGKAPLVVLDDADVDAAVNAAVFGAFANSGQICMSTERLVVDEAVADAFVHQLAERARALPLGDPRQGPVVLSPVVDMATVQRCNALIDDALGQGATLVCGGKSDTPLMPATLLDRVTPAMRIYHEETFAPVKAIVRVRGVEQAIATANDTTYGLSAAVFGRDVARAWNVAARIESGICHVNGPTVHDEPQMPFGGVKQSGWGRFGGMAGVREFTELRWITVQTAPRHYPF

SEQ ID NO: 5841 - protein, 488 aa, Glycine max
  misc_feature (110)..(110): Xaa can be any naturally occurring amino acid
MAAKLDTHAVASDLIDFLNASPTAFHAVDEAKRRLRSAGYHQLSEREVWELQPGNKYFFTRNHSTIVAFAIGKKYVAGNGFYIIGAHTDSPCLKLKPVTKVVKAGILEVXGVQTYGGGLWHTWFDRDLTVAGRVIVREENAGSVSYSHRLVRIEEPIMRIPTLAIHLDKTVNDGFKFNNENHLIPILATSLKGELNKVSSENGPVESGNQTDGKKANDKTGTSNTKHHLLLLQLLASKLGCEPDDICDFELQACDTQPSTIAGAAKEFIFSGRLDNLCMSFCSLKALIDATSSDSSLEEESGVRMVALFDHEEVGSNSAQGAGSPVMLNAVTRVTNSFSSNPNLLEKAAQLSYLVSADMAHALHPNYMDKHEANHQPKLHGGLVIKTNASQRYATNVVTSFIFREIASKHKLPVQDFVVRNDMSCGSTIGPILASGVGIRTVDVGAPQLSMHSIREICAVDDVKYSYEHFKAFYQEFSHVDGKMVVDI

SEQ ID NO: 5842 - protein, 528 aa, Burkholderia xenovorans LB400
MNNVELFHYLLLLVCGAGLLTWLAERLTIPPAVMLLVGGSAVALSGPHMTVGMDPNLILTAVLPPLLMSSSFYTAWRDFRREIATISSLALGAVVFTTVAVAVAVHAFEPALSWPACFALGAIVSPPDAVAAKAMLERYPLPSRLVTVLEGESLVNDASGLLLYQMAIAAVLVGQFTVSRAATVLLMLMVIGIATGAACGQAMIWLIRRLPDPMLRIVLTFLMAWGSYSVAEELGGSGVLSVVTCGLVLGIHQHRVFDAHTRIKATATWEVIVFVLDALVFILIGLALEGIVSRMGNVSSMLKTGVGVALPATVAAILARLLWVAAAIYLPSLLSSRLGKSPHPWSRGEAAILGWAGMRGVVSLAAALALPDNFPGRDVIVFSTFLVIFATLVIQGGSLAFLIRLTGLRPVRSTTMSELEARTHTFGASLKEIEKISQSATDDDKPLVQRLIDEYKVRVSNNERAFEAGKEHVELRARQLRLELDLVAISRQALLGLHHEGKIQDSVLHRLEAELDLEELRLHRLLEP

SEQ ID NO: 5843 - protein, 337 aa, Triticum aestivum
MLLTKPQLSSSLLASTPLFNPTSNPNHARPIAASPSPRRRLRISAASTAVSPGATALSRVDVLSEALPFIQRFKGKTVVVKYGGAAMKSPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSPNAAALGFVGEVARVDATVLHPIIASGHIPVIATVAADETGQAYNINADTAAGEIAAAVGAEKLLLLTDVSGILADRNDPGSLVKEIDIAGVRQMVSGGQVAGGMIPKVECCVRALAQGVHTASIIDGRVPHSLLLEILTDEGTGTMITG

SEQ ID NO: 5844 - protein, 298 aa, Oceanobacter sp. RED65
MDAVVRRRTFLKASAALGVNTLVSRSIAADGLKKPRFRMPEEAMLHAKTWFAFGAQKSIWGGRLLPVVQKNLVDIINRVALYEPVSVLVDPLSKPIATKLLTGDAVLIDCPMDDIWIRDTGPLFVEGIDLEGQFGVDFNFNGWGDKQDHDRDGAIAGKILNQVNVGLAGTFLVIEGGAIEVDGAGTGIFTESCILNNNRNPGLSKLECEKELKRILGLENIIWLPGIAGMDITDGHTDFYARFVEPGVVIAAYDSDPNSFDHDVTKAHLEILNQTVDARGRKLDVRVLETPWMFELDI

SEQ ID NO: 5845 - protein, 376 aa, Francisella tularensis subsp. tularensis SCHU S4
MIQAKSYIDTTPSVYGKFALMANEYKALNFTQGAPDFDTPEWLIERTNFYIQHGKNQYSPIPGAVALRNAIVQKTKRCYDTDITIDNVAITAGDQEGLFCIISAYVGQGDEVIMFDPIFDTYAGVTKFNQGKCVRLKLLPNGKIDINAIANAITNRTKLIILNSPHNPMGTVISKDEFKEIAKIVKDKDILVISDEVYEHIYAGESFISAIQIPELHHKLVVFQSLGKTYNVTGWRQGVTIAPPQVIQNMLAIKQFATFSAVHPMQLALAEGILEHPEYYENLHKLYKKQNQLLREHLKGTRFKILDWQGSPFQILDYSISNQDGDKFASNLIKEHGVGLVPISSLFETPQDGLLRLCFAKKDHDIIKGAKILANI

SEQ ID NO: 5846 - protein, 440 aa, Thiobacillus denitrificans ATCC 25259
MKITVIGTGYVGLVTGTCLAEVGNDVLCLDLDPKKIETLKAGGIPIYEPGLEDMVQRNVAAGRLHFTTDIEESVAFGQIQFIAVGTPPDEDGSADLQYVVAAARNIGRHMDDYKLVVDKSTVPVGTADKVRAALAEELARRGAAIEFNVASNPEFLKEGAAVEDFMKPDRIVIGTDSERATQLLRQLYAPFQRNHERLRVMDVRSAELTKYAANAMLATRISFMNELAVLAEKLGADIEQVRHGIGSDPRIGYDFLYAGCGYGGSCFPKDVQALRRTGQENGVPLRVLDAVEEANDAQKQILVNKLVARFGNDLEGRRFAMWGLAFKPNTDDMREAPSRTMLDALWAMGASVSAYDPAAMDETRRIYGERADLQLVDSPMDALKGADALLIVTEWKVFRSPNFDTLKSLLKAPLIFDGRNLYEPRAMREMGFDYFPIGRP

SEQ ID NO: 5847 - protein, 497 aa, Aspergillus niger
MSDLFATITTPNGVKYEQPLGLFIDGEFVKGAEGKTFETINPSNEKPIVAVHEATEKDVDTAVAAARKAFEGSWRQVTPSTRGRMLTKLADLFERDAEILASIEALDNGKSITMAHGDIAGAAGCLRYYGGWADKIHGQTIDTNSETLNYTRHEPIGVCGQIIPWNFPLLMWAWKIGPAIATGNTVVIKTAEQTPLSGLYAANVIKEAGIPAGVVNVISGFGRVAGSAISHHMDIDKVAFTGSTLVGRTILQAAAKSNLKKVTLELGGKSPNIVFNDADIDNAISWANFGIFYNHGQCCCAGSRILVQEGIYDKFIARLKERALQNKVGDPFAKDTFQGPQVSQLQFDRIMEYIQHGKDAGATVAVGGERHGTEGYFIQPTVFTDVTSDMKINQEEIFGPVVTVQKFKDVEDAIKIGNSTSYGLAAGIHTKDVTTAIRVSNALRAGTVWVNSYNLIQYQVPFGGFKESGIGRELGSYALENYTQIKAVHYRLGDALF

SEQ ID NO: 5848 - protein, 488 aa, Geobacillus stearothermophilus
MKVQTEIKTYFNYINGNWVSSVSNNVEPSINPANRHDIVGYVQRSTLEDVNEAVTAANEAQTSWWKRSGVERGEYLYKAAHILEQCLQDIAETMTREMGKTLAEAKAETMRGVHILRYYAGEGARKIGDVIPSSDSEGLLFTTRVPLGVVGVISPWNFPVAIPIWKMAPALVYGNTVVLKPASETAVTAAKVIECFHEAGFPKGVVNMVCGSGSVVGQGIANHPDIDGVTFTGSNTVGKQVGRAAFERGAKYQLEMGGKNPVIVAKDADLDLAVEGTISGGLRSTGQKCTATSRVFIEREVYEPFKAKLLERVKQLKIGNGLDAETWMGPCASESQFHTVLSYIEKGKSEGAKLIYGGNRCLEGELANGFFVEPTIFEDVDLQMTIAREEIFGPVLALIQVDSIEEAIKLANDTEYGLSASIYTKNIGNALEFIKDIEAGLIKVNAETAGVEFQAPFGGMKQSSSHSREQGQAAIEFFTSIKTVFVKA

SEQ ID NO: 5849 - protein, 174 aa, Glycine max
MVDLVDQYNYCFNLKKKKKGRRSRSRTSPRVRGRVGAAEATKSFDESKEEYNKAFEEKKTELQTKVVEIYEASSTEIKSLVKEPKEAGLKKNSTEVQKFLEELVKIDFPGSKAASEASSKFGPALASGSVFFVFEKVSTFIVTEEKEVEAPPAVETKTEEETSSVVKERETVVE

SEQ ID NO: 5850 - protein, 477 aa, Clostridium perfringens str. 13
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKIVNKAIMDSEIPDEILIVMIKRDNKVVIPKGFTIIKPNDTLVLTSKNNEIMNSFLDEIR

SEQ ID NO: 5851 - protein, 468 aa, Pseudomonas putida KT2440
MGLNDQWMQRDLKVLWHPCTQMKDHEQLPLIPIKRGEGVWLEDFEGKRYLDAVSSWWVNVFGHANPRINQRIKDQVDQLEHVILAGFSHQPVIELSERLVAMTPAGLDRVFYADNGSSCIEVALKMSFHYWQNIGKPDKKRFVTLTNSYHGETIAAMSVGDVPLFTETYKALLLDTLKVPSPDCYLRPEGMSWEEHSRNMFQAMEQTLAEHHASISAVIVEPLIQGAGGMRMYHPVYLKLLREACDRYDVHLIHDEIAVGFGRTGTMFACEQAGIRPDFLCLSKALTGGYLPLAACLTTDKVYQAFYDDYPTLRAFLHSHSYTGNPLACAAALATLDIFEQDNVIEANKALATRMATATAHLADHAHVAEIRQTGMALAIEMVQDKAGKLAYPWQERRGLKVFEHALTRGALLRPLGSVVYFLPPYVITPEQIDFLAEVASEGIDIATRDSVSVAVPANFHPDFRDPG

SEQ ID NO: 5852 - protein, 396 aa, Bacillus sp. SG-1
MSKRNLRDETIELHRQHSGKIEVKSKVNIKDESDLSLVYTPGVADVCKAIAENQDEVDTLTSRGNMVAIVSDGTAVLGLGDIGPKAAMPVMEGKSILFKNFADIDAFPLCLDTKDVDEIVNIIKALQPSFGGVNLEDISAPRCFEIEERLKKELDIPVFHDDQHGTAIVVLAAIYNALKVVNKVHKNVKIVINGAGAAGISIARLLLHAGYQDITLVSLEGVVCKGEKWLNNAQEKIAEQTNLTGISGTLNDAIQAADVFIGVSAPGVMKPEHIKAMNEKPIVLAMANPIPEIYPEEALEAGAAVVGTGRSDYPNQVNNLLAFPGIFRGALDAKAKDITMEMKVAAAYAIAGVITDKELSADYIIPKALDERVARLVAKAVRATANQQKKGRSSVS

SEQ ID NO: 5853 - protein, 453 aa, Listeria monocytogenes EGD-e
MKVIKFGGSSLASGIQLNKVFQLVAEDPDRKIIVVSAPGKRFKEDTKVTDLLIDCAAKALLGEDTSELFESVIARYAGIALDTGMSDEIINQIRADLQATISSDKSDPDKFLDRMKASGEDNNAKLIAAYFKFKGLNANYINPKDAGLLVTDEHASAQVLPESYDRLFALREREGIIVFPGFFGYTKDGEISTFSRSGSDITGAIVANGAQAELYENFTDVDAVYAVNPTIVKNPKKVLELTYREMRELSYAGFSVFHDEALIPAFHAGIPVHIKNTNNPDSCGTRVVHERENNNGPVVGIASDDGFCSIYISKYLMNREIGFGRKVLQILEDAGLNYEHMPSGIDDLTIIIRENQFGEDTERTIMSRLKEELNADQVIMQHGISLIMVVGETMRHNVGITSRASKALSDAKVNIEMINQGSSEVSIMFGVKEEQENTAVRALYNEFFSEVFV

SEQ ID NO: 5854 - protein, 194 aa, Listeria monocytogenes EGD-e
MTYPQLSKEVAPNEIEAEMITNRGTIRIKLFPEIAPKTVENFVTHSKNGYYDGLIFHRVIPEFMIQGGDPDGRGTGGESIWGESFEDEFSTEAFNLRGALSMANAGPNTNGSQFFIVQKPDMPADMLGQMEQAGFPVEVIEAYKQGGTPWLDGRHTVFGHVIEGMDVVDEIANLPTGMQDKPVNDVVIEKINIK

SEQ ID NO: 5855 - protein, 404 aa, Dechloromonas aromatica RCB
MDKKSFLQAGHTPTLLAAFLYFDLAFMVWVLLGPLGISIAKDLGLSHAEKGMMVATPVLAGALLRIIMGILVDRLSPKKAAIIGQVVVIATMIYAWQVGVHSYAEVLILGLFLGVAGASFAAALPLASRWYPAEHQGTAMGIAGAGNSGTALAALFAPGLAAAFGWVNVFGVVLIPLVIVLIAFIFMAKDAPDAPPPKTFAEYLKVLKDKDAWWFMFFYSVTFGGFVGLASSLVIYFNTQYGLDPKMAGYFTAGCVFAGSLVRPIGGNVADRIGGVKSLTVMYMFAALFLSIVSFGLPEAWMALLVFVGAMLSLGMGNGAVFQLVPQRFRKEIGVMTGLVGMAGGVGGFYLASSLGYSKQLTGSYQAGFLIFASLAVLALLGLTGVKTRWRTTWGASHLTAAKI

SEQ ID NO: 5856 - protein, 502 aa, Pseudomonas putida GB-1
MDNKVKAYLQAFGVSEATQRFLSKPQRMFIGGAWLEASDGGTAEVIEPSTEGVLTRIPMGTADDLDRAVCAARAQFDGGAWRQLKPLERERLIHRLADLIETHGDELAQIEAIDMGKSVVQARAVDIQGTVDTLRYFAGWASKIHGRTVEPSLPGNYLAYTRKEAVGVVGAIVPWNFPLQTMAWKLGAALATGCTVVVKPAELTSLSALRFAELVQAAGIPDGVVNIVTGRGSVVGQAMSSHPGIDKLSFTGSTPVGCAVGKTAMDQMKRLTLELGGKSPVIVFADADIEAAAQAVANGVFFNSGQVCDAGTRAYVERSVYPAFLDALARYTATLKIAPGLDPDCFISPMVSQQQQRRVLDYIALGKAEGAQVHYGGELLDGPGFYVQPTIFAHCRNDMRIVSEEIFGPVLVTQPFDSQEEALQLANDSLFGLAAAIYSNDLGKVHGLIPQLRAGTVYVNAHSTLDPAMPFGGYKQSGYGKDLGAEQLEFLLETKAVWITLP

SEQ ID NO: 5857 - protein, 313 aa, Vitis vinifera
MGRIQDQSQNQAEYELQPQEYQSESTQDLTLALDHDQLQQEEYPQGPKHPSDAMESEPQAQQQFQQPPQYGNPQAQPNPAYMPQQTQQVSRPQNPQMNAMNANQLAPFPPQSPQSLPLQQSPQLHVFPHGPFQPQGFGTGMHGYQSPSPVPFPPASGEYQGVLASPHKPPAAAEYWTSGLFDCMNDPTNALVTVFFPCVTFGQVAEIVDRGHTSCGTSGLLYGLIAFLIGLPCIMSCTYRTKMRSMYNLSESPGPDWVVHCLCECCALCQEYRELQARGFDPSIGWIGNVAKSQNIQMQHGAMVPPGSQTMMG

SEQ ID NO: 5858 - protein, 474 aa, Pseudomonas putida GB-1
MNNLPHGHCPPEGDTHELKRNLFNRHIQLIAIGGAIGTGLFMGSGKTISLAGPSIIFVYMIIGFMLFFVMRAMGELLLSNLNYKSFIDFSADLLGPWAGFFTGWTYWFCWIVTGIADVIAISAYTQFWFPDMPLWIPALACVGLLLTLNLMTVKMFGEMEFWFAMIKIVAICALVCTGFYMVAAAYQSPAGHAAALANLWNDGGMFPHGAMGFFAGFQIAVFAFVGIELVGTTAAETKNPERNLPRAINSIPVRIIVFYVLALIAIMAVTPWREVVANKSPFVELFVLAGLPAAAGIINFVVLTSAMSSANSGVFSTSRMLYGLAVDGDAPGKFSALSSRAVPSNGLIFSCVCLTGGALVIYLVPNMLDAFTLITTVSALLFMFVWSIILLSYLAYRKQRDPLHQASKYKMPGGTFMCRVCLAFFAFILALLALEADTRMALYLVPVWFAVLGLAYRSIRQKKQETAQLSFDAD

SEQ ID NO: 5859 - protein, 193 aa, Streptococcus gordonii
INDYSYEEVERIVRKAFDIARGRRKRVTSIDKQNVLATSKLWRRVADEVAKDYPDVTLEHQLVDSAAMLMITNPAKFDVVVTENLFGDILSDESSVLSGTLGVMPSASHSADGPSLYEPIHGSAPDIAGQCIANPISMILSVAMMLRDSFAELEAAEAIEAAVEKTLAQGILTRDLGGQVGTAQMTESIINNL

SEQ ID NO: 5860 - protein, 145 aa, Acidovorax sp. JS42
MTTVAEILRTKADGQVHAVEPSDTVLTALRRMADKGIGALLVMEGDQIAGIFTERDYARKMVLLGRSSGDTPVSEVMTRAVRFVRPAQSAEQCMALMTENRLRHLPVVEGGRVVGLVSIGDLVKSVISEQQFIIEQMELYITGVR

SEQ ID NO: 5861 - protein, 297 aa, Thiobacillus denitrificans ATCC 25259
MSTYKTIEDTVGNTPLVRLKRLPGETSNIVLVKLEGNNPAGSVKDRPALSMIEQAEARGEIRPGDTLIEATSGNTGIALAMAAAMRGYKMVLIMPEHLSIERRQTMRAFGAELRLVSREAGMEGARDLAIELEKQGVGRVLDQFTNPDNPAAHYRSTGPEIWRDTEGRISHFVSSMGTTGTIMGCSRYLKEQNPAIQIVGVQPTEGAQIPGIRKWPAEYVPKICDPSRVDRMIYVGQQDAEETTRRLAREEGIFAGISSGGALWAALQLSKEVENATIVSIVCDRGDRYLSTGVFPA

SEQ ID NO: 5862 - protein, 143 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5863 - protein, 113 aa, Brassica napus
MSSSPSLEILVRDAEGFIVWNGPPFSSNGQPTPKNERVSCSSTKFSLDGSKFMAVKSDGTISIYDSPSLGEVRSFAVANVTATEISPCGTYLQTFQKPTTPQEKNVSLWNTDT

SEQ ID NO: 5864 - protein, 208 aa, Triticum aestivum
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAAPAEAAAPVEAAAPAAEVVEEKKEEEKPAEAAAPAAEEPEKK

SEQ ID NO: 5865 - protein, 409 aa, Thiobacillus denitrificans ATCC 25259
MALIVQKYGGTSVANVERIRAVAERVAKFKMLGHQVVVVLSAMSGETNRLIGLAKQIQAEPDPRELDMMVSTGEQVTIALLAMALKDLGLKAKSYTGAQVRILTDDAFTKARILSIDEAKMRRDLDSGHVVVVAGFQGVDEGGNITTLGRGGSDTTGVALAAALKADECQIYTDVDGVYTTDPRIVPEARRLKTVTFEEMLEMASLGSKVLQIRSVEFAGKYKVKLRVLSSFQDEGDGTLITFEENDNMEQAIISGIAFSRDEAKITVVGVPDHPGIAYQILGPVADANVDVDMIVQNVGHANTTDFTFTVHRNDFAKAMSLVKATAATVGAREVTGDDKIAKVSIVGVGMRSHVGIAKKMFETLSKENINLQMISTSEIKISVVVEDKYLELAVRALHQAFELDKATA

SEQ ID NO: 5866 - protein, 612 aa, Chlamydomonas reinhardtii
MLLHAPHVKPLGQRSSIRRGNLVVANVACTAGKNPTSRPAKRSKVEFIKENSDHLRHPLMEELVNDETFITEDSVQLMKFHGSYQQDNREKRAFGQGKAYSFLMRTRQPAGVVPNRLYLVMDDLADQFGNGTLRLTTRQAYQLHGVLKKDLKTVFSSVIKNMGSTLAACGDVNRNVMGPAAPFTNRPDYLAAQKAALDLADLLTPQSGAYYDVWLDGEKFMSSYKEDPAVTEARAFNGFGTNFDNSPEPIYGSQYLPRKFKIATTVPGDNSVDLFTQDLGVVVQGYNLYVGGGQGRSHRDADTFPRLADPLGYVAAADLFAAAKAVVAVFRDYGRRDNRKQARTRHMLAEWGVDKFRSVAEQYLGKRFQEPVPLPPWQYKDYLGWGEQGDGRLYCGVYVQNGRIKGEAKRALRAAIERYSLPVVLTPHQNLVLRDVRPEDREDIEQLLRAGGVKELVEWDGLDRLSMACPALPLCGLAVTEAERALPDVNTRIRAMLTRAGLPPSQPLHVRMTGCPNGCVRPYMAELGLVGDGPNSYQLWLGGGPAQTRLAQPYAERVKVKDLESTLEPLFGAWRAGRQPDEAFGDWVARLGFDAVRQQAAAAAAAAPVGTA

SEQ ID NO: 5867 - protein, 291 aa, Streptococcus pneumoniae TIGR4
MKKQEKLALVESALEDFYGDQQFASSLRESVLYSIHAGGKRIRPFLLLEVLEALQVTIKPAHAQVATALEMIHTGSLIHDDLPAMDDDDYRRGRLTNHKKFGEAMAILAGDALFLDSYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQLPFETESIVSVVESLRING

SEQ ID NO: 5868 - protein, 159 aa, Clostridium perfringens str. 13
MNITVISVGKLKEKYLKQAIDEYSKRLSRYCKLEIIELPDEKTPDNASEKEELQIKEKEGKLILSKIKDNMHVIAMDLKGNEITSEKFSKYIENCGVMGNSNITFVIGGSLGLSQEVIKRADYKLCFSKMTFPHQLFRVMLLEQVYRAFRIMKNEPYHK

SEQ ID NO: 5869 - protein, 286 aa, Ralstonia eutropha JMP134
MNTASLLARNSFIELGARERARLLLDTSTFRELAGPFDGLQSPWLARQGIVPQSDDGVIVAKGRIDGQPVVVLAIEGAFQGGSLGEVGGAKIAGALELAADDNRRGVPTRAVLLLETGGVRLQEANLGLAAIADIHAAIVDLRRYQPVVGVIAGQVGCFGGMSIAAGLCTSLVMTQEGRLGLNGPAVIEQEAGIAEYDSRDRPFIWSFTGGAQRAATGFAEVYVADDCVALRDAVASELRVPVSATHRSERYREVLSVLQDYDAGTQPTPAEVQRLFGHFHRETDA

SEQ ID NO: 5870 - protein, 386 aa, Oryza sativa Japonica Group
MEKSELLLGSYSYAALCGVTLIIGWLAHWVYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQTVSKSIIGTKGGKSKASEARAPPLSSIRTLCNYAALGY

SEQ ID NO: 5871 - protein, 326 aa, Candida glabrata CBS 138
MNSNSKIRHLVSIKDLSDEEFEILVNRAEHFKKIFKSGNTEEFQEQHLKLLGRTIAMIFTKRSTRTRISTEGASTFFGAQPMFLGKEDIQLGVNESFYDTAKVVSSMVSCIFARVNKHEDIQLLCQHSSVPIINSLCDTYHPLQAICDMLTIKEHLDYTKNKLKITWIGDSNNVINDMAIACLKLGMDVSIATPPGIEMDPEIMNAAKKICAKNGTQIEVTHDSKHASVGAHVLVTDTFVSMGEEFAKEAKLKQFQGFQVSQEHASVAAPNFKFMHCLPRHHEEVTDDIFYGDHSIVFDEAENRLYAAMAAIDVFVVHKGDFNACK

SEQ ID NO: 5872 - protein, 207 aa, Yersinia pestis CO92
MSYSGERDQFAPNMALVPMVVEQTSRGERSYDIFSRLLKERIIFLTGQVEDHMANLITAQMLFLEAENPEKDIFLYINSPGGVITAGMSIYDTMQFIKPDVSTICMGQACSMGAFLLTAGAKGKRFCLPNSRVMIHQPLGGFQGQATDIEIHAKEILKVKSRMNELMAYHTGKSLEEIERDTERDRFLSAEQSVEYGLVDSVFTRRD

SEQ ID NO: 5873 - protein, 462 aa, Aspergillus nidulans FGSC A4
MKLASTLAGLLLPLISTVSAADVDAWKSRNIYFALTDRVARGSDDTGGDACDDLSTYCGGTFKGLEGKLDYIKGMGFDAIWITPVVANHDGGYHGYWAKDLYSINENYGTADDLKSLVSAAHEKGIYIMADVVANHMGSPISDNQPESLSQESAYHSACTIDYSSQESIETCRIADDLPDVNTESEEIRTLFKEWITWLVKEYEFDGLRIDTVKHVEKDFWSDFSSAAGVYTIGEVFDGDPDYLAGYANTMDGLLNYAVYYPVNNFYQQAGSAQDIVDMHDKIDSSFPDPSALGTFIDNHDNARWLSNKDDKSLLKNALAYVILARGIPIVYYGTEQGYAGGNDPENREDLWRSNFDTDADLYKAISLLSAARSAAGGLGDNDHVHLHVAESAYAWSRAEGKLVVVTSNSGSGSENEICFDSKTPNGSWENIFGEGTISADDSGQICVSITNGEPAVLVAQS

SEQ ID NO: 5874 - protein, 504 aa, Oryza sativa Japonica Group
MESLLAAGAGGIGVAAAAVGGFIAAATLAVAPPKYRRNPPPAVPGLPIIGNLHQLKEKKPHQTFTRWAEIYGPIYTIRTGASSVVVLNSTEVAKEAMVAKFSSISTRKLSKALTVLSHDKSMVATSDSGDFHKMGKRYIMLSMLGTSAQKQFRDTRDMIINNMLSTFHQLVKDDPHAPLIFRDVFKNELFRLSMIQSLGEDVSSVYVDEFGRDISKEEIYNATVTDMMMCAIEVDWRDFFPYLSWVPNKSFETRVFTTESRRTAVMRALIKQQKERIVRGEARTCYLDFLLAENTLTDEQLMMLVWEALIEAADTTLVTTEWAMYELAKNPDKQERLYQEIREVCGDEAVTEEHLPWLPYLNAVFQETLRRHSPVPLIPPRFVNEDTMLAGYDVPAGTEMVINLYGCNMNKKEWESPEEWAPERFAGGRFKVADMYKTMAFGAGRRVCAGSLQATHIACAAIARFVREFGWRLREGDEEKVDTVQLTAYKLHPLHVHLTRRGRM

SEQ ID NO: 5875 - protein, 404 aa, Haemophilus influenzae R2846
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 5876 - protein, 166 aa, Pseudomonas putida GB-1
MIKIGDQLPDVTLYQYNTDAGACAIGPNAFSIRERCKQKKVLIFALPGAFTPTCSERHVPGYVAEAPALFAAGIDEILCVSVNDAFVMNAWGNSLQVGDAVKMIGDGNGEFSEALGLIQDLSARGMGRRSQRYAMLVDDLVVKHIAVEAPGKFEVSDAASMLAALR

SEQ ID NO: 5877 - protein, 332 aa, Salmonella enterica subsp. enterica serovar Paratyphi A str.
MQPETQSSALPAYRFSIAPMLDWTDRHCRYFLRLLSRQTLLYTEMVTTGAIIHGKGDYLAYSEEEHPVALQLGGSDPAQLAHCAKLAEARGYDEINLNVGCPSDRVQNGMFGACLMGNAQLVADCVKAMRDVVSIPVTVKTRIGIDDQDSYAFLCDFINTVSGQGECEMFIIHARKAWLSGLSPKENREIPPLDYPRVYQLKRDFPHLTMSINGGIKSLEEAKEHLRHMDGVMVGREAYQNPGILAAVDREIFGADTTDADPVAVVRAMYPYIERELSQGAYLGHITRHMLGLFQGIPGARQWRRYLSENAHKAGADVAVLEQALKLVADKR

SEQ ID NO: 5878 - protein, 550 aa, Thiobacillus denitrificans ATCC 25259
MKPLKTLPAWKALEQHFKSMRNFDMRAAFREDAARFETLSLRCGNLLLDYSKNRVTQETMRHLAQLARESELEEMRNAMCTGERINFTEKRAVLHVALRAPVRPALMVEGVDVEREIAKVLHRMQRFVESVHNGSWRGHTGKPIRNVVNIGIGGSDLGPAMVCHALDHYAVENVRVHFVSNLDPSHLAGTLAQLDPETTLFIVASKTFTTLETLANANSAKAWLLAALRAPEAVARHFVALSTNAQAVEAFGIDPENMFIFWDWVGGRYSLWSAIGLSIALQIGWGNFQALLAGAHAMDVHFKEAPLEANMPVILGMLGIWYANFWGTDTYGVFPYDQRLRLLVPFLQQLDMESNGKNVNRANKLVNYNTGPIVWGAPGTNGQHAFFELVHQGTRLIPTDFLVAAVNLTPLADQHEWLLANCLAQTEALLKGKSRAVIEAELIAQGMTRDDARALAPHKVFPGNRPSNTLLYQKLDPHTLGMLIALYEHKVFVQGVIWQINSFDQWGVELGKQLAPPIRAALSSVRVIGEHDGSTQGLIADIRRRRGLST

SEQ ID NO: 5879 - protein, 327 aa, Salmonella enterica subsp. enterica serovar Paratyphi A str.
MATRIEFHKHGGPEVLQTVEFTPTEPAEHEIQVENKAIGINFIDTYIRSGLYPPPSLPAGLGTEAAGVVSKVGNGVEHIRVGDRVVYAQSTLGAYSSVHNVPADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 5880 - protein, 212 aa, Streptococcus pneumoniae TIGR4
MQNRPIIIGVTGGSGGGKTSVSRAILSHFPDEKISMIEHDSYYKDQSHLTFEERVKTNYDHPFAFDTDLMIEQIKELLAGRPVDIPTYDYTEHTRSSKTYRQEPQDVFIVEGILVLEDKRLRDLMDIKIFVDTDDDVRIIRRIKRDMEERGRSLDSVINQYLGVVKPMYHQFIESTKRYADIVIPEGVSNTVAIDLLTTKIAKILEEARNSK

SEQ ID NO: 5881 - protein, 346 aa, Pyrococcus abyssi GE5
MKMGVGKYDELFNRIKERAKLVDEKLFELIPEKEPKVLYEAARHYPLAGGKRIRPFVVLTATEAVGGNALKAIYPAVAIELIHNYSLVHDDIMDMDETRRGKPTVHKVWGINMAILAGDLLFSKAFEAISRAEISPEKKAKVLETIVKASNELCEGQALDLEFENREMVSIEEYMRMISGKTGALFDASAKVGGIVGTENEEYIEALSRWGRNVGMAFQIWDDVLDLIADEEKLGKPVGSDIRKGKKTLIVAHFFENADEKAKEKFLKVFGKYAGDVKGKGIIEEDVKAEVMEAIELLKEHGSIDYASRIARELVEKANEALNVLPESRARKDLELLASFMVEREY

SEQ ID NO: 5882 - protein, 214 aa, Brassica napus
MEIDREDGRTSNQLRPLACSRNILHRPHGSASWSQGDTKVLAAVYGPKPGTRKNENPEKACFEVIWKPKSGQIGKAEKEFEMILKKTIQSICVLTVNPNTTTSVIIQVVHDDGSLLPCAINAACAALVDAGIPMKHLAVAICCCLADSGYVVLDPNKLEEKKMTAFAYLVFPNTTLSVLPEVEGEPVEHGIITSVTHGVMSVDDYFLCIETGRA

SEQ ID NO: 5883 - protein, 148 aa, Zea mays
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPNYEEGGAADEDDEAAREVVVGEVEVAKVAESRDGVARVDVAPGLLQDQKQ

SEQ ID NO: 5884 - protein, 131 aa, Arabidopsis thaliana
MSRSLGIPVKLLHEASGHIVTVELKSGELYRGSMIECEDNWNCQLEDITYTAKDGKVSQLEHVFIRGSKVRFMVIPDILKHAPMFKRLDARIKGKSSSLGVGRGRAAMRGKPAAGPGRGTGGRGAVPPVRR

SEQ ID NO: 5885 - protein, 368 aa, Oryza sativa
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNNQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIHVTEESSS

SEQ ID NO: 5886 - protein, 403 aa, Clostridium perfringens SM101
MRKIYNNRYYDYNRYYDDEYYQDDYYQNDYHCKEDYCCKDDCYLKINCNCCKPGPRGPRGPQGEQGPQGERGFTGPQGPVGPQGEQGPQGERGFTGPQGPIGLQGEQGPQGERGFTGPQGPVGPQGEQGPQGERGFTGPQGPVGPQGEQGPQGERGFTGPQGPIGPQGEQGPQGERGFTGPQGPIGPQGNQGPIGPQGEQGPQGATGPQGPQGPVGPQGNQGPIGPQGPVGPQGPQGQPGVNFNDTLLVSSSSLSSQNVGSNGIFTYNIQNPNGSTFTAITANIANGTFTINEPGRYLFIWSFNLDNTNNTTANTIVSLFRNGFRIFLSGTPRVAPGEIGVVNGSIAVNANAGDVFALVNNSTRNVLSQIISSPISVTPAILGESTGINSGIGSWVQIVKVSD

SEQ ID NO: 5887 - protein, 266 aa, Gloeobacter violaceus PCC 7421
MPMSAERQAWLSWAPQLVGVLILGFLLISLNPVRFVGNGENLVVFSWFGGIQKEPLQPGGHLILPVVSETIPFDVKTQALTWKDGGDSYGPRIVALTRDGQEIGAEVTMQFVVADPPKVYETLGTEYIDRIAPIVRSVISSQTSGFSAQDLYSTKRPVLQAQIRERVAGDLSQYGINVLDLLLRDVNFSKDFVAAIEAKTISENQLARKAYEIDQATQDAKTLISEAQAEAGRLGAKADALTKNPEYLRVVQSGVLGETLDTLINR

SEQ ID NO: 5888 - protein, 560 aa, Gloeobacter violaceus PCC 7421
MTDTMRRSKVEQIKENSHNLRGRLREELQQPETTHFAEESVQLLKFHGIYQQDDRDERKARKDAGLEPDYAFMVRTKNPGGYAPAAFYLAMDRLADALGSGTLRVTTRQGLQLHGIRKHNLREAIATISTQLGSTLGACGDINRNVMAPPAPFTARPYAVAREAAAAIADMLTPHTGAYFEVWQDEALVYSGEPEVEPIYGETYLPRKFKIAVAVEGDNSVDIYTQDLGVIPVFEDGERLLGYNLTVGGGLGMTHAKPETFPRQADHLGFVSSEDMLEAVKAVVLVQRDHGDRYNRRHARLKYLIHDRGLGWFRAQVETYLGKPLQPWRTVAPWVFHDYLGWQPQGDGRYCLGIWIENGRIKDEGAFRLKSALREIVERFEVDLILTPTQNALLVDVAPEVRAPIDAILQSAGVRPVQAVSNAERYAMACPAWPTCGLALTESERALPGIIAELEAKLTELDLAQEQISIRMTGCPNGCARPYMGEIGFVGSAPGAYNLYLGGNLASTRLNWVFRERVKREDILAVLGPLFSYFKRERAPGESFGDFCLRKGRADLEAHL

SEQ ID NO: 5889 - protein, 659 aa, Klebsiella pneumoniae
MSYVDWPPLILRHTYYMAEFETTFADLGLKAPILEALTDLGYEKPSPIQAECIPHLLDGRDVLGMAQTGSGKTAAFSLPLLNNIDPELRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTAYGMRKNEALVRFLEAEDFDAAIIFVRTKNATLEVAEALERNGYNSAALNGDMNQALREQALERLKDGRLDILIATDVAARGLDVERISLVVNYDIPMDSESYVHRIGRTGRAGRAGRALLFVENRERRLLRNIERTMKLTIPEVELPNAELLSKRRLEKFAAKVQQQLESSDLDQYRALLAKIHATAEGEELDVETLAAALLKMAQGERSLIVPPVAPMRPRREFRDRDDSFDRRGDRNDRGPRGDREDRPKRERRDVGDMELYRIEVGRDDGVEVRHIVGAIANEGDISSRYIGNIKLFASHSTIELPKGMPGEVLQHFTRTRILNKPMNMQLLGDAQPRTERRGGGERREGGRGFGGERREGGRGFGGERREGGRGEGRRFSGERREGRAPGRDDASAPRRDDSAGRRRFGGDA

SEQ ID NO: 5890 - protein, 256 aa, Pseudomonas putida KT2440
MNDQRKGDHAEPTTHFGYQDVPESQKAKKVAEVFHSVAAKYDLMNDVLSGGMHRLWKRFTIELSGVRSGNRVLDIAGGTGDLAAKFSRLVGPTGQVVLADINDSMLKVGRDRLLDRGVAGNIEFVQADAEKLPFPDNHFDCVTIAFGLRNVTHKDAAIRSMLRVLKPGGRLLILEFSKPTNKLMSKAYDAYSFAFMPLAGKLITNDAESYRYLAESIRMHPDQETLKSMMVEAGFDRVTYHNMTSGIVAVHRGIKP

SEQ ID NO: 5891 - protein, 158 aa, Clostridium tetani E88
MRVGIGYDVHKLVDGRDLIIGGEKIPFEKGLLGHSDADVLCHAIGDSILGAAALGDIGRHFPDTDNRYKGYSSLKLLEEIKRIINEKGYYITNIDSTIIAQKPKMLAYINNMRKNISKVLDISIEDINIKATTEEELGFTGKQLGIKAQSICLLNKNI

SEQ ID NO: 5892 - protein, 421 aa, Acidovorax sp. JS42
MGKPHPLLHTGGLPVQALRAQFPVLAQRIHGQPLAYLDNAATTQMPLAVQEAMQRFERHDRANIHRGVHTLSQRATDAFEEARATLKRFIGAGMQHELVFTSGTTEALNLVAQGLWAAGPGKAWLRPGDRIIVSGLEHHANLVPWQQAARMSGAELVVLQPDAQGRVHEADLAPLLTPNTRVLALTACANATGERPPYEALLAMARAAGALTVLDAAQAVGHAMPALAELEADFMAFSGHKMYGPMGTGALAGRREALERLYPLRLGGDMVEWVSYTAAGYAALPARLEGGTPNVAGAVGLAAAARFIDGIGREAIDLHVQTLRAQALAGLSALEGVTVLAPHATQASLVSFVARDVHPHDIGTLLDERGIAVRTGHHCAQPLQEHLGMGPTTRASFALYNSHEEVERLIAGVAQALEVMR

SEQ ID NO: 5893 - protein, 601 aa, Klebsiella pneumoniae subsp. pneumoniae MGH 78578
MAGSDLLLAGVLFLFAAVIAVPLASRLGIGAVLGYLLAGIAIGPWGLGFISDVDEILHFSELGVVFLMFIIGLELNPAKLWRLRSSIFGVGAAQVMLSAAILGGLLMTTGFSWQAAVVGGIGLAMSSTAMALQLMREKGMSRSEAGQLGFSVLLFQDLAVIPALALVPLLAGSADEHVNWLTVGMKVLAFAGMLIGGRYLLRPVFRFIASSGVREVFTAATLLLVLGSALFMEALGLSMALGTFIAGVLLAESEYRHELEIAIDPFKGLLLGLFFISVGMALNLGVLYTHLLWVAVSVAVLVAVKMLVLYLLARLYGLRSSERMQFAGVLSQGGEFAFVLFSLPASQRLFLHDQMALLLVAVTLSMMTTPLLMKGIDKLLSRRLNPADDTGEAPWVEDDKPQVIIVGFGRFGQVIGRLLMANKMRITVLERDISAVNLMRNYGYKVYFGDATQLELLRSAGAEEAQSIVITCNEPEDTMRLVEMCQQHFPHLHILARARGRVEAHELLQAGVTQFSRETFSSALELGRKALITLGMHPHQAQRAQLHFRRLDMRMLRELMPVHTDTVQISRVREARRELEEIFQREMQKESRQLDGWDEFE

SEQ ID NO: 5894 - protein, 634 aa, Klebsiella pneumoniae subsp. pneumoniae MGH 78578
MIVFSSLQIRRGVRVLLDNATATINPGQKVGLVGKNGCGKSTLLSLLKNEISADGGSMTFPGNWQLAWVNQETPALPQPAIDYVIDGDREYRQLEAALQQANERNDGHAIATVHGKLDAIDAWTIRSRAASLLHGLGFSNEQLERPVSDFSGGWRMRLNLAQALICRSDLLLLDEPTNHLDLDAVIWLEKWLKGYTGTLILISHDRDFLDPIVDKIIHIEQQTMFEYTGNYSSFEVQRATRLAQQQAMYESQQQRVAHLQSYIDRFRAKATKAKQAQSRIKMLERMELIAPAHVDNPFHFSFRQPESLPNPLLKMEKVSAGYGERIILDSIKLNLVPGSRIGLLGRNGAGKSTLIKLLAGELQPVSGEIGLAKGIKLGYFAQHQLEFLRADESPLRHLARLAPQELEQKLRDYLGGFGFQGDKVSEETRRFSGGEKARLVLALIVWQRPNLLLLDEPTNHLDLDMRQALTEALIDFEGALVVVSHDRHLIRSTTDDLYLVHDGKVEPFDGDLEDYQQWLSDSQKQESQSGEAPKESGNSAQARKDQKRREAELRSQTQPLRKEIARLEKEMDKLNAQLASAEEKLGDSELYDASRKAELTECLQQQASAKSGLEECEMAWLEAQEQLERMLQEG

SEQ ID NO: 5895 - protein, 1334 aa, Chlamydomonas reinhardtii
QAGVELPAVTVEYRQLRVETEALVGSASIPTVVSVPLTAAKVRRRGRESRMPAEGLQRGCRGAVAGVQKGCGGAVESLAALCDVVCQAAKPLAILNDLQGRLVPGRLTLLLGPPSCGKSSFMRALTGRLMPAQGRVRYNGAELDQFNVRRTAAYVDQIDNHNPNLTVRETLDFAHACQVGLHGAAIDVPAELAAQRIASRANGDSEPEDEFEALLRQAWGTNVRVDIVMSLLGLAHCSETLVGDALVRGISGGERKRLTTAEMLVGPSNVIMLDEMSTGLDSATLFTVVRWLSQAAQALRLTVMISLLQPPPEVFGLFDDVILMTEGRVLYHGPVSDVVPHFRSLGLECPDRKDVPSFLLEITTPLGQRQYAGPELRQRFNLPPPGWSDCFTSMKCRWSSRSSINIPLAPAPTAHSPSVLFPNTRGPRRGHVCRAARDLVTLVMRDKVLLKGRLIQVTVLGLLTGSLFYNQVRGPAHQPTRLGWGVSMVAARTLFGCCFMSVLFMSFGGFPQIPITLEQKKVWFKHRDSAFYPAYAQGLAMALSQLPLSFIESGVFALVIYFMTNFYRQGLGYFFTFYLVLACTSMAVSSLFRFLACVSPNMVVANALSGLAIVTLILTSGFAIVHYSIPPWAIWAYWISPHAYALRSLVINEMVSPKWQNLPAPGGPPGMSLGDAALDTFDFYTTRGWIWIGVGFLIGFYSILTALSIVILAYQEPEEVARARARAEALRERFTKLPAKSGRHKHSKANKASESWELACVGAATTSSERGRGLPAVPSAASKPSSGRAAGQPGSLPLEARERLQLLSGITGFNEPGVLLALMGGSGAGKTTLMDVIAGRKTVGEIGGTITVNGHKAEPRAWSRVMGYVEQFDIHTPAQTVVEALQFSARLRLPQSFTDTQVKAYVDEVLEIVDLTPMLFNLVGTAGVSGLSTEGRKRLTIAVELVANPSCLFLDEPTSGLDARAAAIVMRAVRNVARNGRTVMVTIHQPSIEIFESFDQLLLIQRGGRTTYFGPLGLHSADLINYFMAVPGTPPLPSGFNPATWMLEVTGGSMATVLDKVELDWPEHYAATELARKVGQRGQQLRSQGQGVPPAGGRHPRPTRYAMPFWTQTRVLLRKYNLAYWRTPSYNFVRMGMTFITSFIYLAIYWGEGHIPNPAGIANVQNVMGIMFSSSNFLGMTNLMSVMPVVGYERVVFYRERGASMYDAFAYGIAIALVEMPYLLVQACTFVPIMYFAIGFELTAEAFWYYFIVFFETIVFYTIFGQTLVYITPAQAIAQVVGGGFNFLFNVFNGFIITYPEIPRGWKWMNRIVPPTWILYGLGVSQLGNKNELL

SEQ ID NO: 5896 - protein, 143 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 5897 - protein, 289 aa, Klebsiella pneumoniae subsp. pneumoniae MGH 78578
MSAKHPVIAVTGSSGAGTTTTSLAFRKIFAQLNLHAAEVEGDSFHRYTRPEMDMAIRKARDQGKHISYFGPEANDFGLLEQTFVDYGRHGKGQSRKYLHTYDEAVPWNQVPGTFTPWQPLPEPTDVLFYEGLHGGVVTPQHDVASHVDLLVGVVPIVNLEWIQKLIRDTSERGHSREAVMDSVVRSMEDYINFITPQFSRTHINFQRVPTVDTSNPFAAKAIPSLDESFVVIHFRNLQNIDFPWLLAMLQGSFISHMNTLVVPGGKMGLAMELIMTPLVERLMEGRKIG

SEQ ID NO: 5898 - protein, 395 aa, Ralstonia solanacearum GMI1000
MNASLPPALNHPVAARDAIRDLRASRIREVANAGLGLPDVLPFWFGESDRVTPEFIRDTAAQALARGNTFYTHNLGIAPLRSALADYVSRLHGRTAIDHVAVTSAGVNALMLAAQLVVGPGDRVVTVTPLWPNVVEIPKILGAHVETVPLDYGAHGWTLDVDRLLAALTPDTRLLAINSPNNPTGWVMSREAQQAVLAHCRRHGIWILADEVYERLYYGDRPAAPSFLDIAGRDERVICVNSFSKSWLMTGWRLGWMVLPAAVTDDLGKLIEYNTSCAPSFVQEAGVVAVRDGEDFIRGETARLRAARDHLVTALSALPGVDVRVPEGAMYAFFRIPGAQDSLALCKQLVREARLGLAPGSAFGPEGEGFVRWCYACDVARLAAGVERLREFLRV

SEQ ID NO: 5899 - protein, 218 aa, Chlamydomonas reinhardtii
MPLIYSSVSQGTVTLAEYAAFSGNFGAVAKDYLEKAGKNEGKFTFNVDGHTFNFLNRGGFTYLVVADEAYGRAIPSAFLDKMASEFAMKFADKAAGAKEGGLNGSFGKQLKSMMEHATQYPEEYSKVASVQKKVDEVKGIMTENIEKVLARGEKLELLTDKTENLMNEADRFQRTGRTLRRKMWWQNCKMKIVVALAVILLAVVIFLLVCFSGGNCLK

SEQ ID NO: 5900 - protein, 387 aa, Oryza sativa Japonica Group
MTNKNLELQRLVGVQTNMLKNSGVTIIEGRGKVVDPHTVSVDGKLYTAKNILIAVGGRPSMPDIPGIEHVIDSDAALDLPSRPEKIAIVGGGYIALEFAGIFNGLKSGVHVFIRQKKVLRGFDEEVRDFVADQMSLRGITFHTEETPQAVMKSDDGLLTLTTNKGSINGFSHVMFATGRKPNTKNLGLEEVGVKMDKHGAIVVDEFSRTSVDSIWAVGDVTNRVNLTPVALMEGGALARTIFGNEPTKPDYSAVPSAVFSQPPIGQVGLTEEKAIEKYGDVDVYTSNFRPLRATLSGLPDRVYMKVIVCANTNKVLGVHVCGEDAPEIIQGIAIAVKAGLMKQNFDATIGVHPTTAEELVTMRSPTRKVRRDAVDEAKMKDEATSQK

SEQ ID NO: 5901 - protein, 468 aa, Francisella tularensis subsp. tularensis SCHU S4
MITPIILSGGFGSRLWPLSREASPKQFIGLVDEHSLLENTIKRLDNVKDITSPVVVCNESHRFQVAEVLRKINKKGDILLEPLARNTAPAIALAALHLAINDPNTIMLVLAADHHIENLEIFHQAIEKAQQKVIKDDSLVTFGITPTCPHEGYGYIKQGVQTTVNGVYKVDKFVEKPSVVVAQEYLDSGKYYWNSGMFMFTARVYLEVLEKLQPEIYRGCEKTYQKSQQDLDFVRFDKQSFALVQSQSIDYAVMEKATNVAIVPMQQSGWSDVGSWDSLYDIAAKDSCGNVVIGDVITSNVKNSYLRSHDRLLAAVGVNDLIIVETADAILVADKNKTQDVKKIVEVLKIQQRSELLQHKQIYKPWGSATILEDKSGYKIQAIQLEPGKKLSLQQHYHRSEHWIVISGTATVTIGTTKSIVRPNESVYIKIGESHRLENNGKIPVILIEVQVGEYISEDDIVRLDTSS

SEQ ID NO: 5902 - protein, 497 aa, Passalora fulva
MSLSVQLETPSAGKYEQPTGLFINNEWVKPVSGKFFDVINPTDESVICQVAEADEKDVDIAVAAARKAFEGPWRQETPENRGKLLVKLAELFEKNLDLFASVKALDNGKAFNMAKVDIGMCAGCLRYYGGWADKIEGKVVDTTPDTFNYIKKEPIGVCGQIIPWNFPLLMWAWKIGPAVATGNTVVIKTAEQTPLGAYVAANLIKEAGFPPGVVNVISGFGKVAGAAIASHMDIDKVAFTGSTVTGRTILKAAAGSNLKKVTLELGGKSPNIVFDDADIDNAISWVNFGIFFNHGQRCCAGSRIYVQEGIYDKFLQRFKERAQKNVVGDPFAADTFQGPQVSQVQFDRIMGYIQAGRDAGATVEIGGNRKGDKGYFIEPTIFANVTEDMKIMQEEIFGPVCSISKFKTKEDAIKVGNATPYGLAAAVHTRNLNTAIEVSNALRAGTVWVNTYNTLHHQLPFGGFKESGIGRELGEDALANYTQTKTVSIRLGDALFG

SEQ ID NO: 5903 - protein, 162 aa, Populus trichocarpa
MAPIAVGDVLPDGKLAYFDEQDQLQEVSVHSLVAGKKVILFGVPGAFTPTCSLKHVPGFIEKAGELKSKGVTEILCISVNDPFVMKAWAKSYPENKHVKFLADGSATYTHALGLELDLQEKGLGTRSRRFALLVDDLKVKAANIEGGGEFTVSSAEDILKDL

SEQ ID NO: 5904 - protein, 251 aa, Lotus japonicus
MPIRNIAIGAPQEATHPDTLRSALAEFISTFIFVFAGSGSGIAYNKLTDDGAATPAGLISASIAHAFALFVAVSISANISGGHVNPAVTFGLFVGGNISFLRGVIYIIAQLLGSIVASLLLAFVTGLAVPAFGLSAGVGVGNALVLEIVMTFGLVYTVYATAVDPKKGSLGTIAPIAIGFIVGANILLGGAFDGASMNPAVSFGPAVVSWSWSNHWIYWVGPLVGGGIAGLIYEVVFIGSQTHEQLPTTDY

SEQ ID NO: 5905 - protein, 129 aa, Myxococcus xanthus DK 1622
MKLGYIILYVPDVSAAIVFYEKAFGLARRFIHESGGYAEMETGTTALAFVEEGAAKEHGFTVRHLRPKEDAAAIELALVTPDVATAYTRAVEAGAEATQPPKQKPWGQTVAYVRDINGVLVELCSPMEG

SEQ ID NO: 5906 - protein, 373 aa, Arabidopsis thaliana
MSNDKDSMNMSDLSTALNEEDRAGLVNALKNKLQNLAGQHSDVLENLTPPVRKRVEFLREIQNQYDEMEAKFFEERAALEAKYQKLYQPLYTKRYEIVNGVVEVEGAAEEVKSEQGEDKSAEEKGVPDFWLIALKNNEITAEEITERDEGALKYLKDIKWSRVEEPKGFKLEFFFDQNPYFKNTVLTKTYHMIDEDEPILEKALGTEIEWYPGKCLTQKILKKKPKKGSKNTKPITKTEDCESFFNFFSPPQVPDDDEDLDDDMADELQGQMEHDYDIGSTIKEKIISHAVSWFTGEAVEADDLDIEDDDDEIDEDDDEEDEEDDEDDEEEDDEDDDEEEEADQGKKSKKKKAGRSQLAEGQAGERPPECKQQ

SEQ ID NO: 5907 - protein, 306 aa, Yersinia pestis CO92
MSDTHAPVDFKQQLAAHQQRVNQALLDFIAPLPFGNSNLIEAMRYGAVIGGKRLRPYLVYATGQMFGLSLANLDAPAAAIECIHAYSLIHDDLPAMDDDDLRRGQPTCHVKFGEAHAILAGDALQTLAFSILAEAPMPDVADKDRLSMIIELAQASGAAGMCAGQALDLEAETRPVLLGDLEQIHRHKTGALIRAAVRLGAQAAGEAGRKTLLSLDRYAEAIGLAFQVQDDILDVIGDTATIGKRQGSDQQLGKSTYPALLGLDCAQTKAMDLYQEALEALDELAKQSYNTDSLQALARFIIERNN

SEQ ID NO: 5908 - protein, 578 aa, Kluyveromyces lactis
METKTLIHSGAAKEMSYTERYNVAPLIPLPEYLFHRLFQLNCRTVFGVANYSTAKLYQAIAVSGIHGIQTINQLNTSFAVDAYGRAIGVSCYVTSESAELGHVNGFFGSFCEYVPILQVVVLEQSHDLERLIGDVSIFHDVVDDPSEIDSCVRTLFWGKRPVYMGLRSKDATKLVPSSSLNGNIADKMGIKNTFFQTDTIKRVIDKIIAEVYASSRPLIVVDALIDRYNYNSTIQNFLTETGIPFVTTLMSKGSIDESLPNFVGTFLGTMSQPIVREYMNNADCTLILGCMIENFKNSYCRFNYKSKNQILLWNDRVKIENNIIPDILLHELLPQLIASLDTTKIVNSRPVTIPNMIPRVEPQPVTFLRQEYLWFKMSTWLKQGDVIISESGTSAIGLLQQKFPDNTRLVSQAIWNSSGYSIGACLGILAAYRDMGTLDKHRIILMVGDGSLQFTFQELSTILTHGFKPYIFVINNQGYTVDRTLNREKTHLNATYFDIQPWELLKLPSLFYSQEYFKRRCMSVGELNSLLSDKEFNKSDQLKIVELILPSMDVPVLLDPRDDSSDDESSPQHKRPRT

SEQ ID NO: 5909 - protein, 356 aa, Zea mays
  misc_feature (186)..(186): Xaa can be any naturally occurring amino acid
MEMTGSLPVPSVQAMVAAGRHAPVPPRYLRPDLAADVVVADDATTIPIIDFQRLLLVDPEESARLHAACQDWGFFQLINHGVPDDVMEAMKASTQSFFALPAEAKQQYRQQAGQLEGYGQLFVVSEDQKLDWADVLYLNTQPPEHRNLSFWPAGESFRQTLDTYSAAVKHVADRLLGAMYMNLGLXSSMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 5910 - protein, 619 aa, Yersinia pestis CO92
MSLDIAKYPTLALAENPEELRMLPKESLPKLCDELRQYLLTCVSRSSGHFASGLGVVELTVALHYVYNTPFDHLIWDVGHQAYPHKILTGRRDRISTIRQKDGLHPFPWRGESEYDVLSVGHSSTSISAGLGMAVAAEREGKGRRTVCVIGDGAITAGMAFEAMSHAGDIHSDMLVILNDNGMSISENVGGLNNHLAQLLSGKLYASLREGGKKAFSALPPIKDLLKRTEEHLKGMVVPSTLFEELGFNYIGPVDGHDVHTLTQTLKNMRDLKSPQLLHIMTKKGKGYAPAEKDPIGWHAVPKFDPASGTLPKSQSSLPTYSKIFGEWLCETAAKDSKLMAVTPAMREGSGMVRFSREYPQQYFDVAIAEQHAVTFAAGLAIGGYKPVVAIYSTFLQRAYDQLIHDVAIQNLPVLFAIDRGGLVGADGQTHQGAFDLSFMRCIPNMVIMAPSDENECRQMLYTGYHHNGPAAVRYPRGNGTSAVLEPLEMLPIGKGVLRREGEKIAILCFGTLLAQAQLAAENLNATLVDMRFVKPLDEELVLEMAAKHQVLVTVEENAIMGGAGSGVNELLMAKRRWVPVLNIGLPDLFVPQGEQDEMRSELGLDAAGIQRQIEAWLA

SEQ ID NO: 5911 - protein, 746 aa, Oryza sativa
MSVMARPRFEEDDEDEFFDSREVMSPASVSSPASSGRYDGPMLEVWATDPCSVHERRQRFIKSLGLSDSSPSAGGGGDRPDEEPCSRSSAAEEILPCSPTVELVSAVPSFACRGEEPGASGGGGGAEVLDCVFKNLDDGTVFVVDEMGKDGSFRSLRDRRSNRTVTAAEFERTYGSSPFICELMRRVDDSDESSAVEKALVRGRRRRRRFGWLRRLGIRGCVVDVEEDDETNSTSSSSCRSCSGKVDRVKVRHYKKRSKELSAVYRGQDIKAHEGAIVTMKFSSDGQYLATGGEDGVVRVWRVVEGERPNELDFAEDDPSCVFFTVNENSELAPVNSSEGSKSKHYKNSKVSTDPACVVIPHRTFALSQEPVHEFYGHDDAILDLSWSKNRDLLSSSMDKTVRLWQVGCNSCLKVFSHTNYVTCVQFHPTSDNYFISGCIDGLVRIWDVRRCQVVDWADTKEIITAVCYRPDGKAAVVGTITGNCRHYDASENHLELESQVALNGRKKSPLKRIIGFQYCPSDPKKLMVTSGDSQVRILDGLHVISNYKGLRSSSQVAASFTPDGDHIISASDDSSIYMWNYANQIAPVTNHVKTVWSNEHFSCHDVAIAIPWNASQTRNSISLACSITSSRQEVLDEFHNEHDSSSCSHTEDSPDGDSLYQLPSGNFTLSSAFFAESAPRGSATWPEEQLPSNSTTQSTLRKSQYKFLKASCQNAATHAWGQVIVAAGWDGYIRSFQNYGLPVQV

SEQ ID NO: 5912 - protein, 224 aa, Bacillus anthracis str. Ames
MTVQTNLTTVNEAIKQSCARAGRSLQDIKLVAVTKTVGIEKTNEVIEAGIIDLGENRNEGFLQKYEHFGSKVNWHFIGSLQTRKVKEIINEIDYLHSLDRLSLAKEIQKRANKKVKCFIQVKTSSEESKQGLAIEETVSFIQSLQELDKIEVVGLMTMAPFTEEEEEIRRCFKELRMLQKEVQGLELLHAPCKELSMGMSNDYTIAIEEGATYIRLGTILVGKA

SEQ ID NO: 5913 - protein, 369 aa, Coprinopsis cinerea okayama7#130
MKALSDLVKHARLQYLQVSKPHVIIHTSDKPSYGPGMYWTDVKKKARRPLNSIILEGNTLEKILADAREFISMERWYNNAGIPHRRGYLLYGPPGTGKSSTIYALAGELGMEIYSLSLASDFVDDNFLQKASSSVPKNSIFLIEDVDCAFPSREDEDEKDKPRRGRRDEYRSFVTLSGLLNTLDGVGSEEGKLFFATTNHLDRLDPALIRPGRIDMKVEYKLATKGQASALFARFYSFKDDILPDSMHSVDEKKEHLTDGEITRLANAFAKAIPEHEFSTAEIQGYLLGFKKDPEQAAACVGEWVVAEQKRREEELQAEKEKKEKVKASKDSGQGVNGINGIVNGFPGPSASFSGRPLSSAGVAVSAAG

SEQ ID NO: 5914 - protein, 294 aa, Klebsiella pneumoniae
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 5915 - protein, 167 aa, Myxococcus xanthus DK 1622
MPRYFDGDFLPPKGRFAICVARFNGFITEELAKGAVDTLVRHGVADADIDVYRCPGTYELPGLVRRVTETRQYVGVITLGAVIRGGTPHFDYVAGECAKGIGAVAFEAAAATPAKTVTFGVLTTDTVEQAIDRAGVKAGNKGAEATLACIEMVNLYAKMSATDGRKA

SEQ ID NO: 5916 - protein, 308 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDN

SEQ ID NO: 5917 - protein, 364 aa, Acidovorax sp. JS42
MQQQRTHKIAVIAGDGIGKEVMPEGLRAVQAAARRFGLNLELHTFDWAHCDYYARHGQMMPDDWKAQLSGMDAIFFGAVGWPATVPDHISLWGSLLKFRREFDQYINLRPVRLFEGVPCPLAGRKPGDIDYYVVRENTEGEYTSLGGIMYEGTDREIVIQESVYSRHGANRLLKFAFDLAQSRPRKHVTLATKSNGIAISMPWWDQRADDVAKGYPEVTLDKQHIDILTARFVLQPGRFDVVAATNLFGDILSDLGPATTGTIGLAPSANLNPERTFPSLFEPVHGSAPDIYGQNIANPIAMIWSGALMLDFLTHGQGAGRQAHDAIVAAIEEIIKSGPRTPDLGGAASTTQVGEAIAARIAHG

SEQ ID NO: 5918 - protein, 1243 aa, Corynebacterium diphtheriae
MRRAPAVSSASTFGQNDWLVDEMFQQFQKDPQSVDKEWRDLFEKQGAPSTPGTEAKNTSPQPAAPAKKQPAPAKKPAPTTASAPASTEAKAAPKPENKKPAKKQQPSPLERTGELPAAGSSAIKGIYKAIAKNMDESLEVPTATTVRDMPVKLMWENRSIINEHLKRTTGGKVSFTHIIGYAVVKATMAHPDMNNYYEVVDGKPTLNTPEHINMGLAIDVQQKSGARALVVAAIKEAETLSFAEFVAKYEDIVARSRVGKLTMDDYSGVTISLTNPGGIGTRHSVPRLTKGQGAIIGVGSMDYPAEFAGASADRLAELGVGRLVTITSTYDHRIIQGAESGEFLRTMSQLFIDDAFWDEIFESIGIPYAPMRWASDLSNTGIDKNTRVMQLIEAYRSRGHLIADTNPLRWHQPGMPVPDHRDLDIATHGLTLWDLDRSFNVGGFGGKETMTLREVLGRLRAAYTLKVGSEYTHILDRDERLWLQDRIEAGMPKPSYAEQKYILQKLNAAQAFEDFLQTKYVGQKRFSLEGAEALIPLMDSAIDTAAGQGLDEVVIGMPHRGRLNVLVNIVGKPLATVFTEFEGHIEPKAAGGSGDVKYHLGAEGTHIQMFGDNEIKVSLAANPSHLEAVDPVMEGIARAKQDLLNKGDSTDGYSVVPMMLHGDAAFAGLGIVQETLNLAQLRGYTVGGTIHIIVNNQIGFTTTPDSGRSSHYATDLAKAYGCPVFHVNGDDPEAVVWVGRLATEYRRQFGKDVFIDMISYRRRGHNEADDPSMTQPEMYKLIDARNTVREQYKEDLLGRGELTTEDAEKVQRDFHDQMESIFNDVKETEKKPFEAQAGITSSQEVPHGLETNITREELVEIGQAYATAPENFEFHQRVAPVAKKRLEAAQNGGIDWGWGELIAFGSLAAGGKFVRLAGEDSRRGTFTQRHAVVYDPRTGEEFNGLNDLAERKGNGGKFLVYNSALTEYAGMGFEYGYSVGNEDAVVAWEAQFGDFANGAQTIIDEYISSGEAKWGQTSSVILLLPHGYEGQGPDHSSARIERYLQLCAEGTMTVAQPTTPANYFHLLRRHVLGGLKRPLVVFTPKSMLRMKAATSSVEDFTQMKKFQSVINDPRFVNGGLDKNKVKKIMLVSGKLYYDLAKRAQKDKRDDVAIVRIEMLHPIPFNRLKEAFDFYPNAEEIRFCQDEPANQGPWPFMHEHLPELIPGMLPMKRVSRRAQASTATGLSKVHAVEQQHLLDEAFAD

SEQ ID NO: 5919 - protein, 160 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGP

SEQ ID NO: 5920 - protein, 406 aa, Klebsiella pneumoniae subsp. pneumoniae MGH 78578
MATEQPAITRATFDEVILPIYAPAEFIPVKGKGSRVWDQQGKEYIDFAGGIAVTALGHCHPALVAALHQQGETLWHTSNVFTNEPALRLGRKLVEATFAERVVFMNSGTEANETAFKLARHYAVTRHSPYKTKIIAFHNAFHGRSLFTVSVGGQPKYSDGFGPKPADIVHVPFNDLQAVKAVMDDHTCAVVVEPIQGEGGVTAATPAFLQGLRELCDQHQALLVFDEVQCGMGRTGSLFAYMHYGVTPDILTSAKALGGGFPVSAMLTTHEIASAFHAGSHGSTYGGNPLACAVANAAFDLINTPAVLDGVSAKRELFVKHLQRLDAEFDLFSDIRGMGLLIGAELKPQHKGRARDFLYAAADAGVMVLNAGPDVMRFVPSLIIDEQDIAEGMARFAQAVAKVING

SEQ ID NO: 5921 - protein, 477 aa, Bradyrhizobium sp. ORS278
MDQSLKSPPVSALDDAFHAMVEASRSAPPPPLADRLDRLKRLRAMISDNEKQLEQAISADFGHRCAVETTIAETLFLQTETKHTMTMLPRWMAPRRIATSLQFFPARNRLIPQPLGVVGIIAPWNYPLQLTLAPAIGAIAAGNRVLIKPSELTPGFSALLKELVAAHFDPNDLTVTGIEDGIAQAFAALPFDHLVFTGSTRVGRIVAEAAGRNLTPVTLELGGKSPTIVDVSANIDEAAERIAYAKLMNAGQTCIAPDYVFVTEAQRDAFAGKVHGHMVRMFGTHPANGDYTSIISERHYQRLEGLLRDAIARGAKPLTVTSPEDPAWKKLRKFPPTVVVGATSDMAIMQEEIFGPLLPILSYRDADEAIRFINAHDRPLALYWFGTDEAARDKVLARTVSGGVTINDCLLHFAQMNQPMGGVGASGIGHYHGEWGFNSFSKLKPVFYRSPFNRMKDLYPPYGASVARIEKLLRFLS

SEQ ID NO: 5922 - protein, 149 aa, Dechloromonas aromatica RCB
MQVREILRVKGGTLYTVTPQQPLAVAIDSMADLDVGSLVVMEAGKMVGMLTFREVLLALRQHASSPDGITVGDVMVANPVTAFPDMEANDLRRLMIEKRSRYLPVIDGDTLMGVISFLDVAKAVLEEQSFENKMLKSYIKNWPSETPAA

SEQ ID NO: 5923 - protein, 490 aa, Rhodococcus sp. RHA1
MADRTSSTGSIGSEPGDGSGTGPAGEPHLSRQLANRHIQLIAIGGAIGTGLFMGSGKTISLAGPSVIFVYMIIGFMLFFVMRAMGELLLSNLHYKSFSDFTADLLGPWAGFFTGWTYWFCWIVTGIADIIAISGYVQYWWPDLQLWIPALVAIAALLLLNLPTVRAFGETEFWFALIKIIAIVSLIVVGLVMVFTHFTSPNGSEAGFDNLWNDGGMFPTGAMGFVAGFQIAVFAFVGIELVGTTAAEAKDPEKNLPKAINSIPIRILLFYVVSLIVIISVTPWREVVPGESPFTAMFTLAGLGIAAGVIQFVVLTSAASSANSGIYSTSRMVYGLAQEGDAPGRLGRLSSRKVPANALMFSCAFLLSAIALLFSGDSVIEAFTTVTTISSVLFMFVWTMILASYIVYRKRRPELHEASKFKMPGGVVMCWVVLAFFVFLIWALTQEADTLEALLVTPVWFVVLGIAWAVIRRRAPHRARYAAFKAELEDR

SEQ ID NO: 5924 - protein, 428 aa, Shigella flexneri 2a str. 301
MKLYNLKDHNEQVSFAQAVTQGLGKNQGLFFPHDLPEFSLTEIDEMLKLDFVTRNAKILSAFIGDEIPQEILEERVRAAFAFPAPVANVESDVGCLELFHGPTLAFKDFGGRFMAQMLTHIADDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSFGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFSALRKLMMNHQ

SEQ ID NO: 5925 - protein, 521 aa, Bacillus sp. MK 716
MLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRRPVN

SEQ ID NO: 5926 - protein, 157 aa, Brassica napus
  misc_feature (152)..(152): Xaa can be any naturally occurring amino acid
FGGEDGLPSILARHQIPGLDVVVDPCAAILVFIVTGFLCLGIKESTFAQGIVTAVNVCVLLFVIVAGSYLGFKTGWAGYELPTGFFPFGVDGMFAGAATVFFAFIGFDSLASTAEEVKNPQRDLPIGIGLALFLCCSLYMMVSIVIVGLVPXYAMDP

SEQ ID NO: 5927 - protein, 361 aa, Oceanobacter sp. RED65
MSDLQGQLEQAVKGYHDPYLGSDLFEAGAVKNLSAEDGIAKLDIFLEYPSEYLKAGIEQMLQIALENIEGIDSAEVTIDWAVSSHKAHENLPNIANVKNIIAVASGKGGVGKSTTSVNLALALAEDGAKVGILDADIYGPSVGMMLGMPEGTRPETVDDKYFKPVIAKGIQSMSMAYLVTDKTPMVWRGPMVSGALQQLITQTMWDDLDYLIIDMPPGTGDIQLTLSQKVPVSASVVVTTPQDIALLDAKKGIEMFRKVNIPVLGIIENMSIHICSNCGHAEHIFGEAGAEQIAAEYNTELLGSLPLSKYIREQSDIGEPPVAHDPASEVGMMYRHCARTMAAKLSQLSSQAVPDIQITDD

SEQ ID NO: 5928 - protein, 434 aa, Bacillus anthracis str. A2012
MFVVRPLGEIDISKNNLRRVDSLSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 5929 - protein, 454 aa, Zea mays
APYLQHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 5930 - protein, 549 aa, Rhodococcus rhodochrous
MNGQHPRSVVTAPDATTGTTSYDVVVVGAGIAGLYAIHRFRSQGLTVRAFEAASGVGGVWYWNRYPGARCDVESIDYSYSFSPELEQEWNWSEKYATQPEILAYLEHVADRFDLRRDIRFDTRVTSAVLDEEGLRWTVRTDRGDEVSARFLVVAAGPLSNANTPAFDGLDRFTGDIVHTARWPHDGVDFTGKRVGVIGTGSSGIQSIPIIAEQAEQLFVFQRSANYSIPAGNVPLDDATRAEQKANYAERRRLSRESGGGSPHRPHPKSALEVSEEERRAVYEERWKLGGVLFSKAFPDQLTDPAANDTARAFWEEKIRAVVDDPAVAELLTPKDHAIGAKRIVTDSGYYETYNRDNVELVDLRSTPIVGMDETGIVTTGAHYDLDMIVLATGFDAMTGSLDKLEIVGRGGRTLKETWAAGPRTYLGLGIDGFPNFFNLTGPGSPSVLANMVLHSELHVDWVADAIAYLDARGAAGIEGTPEAVADWVEECRNRAEASLLNSANSWYLGANIPGRPRVFMPFLGGFGVYREIITEVAESGYKGFAILEG

SEQ ID NO: 5931 - protein, 303 aa, Candida glabrata CBS 138
MAKDIEISTSEATFIVEALRQKQRLDGRRLDQFRDVQIEFGKEYGDVTVRMGKTLVQCRISCQITEPYEDRPFEGLFVISTEISPMAGPQFENGNSTGEDEVLCARIIEKAVRRSGALDVEGLCIVAGSKCWAVRADVHYLNCDGGFIDASCIAVMAALSHFRKPDISVHGEDVVVYPVDEREPVPLGILHIPICVTFSFFNPQDTEENIKGDSNAEISIIDATTKEELLRDGVLTVTLNKNREVVQVSKAGGLPMDALQLMQCCHKAYEITEQLTDMILKEVKHDLAKRDKYSSILSSENAR

SEQ ID NO: 5932 - protein, 156 aa, Yersinia pestis CO92
MNVIEGVVATPNARVAIAIARFNNFINDSLLDGAIDALKRIGQVSDDNITVVWVPGAYELPLVANVLAKTNRYDAVIALGTVIRGGTAHFEYVAGEASSGLSSVAMNSDIPVAFGVLTTESIEQAIERAGTKAGNKGAEAALTALEMINVIKAIKG

SEQ ID NO: 5933 - protein, 271 aa, Haemophilus influenzae R2846
MQHKLIAFIGGGNMAQAIILGLLKQGYPAEQIIVNDPNEEKRAFFANLGVATSENNVESVIKAEVVLLAVKPQMMAEVCSPLSAVDFSDKLLISIAAGISTERLNALIPSLKSIVRVMPNTPALVGEGMAGLFAPKNTSENYRTFAQDLLGAVGRTVWVNDETQMHAVTAASGSSPAYFFLMLEAMQKALIKMNIDEKTARELVQQAMLGAAKMVTENPQIALSTLRENVTSKGGTTAAALAVFDAQHFNQTIEQAMQACLSRSQEMETLF

SEQ ID NO: 5934 - protein, 340 aa, Glycine max
ASRCLKCGEHSGGEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVGVTVYDRHPEIGGLLTFGIPSFKLDKSLLARRREIFSAMGIHFELNCEVGKDVSLDSLLEQYDAVFVGVGTYRSMKAGLPNEDAPGVYDALAFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVP

SEQ ID NO: 5935 - protein, 294 aa, Candida glabrata CBS 138
MDLLSIEKFLCDLSVNQVGPIIKKKSGTQHVYDLKTGERAVDIVTAIDKQVEKLIWDSLKEQYPDFKFVGEESYVKGVTTITDDPTFIVDPIDGTTNFVHDFPFSCTSLGLTINKEPVVGVIYNPHLDLLISASKGNGIRINREPFDHKAKLESMGPLYLNKSVVALQPGSAREGNNFKTKMKTYESLLSCDEGFVHGFRNLGSTAMTLAYIATGNLDSYWDGGCYSWDVCAGWCILKEAGGIIVGANPGEWDIPIDNRSYLAVRGTTEEGGKELQKKYVDDFWKCVKGKLSYD

SEQ ID NO: 5936 - protein, 443 aa, Mycobacterium tuberculosis H37Rv
MRCSVFGTGYLGATHAVGMAQLGHEVVGVDIDPGKVAKLAGGDIPFYEPGLRKLLTDNLAAGRLRFTTDYDMAADFADVHFLGVGTPQKIGEYGADLRHVHAVIDALVPRLVRASILVGKSTVPVGTAAELGHRAGALAPRGVDVEIAWNPEFLREGFAVHDTLNPDRIVLGVQDDSTRAEVAVRELYAPLLAAGVPFLVTDLQTAELVKVSANAFLATKISFINAISEVCEAAGADVSQLADALGYDPRIGRQCLNAGLGFGGGCLPKDIRAFMARAGELGADQALTFLREVDSINMRRRTKMVELATTACGGSLLGANIAVLGAAFKPESDDVRDSPALNVAGQLQLNGATVHVYDPKALDNAHRLFPTLNYAVSVAEACERADAVLVLTEWREFIDLEPADLANRVRARVIVDGRNCLDVTRWRRAGWRVFRLGVPRLGH

SEQ ID NO: 5937 - protein, 580 aa, Oryza sativa Indica Group
MASLTPSLQDLLVSSLMILLVLLYIAYWRSKYQSLFPVDWPIVGLLPTLVANLHRLHDKITEYLAASGHSFTGNGPAASNMRLFVTCDPDNVRHIFTTNHDNYPKGHEFAEIFDIMAGAFFTMDGELYRRQRAKTHSILSDPRMVASMASSCADKVRDGLLPLLTSMASTRTPFELQDLATRLMFDVTAMPVFGVDPGRLSPDMPSMHVSAAMDTIMEVGLFRHTVPPSCWKAMRRLKIGPERKLAAAHAALHVFVSEMMEKARKQEAAPSSMSMDVLSSYINDPDYVGLLHSILITYMVAGRDTVGTTLPWFFYNLAMNPRVVSGIREELAHNIATSTCNGDGAPVMFSPEDTKSLVYLHAALFETLRLYPPGWIERKTVVADDVMPSGHEVRAGDAVLISIYSMGRMESLWGEDCRVYRPERWLYDSRGGRKMRHVPSHKFLSFNSGPRMCPGKNIAVMQMKIIAAAVVWNFDLEVVEGQAVVPKLSCLLQMKNGVMVKIAQNFQAMTMIMHDEIAQQVNDKAEQALIVPQVGMDFDFIPFTMLLNCTLLLPSGLCSPSPTQPLRPPPKAPDARGQER

SEQ ID NO: 5938 - protein, 329 aa, Oryza sativa
  misc_feature (126)..(126): Xaa can be any naturally occurring amino acid
MAVRVPSMELHRPPPSVSGVRGKSCLQKPFLVQAKRLEGLEKANPRSRRKQSLEQVKKRAPLIRGTVSPPLPLPGHITQPPYVGKKDASEIASEIQMHDKVSIIRMKAACELAARVLEYAGTLVKXHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQRNNMPGQMVEGQTFTIEPALSMGSIDCDMWDDGWTAVTTDGSLAAQFEHTILITKTGAEILTKC

SEQ ID NO: 5939 - protein, 408 aa, Listeria monocytogenes EGD-e
MIDIQKIRADFPILAQEINEKPLAYLDNAATSQKPKQVIEALTHYYEFDNANVHRGVHTLAARATDAYESARGKVAKFIHAREVAEIIFTRGTTSAINLVVDSYAEANIEAGDEIVISYLEHHSNLIPWQQLAKRKGAVLKYIELEEDGTISVEQAKKTIGEKTKIVALAHVSNVLGTITPIKEIAAIAHQFGAVILVDGAQAVPHMEVDVVDLDADFYAFSGHKMMAPTGIGALYGKRELLDAMEPTEFGGEMIDFVELYDSTWKELPWKFEAGTPIIGGAIALGAAIDYLAEVGLENIHAHEQALASYAMEEMSKIEGITIYGPKDASKRCGLVTFNLEGAHPHDIATILDEDGVAIRAGHHCAQPLMKWLDVSSTARASFYIYNTKEEIDALIDGLKLTKEYFGL

SEQ ID NO: 5940 - protein, 248 aa, Oryza sativa
  misc_feature (148)..(148): Xaa can be any naturally occurring amino acid
  misc_feature (177)..(177): Xaa can be any naturally occurring amino acid
  misc_feature (197)..(197): Xaa can be any naturally occurring amino acid
LSLSFLLNHPFYRFTHQNLPACKPAMTPRCVITIFLMIGVTFVPVGLVCLHASNHVAEIAHRYDIDCVPNAYKRNTQAYIKDSSISKNCAQDVKVKYLMRAPIYVYYELDNFYQNHRRYVKRRSDKHIRYWHKYTHSSCDPIVRNDGXLPIAPCGLIAWTLSMTLYDLPRGSTELRXNRKNIHGKVTRGRSLARMYXPLNFGKGSLIGGGKTWPLFYPWTQKEKIYWGGVASGLVFSPNFKKSFWGGH

SEQ ID NO: 5941 - protein, 155 aa, Aquilegia formosa
GLEIQGKFVKFTAIGVYLEEQKAISSLAVKWNGKSAEELTDSIEFFRDIVTGPFEKFIMVTMILPLTGQQYSDKVVENCVAAWKAWIYTEAESKAVEEFIQVFKDETFPPGSSILFTQSSPALTIGFSKDGSIPKEGKATIANKPLSEAVLESII

SEQ ID NO: 5942 - protein, 109 aa, Glycine max
ILWNGLLGVFKFAKVAVGTAAKAAYLAVLSGKGVTPIIEAADSVAAVEKVGVVSLISPVSVGGVASLELLEVKEVPGFLASVPAVPVAVYYIFQVVNFFLPGVSVLSFL

SEQ ID NO: 5943 - protein, 267 aa, Glycine max
VRLAVPVRIPGSTHASASLVVSGMSVISLVSLANAGFSEIRGKHLNYSKFWNANPSAEKQVKLSSKAGMLLLYTPAFLAGLASFWIFPHQGLRSTLLQSAVTLHFFKRVFEVVFIHKYSGAMLLDSAIPITLSYFLSTATMIYAQHLTQGLPEPPIDLLYPGIVLFVVGIIGNFYHHYLLSNLRGKGEKEYKIPKGGMFELVICPHYLFEIIEFYGFSFISQTLYAFSFTVGTTLYLLGRSYSTRKWYLSKFEDFPEHVKAIIPFVF

SEQ ID NO: 5944 - protein, 225 aa, Klebsiella pneumoniae subsp. pneumoniae MGH 78578
MKQYLIAPSILSADFARLGEDTAKALAAGADVVHFDVMDNHYVPNLTIGPMVLKSLRNYGITAPIDVHLMVKPVDRIIPDFAEAGASIITFHPEASEHVDRSLQLIKEHGCKAGLVFNPATPLSYLDYVMDKLDVILLMSVNPGFGGQSFIPQTLDKLREVRQRIDASGYDIRLEVDGGVKASNIGEIAAAGADMFVAGSAIFGQPDYKQVIDQMRSELAKVSHG

SEQ ID NO: 5945 - protein, 495 aa, Glycine max
MAAMQRPLKRTIAIAKLRACFSSLRPAAAADIVASPPPQLPPFDHQPHPYNGPFADEVLAKRKTFLGPSVFHYYKKPCRCVSDQAKIYGFSKCSSVKLNIVEGKMQYLYDDSGRRYLDAFAGIVTVSCGHCHPEILNAITEQSKLLQHATTIYLHHTIGDFAESLAAKMPGNLKVVYFVNSGSEANELAMMMARLYTGSLGMISLRNAYHGGSSSTLGLTALNTWKYPIPEGHVHHVMNPDPYRGAFGADAASYANDVQDHIDYGTSGKVAGFIAETMQGVGGAVELAPGYLKLVYDIIHKAGGVCIADEVQTGFGRTGSHYWGFETQGVIPDIVTMAKGIGNGLPLGAVVTTPEIASVLAQKIQFNTFGGNPVCSAGGLAVLRVLDKEKRQAHCADVGSHLLERLRFLMERHDIIGNVRGRGLMVGIELVTDRDNKTPAKAETAVVFEKLRELGVLVGKGGLHGNVFRIKPPMCFSKDDADFLVDALDYSLSKL

SEQ ID NO: 5946 - protein, 692 aa, Myxococcus xanthus DK 1622
MELSSLESSFWAIAPGVVGAVGLLFAAVFYFRVKALPEGDATMNRIAGYIRDGAMAFLVREYKVLAAYCAVIAVLIGLALGPLASGSFVLGAFLSLLAGYIGMKAATFANVRTAQAARTGSKPNALLVALDGGAVMGLAVAGLGLIGMGGVYYAFQGHPQLSPVLHSFAVGASSIALFARVGGGIYTKAADVGSDIAGKVIENIPEDDPRNPGVIADNVGDNVGDVAGMGADIYESMVAAIVAAMAIALTASAADLSRLVVDPSAIGSAKVAGVVIPLVLSAVGLVVSLLSIFIARALKHMNPAQVLRSALILPPVILVGLSFVMMQVFGLSQAITVALAAGAFGGAIIGLVTDYYTSSTPVQRIAEASVTGAGTNLIRGLAVGMESVGIPMATIAVVAYIADQALGLYGIALAAVGMLGGTAVVMTVDAYGPISDNAGGISEMSGLGPEVRAITDELDAVGNTTAAIGKGFAIGSATLTVIALFSAFNLEVNHTRIAAGLPEMSLQLTNPNVIVGLLLGSILPFLVGASTMLAVGRAAGAIVEEIGRQFREIPGLMELKADPDPKKIVDIATKSALQEMVFPGIIAVAAPPLVGYLLGPGALAGLLAGSLVVGATMALYMANAGGAWDNAKKFIEKGKLPGHAKGSAVHKAAVVGDMVGDPFKDTSGPGVAILIKVMSVVSLLVASLIALR

SEQ ID NO: 5947 - protein, 219 aa, Chlamydomonas reinhardtii
MPLIYAFVARGTTVLAEYTPYSGNFNTVAIECLQKLANPEPKFTIACDRHTFNFLVANGFTYLVVADEAYGRQIPFAFLERVRDEFEEKYAEKARTAAALSMDRTFGPRLKSHMEYCMDHPEEISKIAAVQKKVNEVKDVMVENIEKVLERGEKIELLVDKTDDLRNQAEQFQKKGRQLRNKMWWQNCRMKLIVLFAILLLAVVIFLLVCFTGGKNCTK

SEQ ID NO: 5948 - protein, 227 aa, Zea mays
  misc_feature (166)..(166): Xaa can be any naturally occurring amino acid
MRLYTPPSKEDEVLATTPNRCLMNCFILTQSCFSPPVSCSWDAVMQRQPWPPPMQSNRVVSITDRHTEEASPVRKLVAEIIGVLGSKHMRTVTPLPDTGQWLLLSLIEKLPQSVVDLLRAHVINLHHYLMLFSLLGFSVLFDCIKAPDSNAICRGITQDMTYAAVXAYTDAYKPDWERINFIVDILRSTPGEGPSWYHLLKKVSGGCNDLKNNEHIACCCPYQTASY

SEQ ID NO: 5949 - protein, 179 aa, Oryza sativa
  misc_feature (107)..(107): Xaa can be any naturally occurring amino acid
HVVASVDHVNAPLLWDKKMVHTQFKWSWYHVPTFAPYKVEGVFYPLILASGGHAQTMKTALVVLQSLTPNAQSVFRVLAEYQLAHEKEEGKFVADLFSYDFLLFTNXTLLHCLPGMHFSSLYTKCRERFLVSSQVTLNSHLTEFKDHDLVKIRKHSDGQDCLHIPLVSDALEKLLQELT

SEQ ID NO: 5950 - protein, 516 aa, Zea mays
MASSDLAESLLPGGGGGASASHDEYEERAYDSEDKISIAVSDSDGEDDGTPASRPPFSWRKLWRFTGPGFLMCIAFLDPGNLEGDLQAGAAAGYQLLWLLLWATIMGALMQLLSARLGVATGKHLAELCRQEYPPWATRALWAMTELALVGADIQEVIGSAIAIKILSGGAIPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVLEAVYYYNIESILALIVSFFINICVTTVFAKGFYGSKQADSIGLENAGQYLQEKYGTAFFPILYIWAVGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKVISWIVTVFLMLINGYLILSFYITDVRGALLRSSLCVVLVVYLAFIVYLIVRNTSLYSRLCSSTSKSS

SEQ ID NO: 5951 - protein, 501 aa, Novosphingobium aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 5952 - protein, 474 aa, Pyrococcus abyssi GE5
MPKLIKERVPTPERSVEERIRDFNEVNLGYTWELALREAERCLQCPKEYAPCIKGCPVNIDIPGFIRALRENRDDPDKAVREALKIIWDSNSLPAITGRVCPQEDQCEGVCVVGKVGDPVNIGKLERFVADYARQHGIEDELLEEQIRGIKRNGKRVAVIGAGPAGLTCAAELAKMGYEVTIFEALHEPGGVLAYGIPEFRLPKEIVKKEVEKLKRLGVKIETNVLVGKTVTFEELREEFDAIFIGTGAGTPRIYPWPGVNLNGIYSANEFLTRINLMKAYKFPEYDTPIKIGKRVAVIGAGNTAMDAARSALRLGAEVWILYRRTRKEMTAREEEIKHAEEEGVKFMFLVSPKRFIGDENGNLKAIELEKMKLGEPDETGRRRPIPTGETFVMEFDTAIIAIGQTPNKTFLQTVPELKVDEKGRIIVDENLMTSIPGVFAGGDAIRGEATVILAMGDGRKAAKAIHKYLSSSS

SEQ ID NO: 5953 - protein, 541 aa, Candida glabrata CBS 138
MPVARESSRNSLSQMFLREESEELPMIATSSRMQNLIRIGKKYARFIGPGLMVSVSYMDPGNYSTAVAAGSAHKYKLLFSMFVSNLMAGFLQCLCARLGAVTGLDLAQNCKKHLPYGLNITLYILAEIAIIATDLAEVVGTAISLNILLGIPLPIGVVLTVIDVLIVLMAYKPNGDLKLIRYFELFVSFLVICTVICFAIELFYVKLGPASDIFKGFLPSKAVIEGDGLYLSLAILGATAMPHSLYLGSGVVQPRLRDYDIKHGYYSPDELDIDNNHQDYKPSLESVQETLHYTVAELLVSLFTIALFVNCAILIVSGATLFETPQDADIADLFSIYELLSNTLSKSAGTIFALALLFSGQSAGIVCTLSGQIVSEGFLNWTIAPALRRSLTRAVAITPCLILVMVSGRSGLSNSLYASQVVLSVLLPFVSAPLLYFTSNKNIMRIEMIDRKLPATSIFSTPGNVEQNKKKYGKVRLDEDEEEVIPLQDMETETETDQSQHQDQNIEYKDMSNSTFVNILAVTVWLLISGLNLYMLKNLDK

SEQ ID NO: 5954 - protein, 485 aa, Oryza sativa Japonica Group
MAYQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTARGGAGAVAGDRTPGEAERVARERRSTAASPGGSASATPTWTTRPWRSRSAGSTTSCASTSSAGSRPSAGPPIGSSASACRTTTTSAQPISPVHWRSCRRSPRWFAPPAD

SEQ ID NO: 5955 - protein, 353 aa, Physcomitrella patens subsp. patens
MSNARVTLQELVENGHLNTVPDDFLVSEEDRVKLEDGSCSLELPVIDMAGIEGERRGLVVQQIRSACKEWGFFQVKDHGVPLSLMKKMQQELRQFFDLSYEEKSKIRAKTVGDSLPDEGYSDRMSHKEGRSSNWSDKLRLYTLPVSGRRYELWPTHPPSFRETVEAYAEETDKLMRRILELISDSLELETSHLNDYFSGKYQQVYQVNYYPSCPQPDVTMGLRKHSDNNVLTLVLQDGNPGLQVRKDGQWITVKPVEGWFVVNVADQIELLSNGRYRSVEHRVFVSSKPRISLATFHAPTNDTVVGPIPELLGPKERPRYKACLFSEFKESFYYAGWAKALTGKGHLDHLLVV

SEQ ID NO: 5956 - protein, 200 aa, Yersinia pestis CO92
MVLVTRQAPDFTAAAVLGNGEIVENFNLKKHLNGRPAVLFFWPMDFTFVCPSELIAFDHRYEEFQKRGVEVVGVSFDSEFVHNAWRKTPVDKGGIGEVKYPMVADIKREIQKAYGIEHPDAGVALRGSFLIDKNGIVRSQIVNDLPIGRNIDEMIRTVDALQFHEEHGEVCPAQWEKGKAGMGASPDGVAKYLSENASKL

SEQ ID NO: 5957 - protein, 671 aa, Physcomitrella patens subsp. patens
MAEVKQLLSLIIDTFKSSESQALVGNPSEVDEWLSYASSFGVGSEFEGACAYANSYLAFRTYFVGNDLTVADITIVAYLAKAGPRWESFRKTAKFPNLVRWYNCILVQYPAIANVLPSRGAGKPAPEVSKSSSAAAVSAEAKEKVDGSFEVDLPGAEMGKVCTRFPPEPSGYLHIGHAKAALLNQFFAQKYKGRLIIRFDDTNPAKEKDEFVESILQDLDTLGVKGDVITYTSDYFPQLMEMCEKLIKEGKAYVDDTEREQMQLERKAMIESKCRNQTVEENLKLWKEMIAGSTRGVQCCVRAKMDMSNPNASLRDPVYYRCNPTPHHRVGSKYKVYPTYDFACPFVDSIEGVTHALRSSEYHDRNDQYYRVLEDMQLRKVHVWDFSRLNFVYTLLSKRKLQWFVDNGRVEGWYDPRFPTVQGIIRRGLTIEALKQFILSQGASKNLNLMEWDKLWTINKKIIDPVCPRHTAVLSEGKVLLDLSNGPETPFTRVILRHKKYEPAGKKATVFTKKIWLDHADANAVSKGEEVTLMDWGNCFIRIVERDQYGLVTRLQGELHVEGSVKTTKLKLTWLPETSELVPLTLVDLDHLIVKKKLEENDDFVSVLNPVTRIESAAVGDSNMRNLQRGEIIQLERKGYFICDVPFVRSSKPIVLISIPDGRQQKPPGQQ

SEQ ID NO: 5958 - protein, 332 aa, Candida glabrata CBS 138
MVRVAINGFGRIGRIVLRIAMKRDGIDVVAINDPFITNDYAAYMFKYDSTHGRYDGEVTHDDKDLIIDGKAIKCYQERDPADLPWGDNDIDIVIEATGVFTAKDLAEKHITAGAKKVVITGPSATAPMFVKGVNDDKYTSDVTVISNASCTTNCLAPLAKVLQDNFGIEEALMSTVHSQTATQKTVDGPSKKDWRGGRTASANIIPSSTGAAKAVTKVLPELEGKLTGMAFRVPTVDVSVVDLTVRFAKDVTYDEIKAAIKKASEGEMKGILAYTEDAVVSTDFLGDTHSSIFDASAGIQLSPRFVKLVSWYDNEYGFSARVVDMVELVSKA

SEQ ID NO: 5959 - protein, 266 aa, Clostridium perfringens SM101
MNKKIGFIGCGNMGSAMVLGILKSGIVCKENIIASCSRESSAERIKNELGINTTLDNKEVCNNSDIIFLAVKPYMYEKVIKEIRDCVDLNKTIVTIAAGINLSDVEKWFKKETKIVKTMPNTPALVGEAMSAICPNELVNEEELKEVMDIFNAFGKSEVLSEKDFHGFIALCGSSPAYVYMFIEAMADAAVREGISRDKAYKLAAQSVLGSAKMVLETGEHPAKLKDNVCSPGGTTIEAVLELEETGFRSSVMSAMKKCSKKSKKM

SEQ ID NO: 5960 - protein, 467 aa, Clostridium perfringens SM101
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDIIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 5961 - protein, 219 aa, Gloeobacter violaceus PCC 7421
MALLVMVRHGQSIWNLENRFTGWTDVPLTEKGRAEARACGELIYCVPFAVAFTSKLTRAQDTLRLILEAADQPDVPVIEDQALNERHYGELQGLNKAETAAKYGEETVRQWRRSLEGRPPGGESLKDTALRSLRYFYEKIVPELEAGKNVLVSAHGNTIRAILMELDHLSPEQVEKVEIEYCVPVAFEHQADGTFSQVLMPRCDIIRPPQPPARSIARL

SEQ ID NO: 5962 - protein, 608 aa, Oryza sativa Indica Group
MAIPGAYAHAVQALATGILFVVVSLVLDHVEGRHHKCPSFSCGRLKGVSAPFRRAADPPGCGSKSYELVCSDTNATILIDNATYHVNEIDYDYKRFWVVDANIAGSTCPLPRWNHLLDQYKRKVSGHRIEFELAPGAYNHAYFVRCSREVKDNGIYRPVTCASSNYSFIYVLLSSDSDNPGYIESLEPSCGYLAMTPLGDWRSTTVPRNASYEDVKKFMRGGFTVRFPVNYGAGNIKECLMDSISLSRLLLTPVHCMHYAVLCRFVLVPLAILTFLAHKYWKTRLAIDAVEKFLQMQQVLGPTRYAYTDLTAVTSHFRDKLGQGGYGSVYKGVLLSGDVHVAVKMLNGTSTYDGEEFISEVSTIGRIHHVNVVRLVGFCSEELRRALVYEYMPQGSLDKYIFSSERSFSWDKLNEIAIGIARGINYLHQGCDMQILHFDIKPHNILLDDNFVPKVADFGLAKLYPRNKSFVSDRALRGTVGYIAPEMVSRSFGVISSKCDVYSFGMLLLEMAGGRRNADPNTNPNASQSYYPSWVYGQLTGEQVGETSGAADMHELQKKLCLVGLWCIQMKSHDRPTMSETIEMLEGDVNALQVPPRPFFCDGVLCLM

SEQ ID NO: 5963 - protein, 657 aa, Oryza sativa Indica Group
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHTSEVASVVGCSRDSIDTNQYGIVGPTSCPSLANNASQFWYLAYPYDNMSILPLGCTIVSKDIPMPYSYDKNGPNFDISIFTETAKRVISTGETVFTWYQVTVTSICQQCEREGRRCGFSSQRESSILPASYVNRVETRTYPSYTTLVRKLCTCIFPAMLCKIIESGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPPAENQNEFYFPEWVFERVMNGQDLVLTMETTQGEKEMVRQLAIVALWCIQWNPKDRPSMTKVVNMLTGRLQNLQVPPKPFISSQNQLVI

SEQ ID NO: 5964 - protein, 63 aa, Zea mays
EPCMDPLAPHMGKYKALGCLSEGLGFFPAPGMAAVVNARASNIPYPPKVSPSATFKVGFGDSP

SEQ ID NO: 5965 - protein, 92 aa, Zea mays
  misc_feature (31)..(31): Xaa can be any naturally occurring amino acid
  misc_feature (58)..(58): Xaa can be any naturally occurring amino acid
GRVGGLVGGRVGADAYLFGGPIFNDYSCVGXSLLLKREKAGIEQPDRMEVGDGQQIGXIHMPEFLRALAKRLMRNSTEYDNYRRIIVLDREP

SEQ ID NO: 5966 - protein, 716 aa, Brucella melitensis 16M
MGMAVLVLVIACGVLSVLFAIWAIRSVLAADQGTQRMQEIAEAIREGASAYLTRQYSTIAIVGIVVFLLAWYLLSLNAAMGFLIGAVLSGVTGFIGMHVSVRANVRTAQAASLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIAGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 5967 - protein, 354 aa, Nicotiana tabacum
DPHTVDVDGKLYSAKNILISVGGRPFIPDIPGSEYAIDSDAALDLPTKPNKIAIVGGGYIALEFAGIFNGLKSEVHVFIRQKKVLRGFDEEIRDFVGEQMSLRGIEFHTEESPQAIIKSADGSLSLKTSRGTVEGFSHIMFATGRRPNTKNLGLETVGVKMTKNGAIEVDEYSRTSVPSIWAVGDVTDRINLTPVALMEGGALAKTIFADEPTKPDYRNVPAAVFSQPPIGQVGLMEEQAIKEFGDVDVYTANFRPLKATISGLPDRVFMKLIVCAKTSKVLGLHMCGDDAPEIVQGFAIAVKAGLTKADFDSTVGIHPTSAEEFVTMRTPTRKVRSSPSEGKAEHDIKAAAGV

SEQ ID NO: 5968 - protein, 164 aa, Brassica napus
  misc_feature (157)..(157): Xaa can be any naturally occurring amino acid
MAEQQQQEDHHKELQLLPSPPSTESRVRKLRPTVITTDHHHSPSMIHQDLDLKLSISLSTIPTATVEHLSDGGGGVGGVEALKWQAAEQIRLAAIEKAYAERVRELTRREMEMAQAEFARARVMWQKAREEVERAERLKERSMTKIDTTCLEITCHXCRQRFRP

SEQ ID NO: 5969 - protein, 252 aa, Vitis vinifera
MAINICSETSPRISFSNDFCQADVASIDHCKSRNSELSSLDSSPDFDFCVSTSFEHESSSADELFSNGIILPIKIQERTVAPRSVASLPPLPSPSTNESLKKESSKGIAVSSCESQEKLQSSKSFWPFKRSSSLNCDNVHRRSLMCSLPLLSRSNSTGSVQNSKRTSKQNSQKQPSMAKSSSSSSSASSTNFYTYPVPQKPPLKKNYGGSYGNGVWISPVINVSPAYISKGTANLFGLGSLFRNGKEKKSKK

SEQ ID NO: 5970 - protein, 505 aa, Novosphingobium aromaticivorans
MASGQLRYYAPMTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 5971 - protein, 116 aa, Zea mays
MAASLLHAAAASLQSSTQHARAGAAAFHPRDRHVVAALAGEQTEGSEVGDDRNGEIKPEEAQEIWKVMLEQFKAEALRMQALSMQAYDVYSERMREVLLEASEKLKIQADKAQKDL

SEQ ID NO: 5972 - protein, 304 aa, Shigella flexneri 2a str. 301
MRLPIFLDTDPGIDDAVAIAAAIFAPELDLQLMTTVAGNVSVEKTTRNALQLLHFWNAEIPLAQGAAVPLVRAPRDAASVHGESGMAGYDFVEHNRKPLGIPAFLAIRDALMRAPEPVTLVAIGPLTNIALLLLQCPECKPYIRRLVIMGGSAGRGNCTPNAEFNIAADPEAAACVFRSGIEIVMCGLDVTNQAILTPDYLATLPELNRTGKMLHALFSHYRSGSMQSGLRMHDLCAIAWLVRPDLFTLKPCFVAVETQGEFTSGTTVVDIDGCLGKPANVQVALDLNVKGFQQWVAEVLALVP

SEQ ID NO: 5973 - protein, 139 aa, Zea mays
MPRTTVVESSGCPPLRALTTDILGLVKVVEAHARPAGAAKVVETWGAPDASRAIVAASLADRAADPVLAVARRNGVVRLYDTALQRRPAVSVDFRESPIKAVAADPNGHDVYIGTGTGDLASFDMRTGLSEAAPYNGGP

SEQ ID NO: 5974 - protein, 413 aa, Pyrococcus abyssi GE5
MKAVILAGGFGTRLRPISSTRPKPMVPVLGKPNLQYILEALEKVKEIDEVILSVHYMRGEIREFIQEKMRDYPKDIRFVNDPMPLETGGALKNVEEYVSDDFLVIYGDVFTNFDYSELIEAHKKNDGLVTVALTKVYDPERFGVVITDEEGKIVEFEEKPRKPKTNLVDAGIYMVNKDVLKEIPKNKEVYFEREILPKFVSQGLVYGYKMPKHYYWVDLGTPEDFFYAHQIALDEMARENGYMILGENVEIPEDVEVQGPVYIDDNAKIGHGVKIKAYTYIGPNTMIEDKAYIKRAILLGNDIIKERAELKDTILGEGVVVGKNVIIKENAVIGDYAKIYDNLVIYGAKVLPWKKVEEYEAYIRIKLDPAKVRPELTPDRCPLGLPECIYKKFKAIAGEKPPCDECIENQWLF

SEQ ID NO: 5975 - protein, 463 aa, Yersinia pestis CO92
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 5976 - protein, 135 aa, Brassica juncea
MASSMLSLGWTSLLPREINKDKLKLGPSGSNPFLRTKSLSRVTMSVSVKPSRFEGITMAPPDPILGVSEAFKADTNELKLNLGVGAYRTEELQPYVLNVVKKAENLMLERGDNKEYLPIEGLAAFNKATAELLFG

SEQ ID NO: 5977 - protein, 287 aa, Bacillus cereus ATCC 10987
MSCILYERNQSAILQASSRTKINMIQSGKIYIRGRTVVFMIIRNEQDLEGLRKIGRIVALAREEMKKEAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVKAGSKQNQIGRAVSNFAHKNGYNVIQNLTGHGIGLSLHEAPNHILSYFDPMDNALLKDGLVIAVEPFISMKADHIIERGDDGWTFVTPDKSLVAQCEHTVVVTRGEPIILTEI

SEQ ID NO: 5978 - protein, 377 aa, Candida albicans SC5314
MSTTEQSLQSKTAVLCSFYTKIGSCRHGEECSKKHLKPTITKTILLPNLYQNPRFDLVEYLSRNRKQHRVKKRKTGDKNSDDIAEINLETKDDVKDNEEKANVDGENKEHDETKEIESEDVISKDKEEVIVDRSGIAQQDKQKESNKKGKQEGESEKEEPNKESTEEELPPQGVTQEVPNHNQEESPIKQEQTAAKQEKHGLDENHPVLTDEQIQKDFDLFYQDIFVHVAKLGQINDMAVCENENHLSGHVYIKFNDYNDAIAANLQLNQEWYNGKPVYSELSPVNILADAHCKSWDHGHCDRGAKCNYLHVKQPTQGIKKSLWDSQTKTYTLKKLEMLKKEVPEEIMSGASSDNVNKVNTKDIEIRSTMALLESMF

SEQ ID NO: 5979 - protein, 269 aa, Glycine max
MEVGSVVLVWWWISLIPRILSDPSDEACLTNLSKSLEDPNKLLHNWKEENFAKPCNDSSSNLRGAICNNGRIYKLSLNNLSLRGTISPFLSNCTNLQTLDLSSNFLTGPIPPELQSLVNLAVLNLSSNSLQGVIPPVLTMCAYLNIIDLHDNLLTGPIPQQLGLLVRLSAFDVSNNRLSGPIPASLSNRSGNLPRFNASSFLENKDLYGYPLPPLRNRGLSVLAIVGIGLGSGLASLVLSFTGVCIWLKFTERKMALEEGKISHLMPDY

SEQ ID NO: 5980 - protein, 574 aa, Oryza sativa
MNARRLHKWAATARLVLLLLAAAAAAAAAAAGRREVVTSPHGAVAADDGRCSRIGRDALRDGGNAVDAAVAASLCLGVVSPASSGVGGGAFMLVRLADGTALAYDSRETAPLAASQDMYGGNETLKARGALSIAVPGEIAGLYEAWKRHGKLPWKRLVMPAAKLARAFRVSPYLRKQMEATRDGILQNKGISGVYTSNGDILNVGDVCRNIRLARTLVAVAEKGPDVFYKGAVGDQLAKDIQEVGGIITMEDLKKYQVKIRRPLLENVLGLTVLSMPPPSAGGAGLMLVLNILTQYGLPAGFSGSLGIHRLIESLKHYFAIRMNLGDPEFVNVNEVVSDMMSPKFAADLKKTIYDNMTFDPKHYGGRWNILQDHGTSHLSIVDSERNAVSMTTTVNAYFGSLILSPSTGILLNNEMDDFSMPANTSANSPPPAPANFVRPLKRPLSSMTPTIILKDGNLKAAVGASGGSMIPAGTMEVLLNHFVKNMDPLSSVMAPRVYHQLIPNVVQYENWTTVTGDHFELDAATRADLRRKGHVLEPLAGGTISQLVVDDVERHGGLTAVSDPRKGGFPAGY

SEQ ID NO: 5981 - protein, 467 aa, Listeria monocytogenes EGD-e
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNETNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTAIYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 5982 - protein, 464 aa, Brucella melitensis 16M
MTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVNGKKIEG

SEQ ID NO: 5983 - protein, 323 aa, Arabidopsis thaliana
MVAILCLWALSATSEAVTEAEPGLMMNFYKDTCPQAEDIVREQVKLLYKRHKNTAFSWLRNIFHDCAVESCDASLLLDSTRRELGEKEHDRSFGLRNFRYIEEIKEALERECPGVVSCSDILVLSAREGIEAVGGPYIPLKTGRRDGLKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKNH

SEQ ID NO: 5984 - protein, 209 aa, Brucella melitensis 16M
MRDPIETVMNLVPMVVEQTNRGERAYDIFSRLLKERIIFVNGPVEDGMSMLVCAQLLFLEAENPKKEINMYINSPGGVVTSGMAIYDTMQFIRPPVSTLCMGQAASMGSLLLTAGATGHRYALLNARIMVHQPSGGFQGQASDIERHAQDIIKMKRRLNEIYVKHTGRDYDTIERTLDRDHFMTAQEALEFGLIDKVVEARDVSADESK

SEQ ID NO: 5985 - protein, 409 aa, Brucella melitensis 16M
MQAQSLAEVTVISKAAAVIVAAGRGERAGQSAEGPKQYRLIGAEAVLARTLRAFTDCPLIGTIAVVIHPDDHALYRRAVPEKHENVILVTGGPTRQESTRLGLLALKDEAPQYVLIHDGVRPFIGQDLLERIIANLTPDNGVLPALAVSDTLKRAAADGMVETTISRTGLFAAQTPQAFPYAPILDAHEKAFAINRTDFTDDAAIAEWQEIAVRIIEGSADNTKLTWAKDIEMADKRLRQDHAVFPDIRTGNGYDVHSFEPGDHVTLCGVKIPHEAKLNGHSDADVALHALTDALLATRGAGDIGTHFPPSDPQWKGAASRIFIEHAAKIVREAGGRIANVDVTLISEAPKIGPHRAAMTQALCDMLGIAADRVSIKATTNEKLGFVGRREGIAAIATATVIYPGEVPE

SEQ ID NO: 5986 - protein, 70 aa, Vitis vinifera
MAAAAAVAASAGPAMALVDERLSTEGTGLPFGLSNNLLGWILFGVFGLIWALYFTYTATLEEDDESGLSL

SEQ ID NO: 5987 - protein, 515 aa, Vibrio fischeri ES114
MNNENKTHIADSVLDVIVVGGGINGAGIAADAAGRGLTVGLYEASDFASATSSASSKLIHGGLRYLEHYEFRLVSEALAEREVLLAKAPHIAKPMRFRLPHRPFLRPAWMIRAGLFLYDNLGKRTTLPASHSVDLAASGLLKSEITKGFEYSDCWVDDARLVILNAMAAEKNGAEVKNYCRVEKAIRVDNIWHVTVFDVQANVRFERKARALVNAAGPWVKQFFDDSLEDESPRNIRLVKGSHIVVPKIHNEEQAYILQNKDNRIVFVIPYMEDFSIIGTTDVEYKGDPRKVEISEEEVNYLIDVVNQHFVDQIKRDDVVWTYSGVRPLCDDESDSPQAITRDYTLELEQELDQAPLLSIFGGKLTTYRKLGETAMKMLNPYFAKMGTPWTRNVALPGGDFDYPRHQLVDNICCKHPWLAKETVTRYVNQFGTLTWTLLEGIECQSDMGELFAQGVYQAEIDYLIKHEFAKNAEDVLWRRTKLGLYLTEEEEKQIALYIESYLSHRHKVKLQNVI

SEQ ID NO: 5988 - protein, 304 aa, Oryza sativa Japonica Group
MATALYLSLKSRYDEEVHLKVEMFLRTYGTSKPTRYSFSDVKKITRCFKEQLGQGGFGSVNIVRLLGFCSEGTRHILIYEFMPNESLEKYIFFHDPNTSQELLAPKKMLDIALGIARGMEYLHQGCNQRILHFDIKPHNILLDYNFNLKISDFGLAKLCARDQSIVTLTKARGTMGYIAPELYSRNFGEISYKSDVYSFGMLVLEMVSGRRNSDPSIEDQNEVYFLEWIYEKVITGQDFVLSGEMTEEDRLKVRQMALVALWCIQWNPRNRPSMTKVVNMLTGRLQNIQVPPKPFVSYESHAVP

SEQ ID NO: 5989 - protein, 203 aa, Shigella flexneri 2a str. 301
MERTLTTVSYYAFEGLIPVVHPTAFVHPSAVLIGDVIVGAGVYIGPLASLRGDYGRLIVQAGANIQDGCIMHGYCDTDTIVGENGHIGHGAILHGCVIGRDALVGMNSVIMDGAVIGEESIVAAMSFVKAGFSGEKRQLLMGTPARAVRSVSDDELHWKRLNTKEYQDLVGRCHASLHETQPLRQMEENRPRLQGTTDVTPKR

SEQ ID NO: 5990 - protein, 169 aa, Zea mays
MMSRERKKAAAALQEKLKILRSITHSHALSNTSIIMDASAYIKQLQQKVVRLNQEIACAQDALRHKSSSYPTVTVETLGVQGFLVNVFSDKSCPGLLVSVLEAFDELGLSVLQATASCAADSFRLEAVGGENVVDNVDEHVVKQAVLQAVRSCPESGCGGEHDDEESLG

SEQ ID NO: 5991 - protein, 307 aa, Bacillus cereus ATCC 14579
MEKVLFFGDPGIDDSFAIMYGLLHPEIEIVGIVTGYGNVEHIHAAHNAAYILQLANRQNIPVISGATKPLTEEITTYYPEIHGAEGLGPIHVPENILSIPIYNFGSIAAILIKYGKDLTIVDVGRSTSLAIAFNLWNDLMLNVKGIYFMGGVFLEVGNVTPLAEANVYGDPIASKIVFHQAKNLFIFPLNVTNKAVLTPNVFNYIQANAKNPFHMIMKPMYDYYLSAYQKLNPSMEGPLLHDVVAISGLVNPSFFEFVHRTVNVDTYGDTKGQTFADFRPNSKSEGARIALEIDAEKFIQDFIKIML

SEQ ID NO: 5992 - protein, 435 aa, Triticum aestivum
MDSSAVAVAAPLLEAGGKEMRHLGRTAHNMSSSSLRKKSDTSLVRKVPCAALRGFLSTLQEVLFGTKLFVLFPAVLLAVVARYMRFGQVWLFVLSLIGLIPLAERLSFLTEQIAFYTGPTVGGLLNATFGNVTEVIIALFALREGKITVVKCSLLGSILSNLLLVLGTSLFFGGLANLGVEQPYDRKQADVSTGLLILGVLCQSMPLMLRYAVSAGEHAVNSDDSGLVLSRACSVLMILAYGAYLYFQLKTHRQLFEPQEVEDDGDDLVSEDEAVLGFTSAMVWLAVMTVITALLSEYVVSTIEAASESWELSVSFISIILIPIVGNAAEHAGAIIFAFKNKLDITLGVSLGSATQISMFVVPLSVLVAWVMGVPMDLDFNLLETGSLFLAILVTSFTLQDGSSHYLKGLLLLLCYAVIGVCFFVLRRRSADGSN

SEQ ID NO: 5993 - protein, 243 aa, Bordetella petrii
MPAETPNIMPSVSPAATRIAPSILSADFARLGEEVRNVVAAGADWIHFDVMDNHYVPNLTIGPMVCAAIRPHVQVPIDVHLMVEPVDELVPQFAKAGADIITFHPDASRHVHRTLSLIRDHGCKAGLVFNPASSLDAMDHVMNLLDVVLLMSVNPGFGGQSFIPATLHKLRDARARIDRWMQAGGQPILLEVDGGVKVDNIAQIRAAGADTFVAGSAIFGHPDYAAVIQSLRGEIAKAGTLSA

SEQ ID NO: 5994 - protein, 477 aa, Synechococcus sp. WH 5701
MLEARAHQQLKQLLRQEGGIRWPHHLTMSRLVARSLRRADHTLVRLAPGSDPDWLVGLLVPLALGETPIALVVSDPLRRRLQQVEMPRLKAVGLQLPCWEGSAAPPAESPLWLLSHAELELAWRQGQLGERQLVVPEAERLHQQLRQSLDRPIENSDWERLRRVLPSAEPSLLALHERMSRRIFAHPPTPSGLVPISPEEEAPLRHLLALLGPLPEAWQLWRSAVGPGWTSWSSVDRELLQWRLHRQPLEPLEAMEGLLHNRGAVLVGQFGRNAALAGINPQVSVNLSDPPLSDPLPLYAPLGQPFPNSPHFGTHLLDHCRRLVLGQSGLTIVLVDEHSQRLSLASALAAEFGRRVGHETTAPESNGVICCGWQWWQEHQGRLPLPRQVIVGPLPIASLEDPLTAARVNRLRQAGRDWFRELLLPEAMTRLQLALAGLRRGGGRLAVLDGRLRSRSWGHQVLSALEPWVALNRLLPL

SEQ ID NO: 5995 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 5996 - protein, 585 aa, Saccharomyces cerevisiae; identical to SEQ ID NO: 1081

SEQ ID NO: 5997 - protein, 366 aa, Saccharomyces cerevisiae
MSEKSASNNKAEFKRQSSPFREIISADHPIYKPAKGRYWLYVALPCPWAQRTLITRALKGLAPIIGCSVAHWHLDDKGWRFLEEGDGKTNERHWFDIAGGISSVNLNTSTPVANIPNNAHRLLVDGTDEPHYGYKRLSDFYFKTKPDYKGRFTVPVLWDLETCTIVNNESSDIIGIMNSAAFDEFVGEEYRQVRLVPRSLEAQITEFNSWVYDKINNGVYKAGFAECAEVYEREVTSLFQYLDKLENLLDKKYTDLEAEYGKNNKDKILDRYFAIGDTLTEADVRLYPTIVRFDVVYHQHFKCNLATIRDDYSRIHTWLKNIYWRHEAFQRTTDFTHIKLGYTRSQPRVNPIGITPLGPKPDIRPP

SEQ ID NO: 5998 - protein, 320 aa, Synechococcus sp. WH 5701
MLAGVAWPAMREPWVRWLEETLGQDVERCRPVGGGCSHSAWALELAGGSRLFAKTNQAQLLPVLEAEMEGLLALGAAAGAELVVPSPLHCALAGSKALLVIDWLDLLDGGSGSGAVGGTAAKAELVWEAAGAALARLHRRSSASTSPGFGWPRDNYIGNSLQPNRWSQDWGRFFAGQRLGPQLKLAERSGRSLKGSRRLLELTPEWLNGHGAVPCLVHGDLWGGNAARMALSSITPGSAGVALFDPAVYLGDREVDLAMAQLFGGFSPAFFSGYDGEWPRPAGHSQRRRLYDLYHLLNHANLFGGGYWGQAQGLIAELVD

SEQ ID NO: 5999 - protein, 191 aa, Pyrococcus abyssi GE5
MVDTNNVKLRIENIVASVDLFAQLDLEKVLDICPNSKYNPEEFPGIICRFDDPKVALLIFSSGKLVVTGAKSIHDIERAVAKLIEKLKGIGVKFKRAPLIDIQNMVFSGDIGREFNLDNVALTLPNCEYEPEQFPGVIYRVKDPRAVILLFSSGKIVCSGAKSEADAWEAVRKLLRELEKYGLIEEEEEEL

SEQ ID NO: 6000 - protein, 141 aa, Oryza sativa
FGARGGPRDFPHGGSREEATDRKQVSGFGTLQVDYFTFSPSIADYIRDASLVISHAGSGSIFETLRHGKPLIVVVNEDLMDNHQSELAEELATRKHLFCASPQTLGETIQEMDIETLNPYVPGDAKPVVSLINKFFGFPDD

SEQ ID NO: 6001 - protein, 390 aa, Synechococcus sp. WH 5701
MLPPDISGVQLSPDEVARFSRHLILPEVGMVGQKRLKAASVLCVGTGGLGSPLLLYLAAAGVGRLGIVDFDVVDHSNLQRQVIHGTSWVGKPKIESAKARILEINPHCQVDLYETALTSENALEIIEPYDLVCDGTDNFPTRYLVNDACVLLGKPNVYGSIFRFEGQATVFNLDAESPNYRDLFPEPPPPGMVPSCAEGGVVGVLPGIIGVIQATEAVKIITGIGTTLSGRLLLFDALAMKFRELKLRPNPERPVIDRLIDYQEFCGVGGTAPGQEEAGSVPSITVAELKTVIDGQLEEILLLDVRNPPEADIAVIPGSVLMPLDRIESGEAIEDVRRLAEGKRLYVHCKLGGRSAKALLALGRHGIEGVNVSGGIQAWSEQVDPAVPIY

SEQ ID NO: 6002 - protein, 198 aa, Triticum aestivum
  misc_feature (77)..(77): Xaa can be any naturally occurring amino acid
MAEATLEGSEPVDLSKHPSGIIPTLQNIVSTVNLDCKLDLKAIALQARNAEYNPKRFAAVIMRIREPKTTALIFASXVCTGAKSEQQSKLAARKYARIIQKLGFPAKFKDFKIQNIVGSCDVKFPIRLEGLAYSHGAFSSYEPELFPGLIYRMKQPKMVLLIFVSGKIVLTGAKVREETYTAFENIYPVLTEFRKVQQ

SEQ ID NO: 6003 - protein, 316 aa, Mannheimia succiniciproducens MBEL55E
MTIFADNSYSIGNTPLVRLHNFGHNGNLVVKIESRNPSFSVKCRIGANMVWQAEKDGVLTKDKEIVDATSGNTGIALAYVAAARGYKITLTMPETMSLERKRLLRGLGVNLVLTEGAKGMKGAIAKAEEIVASDPNRYIMLKQFENPANPAIHQQTTGVEIWQATEGKVDVVVAGVGTGGTITGISRAIKLDQGKQITSVAVEPAESPVITQILAGEEIKPGPHKIQGIGAGFIPKNLDLSLIDRVETVDSDTAIKTARRLMAEEGILAGISSGAAVAAADRLAKLPEFQDKLIVAILPSASERYLSTALFEGIEG

SEQ ID NO: 6004 - protein, 434 aa, Nitrosomonas europaea ATCC 19718
MTAQRYVRDLLNFIDQSPSPWHAVATIEATLREFRFIRLEETDKWALQAGGRYYVVRDDSSIVLFILGSKAPAESGFRIVGAHTDSPGLRIRPNGVSASDGLARLKVEIYGGPILATFTDRDLSLAGRISYTDDGGQVAHKRICFDQPLLRLPNLAIHMNRGVNEDGLKLHKQNELPLLFAQLTDDQLPQPYFLALLEQKAGIPATQILSWDLAVYDTQKGTLWGANQEFYTNSQIDNLASCHAGLQAVLDDTILDHAESTLVCAFFDHEEIGSESHIGAGGSFLSDVLQRINLAVSRDPEDGARAFARSFLISADMAHAYHPNFPSSYDADHKVFVNRGPVIKFNANRRYSSESISAAHFMRWCEAAGVPYQRYSHRSDLPCGSTIGPIASAKLGIRSIDIGCPMWAMHSIRESAGVQDHEYIIKALKQFFSS

SEQ ID NO: 6005 - protein, 460 aa, Oryza sativa
MGSVVSSANINARSMDRHEKSGFGSNKRVKISTYECDSFQRIIPTLPDELSFQILARLPRLYYLKLKLVSQAWKAAITSSELSQLRRELGLTEEWLYVLTKLEPNKLDCYALDPLFRKWQRLPPMPSFVSEEESTGRTQSSWFQTWNVVGSSIRIADFIKGWLRRRYGLDQMPFCGCSVGVADGCLYVFGGFSRAVALNCVFRYNPCLNVWQEVSPMISGRAFSKAALLQSKLYVVGGVSRGRNGLLPLRSGEVFDPKTGIWSELPEMPFMKAQVLPTAFLADVLKPIATGMASYKGKLYVPQSLYSWPFFFDIGGEIYDPELNSWETMADGLGDGWPARQAGTKLGIVVNEELYTLEPSSSLDSGQIKRYDSEQDTWKTIVPQVPVHDFTDAEAPFLLAGLHGKVHVITKEANNNLQVMQAVLQNNIENSPSEENIIWNILASKNFGSAELVSCQVLDV

SEQ ID NO: 6006 - protein, 392 aa, Rhizopus niveus
MVSFISISQGVSLCLLVSSMMLGSSVVPVSGKSGSSNTAVSASDNAALPPLISSRCAPPSNKGSKSDLQAEPYNMQKNTEWYESHGGNLTSIGKRDDNLVGGMTLDLPSDAPPISLSSSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSILDHLSYFDINEGSCL

SEQ ID NO: 6007 - protein, 315 aa, Fulvimarina pelagi HTCC2506
MSPTRLEETTRLQKRIEQRLGEVLPACLEGQEQLRDAIATSVLAPGKRLRPLLAVLTAIDLNGDVEAAIEGGCAIELIHTASLVLDDLPCMDDATLRRGQPPTHVAYGEDTALLAVIAMISRAFELLAAAPSLNPEQRTRSVAALGKAVGTSGLVAGQFADLKGGSGSTDAAARTNALKTGALFLAAVEIGMIGSGAPRETRRELEAFARELGLAFQLLDDLLDGSQTAVSIGKDIGQDAGKSTIVSMIGRASTEDQIDRHMRTALAHVEAGLGPDSRLAALLHVIWKTARHRTAEHRAGKVISEGRVDEPAGMQ

SEQ ID NO: 6008 - protein, 647 aa, Vitis vinifera
MGTKLFQSFILHSPITFFSIFITSFCDDNQQYEECTSRLYECGDMKGIGYPFWGDGRPQFCGQGFELKCQDDDYPLIAIGSLEFRVLNISNSTYAMRIARKDFWDQTCPKEFQSTTLNYTLFDYAGTDRNLTLFYGCPDEVLSQLPATWNISNNFTGSVEGINDTTVFYADEAFLGLDQHLAILRTCKINVTLPVLGAAIDELNANRTGGEVSNGEGLEKALNMGFDVDYSVVTGLCVQCNASGGICGSSSTSQFSCLCRDKSYPYSCQKSAVVAAGVGTLFASILIIFCFKRKISKHRLMFIWRKRSDADQNIEEFVRNYGSQAPKRYSYSNVKKMTNAFKDKLGQGGYGGVYKGKLGDGHLVAVKVLNTSKGNGDEFINEVASISRTSHVNIVRLLGFCFEGGKKALIYEFMSNGSLENFLGSENPLKVSKHLGWEKLYQIAVGIARGLEYLHCGCRTKILHFDVKPHNILLDQDFSPKISDFGLAKLCPPKESIISMSAARGTIGYVAPEVFCRNFGQVSHKSDVYSYGMMVLEMVGGRQNVNGTVGHTSETYFPHWIYKHLEQQEDLGLEGIENKEENEITRKMIVVGLWCIQTNPSHRPCMSKVIEMLEGSIEALQIPPKPFLSSPPRFPIDSSSFKSTLSQ

SEQ ID NO: 6009 - protein, 321 aa, Roseovarius nubinhibens ISM
MILPSVIDAIGDTPLVSLDRVVTELGLSGRILAKLDYLLPGFSKKDRAARTIIEAARASGELRDGQPVIELTSGNMGTGLAIVCGVLGHPFIAVMSEGNSPERARMMRALGAEVVLVPQAKGSRPGEVSGADLARVEEAAQRITRERAAFRADQFARPGNPAAHFHGTAPEIWAQSGETVSVFADFAGSGGTLAGCAAYLAPRGVRCYAVEPTGAEAIGGGDRSTPAHPIQGGGYDMDALAHLKSTDSAGTVTVSGNEARDHARLLARREGIFGGFSSGANLAAAVQLLRGPERGGTIAIVICDSGLKYLSTDLWDDPPPQ

SEQ ID NO: 6010 - protein, 550 aa, Vibrio fischeri ES114
MNKTSRLETSVIIIGGGATGSGIMRDCALRGIDCILIEKDDLASGTTGRNHGLLHSGARYAVTDNESAKECIHENKILKTIAKHCVEDTQGLFISLPDDDLDFQKQFIDSCGSAGIEAKQLTPKEALLLEPNVNPDLIGAVQVPDGTLDPFRLCAANVLDAKENGARLLTHTHVTSLIRHQDTVLGVNCIDVKTNQKIEIFAQQVINAAGIWGQNICEYADLSIKMFPAKGSLLILDYRINNLVINRCRKPSDADILVPGDTISLIGTTSEHIDYDKIDDLHVSAKEVDILMREGAKLAPIMANTRVLRAYAGVRPLVAVDDDGTGRNISRGIVLLDHGEKDGLDGFTTITGGKLMTSRLMAEMTTDLVANKLGNTQECTTHIRPLPGSNGASITAKKTASIAKPVYQSAIYRHGERAQQFLTDEAKDQAVICECEMVTQGEINYAINQLDVHNLVDLRRRTRLGMGPCQGELCTYRAAGLFEECGQISGNQSSQLLTHFLEERWKGIKPVFWGDALREAEFSYWIYEGLFGASDIPNQHSEQESKEATL

SEQ ID NO: 6011 - protein, 1170 aa, Vibrio fischeri ES114
MMKITIDKQTFTIDEEITLLAAAKECNVEIPSLCGNNINGEKVPCDLCVVEIEGQGIQRACETQAVDGMQVITSSEALVKRRQSALNKILSDHYADCEAPCQTACPAGVDIQSYLYHISQDNHQKAIEVIKRTLPMPLSIGRVCPAFCEAECRRGLVDEPLAIRQLKRHAADVDLHAQESYVPPKKADKGKSIAVIGSGPGGLTCGYYLTNEGYSVTVFESMPKAGGWLRYGIPEYRLPKSILDKEIELMCRNGMEIQTSVKLGEDFSLTQLSDEYDAVCLAVGASKAVEMHYQGSELGGCYLGVDYLKDYVTESKLTTGKKVAVIGGGNTAIDCARTAVRDGADTTLIYRRTREEMPAEDYEVVEAEHEGVKFHFLTNPVENIADENGRVAQVRLEKMALGEPDASGRRSPQATGEFFIEEFDTVISAVSQKPDLSFLENDTIDLPLTRWNTADANSLTMHSGVKNIFSIGDFRRGPATAIEAVADGRIAAEAIDRFFNGDMEKIPTKPFNSQKEKKTKQVDPKHFEHIQKAMRVIMPELTAEQREQSFDEVETGFDNLDAIREAERCLECACQANTNCGLRDYATEYKADETDLSNESKQKFAIDTSSEFIVFDANRCISCGQCVEACNEKGVHGVLSFMKNEDGTNASRPECRAGFEHGYQMGNSNCVQCGACVQACPVGALVDSRDKSQGRIEVLKPVDTICTYCGVGCKLTMMVDESTNKIKYVQGAKSSPVNEGMLCVKGRFGFDFVSSDERLKTPLIRKNGELVPASWEEAITLVADKFSTIKSQHGGNALAGFSSAKTTNEDNYAFQKLVRREFETNNLDHCARLCHSTTVTGLEASIGSGAMTNDIPSIKHSDLIFIIGSDTTSAHPIIASHIKQATRHHGARLIVADPKQVDISDHAELYVAQRPGTDVMLLNGIMQQIIKNNWHDQAYIAERVEGFDELKAEVMSEAYSPEKIELITGVKAQDVIEMARYIGTAKRTAIYYSMGITQHTTGHDNVRSIANLQMLCGNIGIEGGGINPLRGQSNVQGACDMGALPTDFPGYQKVENPAVYEKFVKAWNKPTLPSKKGLTLTEIIDAACHEQVKGLFVMGENPVLSDPDQAHVIHGLEKLDFLVVQDIFMTETAAYADVILPSCSFAEKAGHFTNTERRVQRISPAVNPPG

SEQ ID NO: 6012 - protein, 489 aa, Pseudomonas putida GB-1
MSHQSLFIAGQWREPHSGRYREILNPANESLLALAPEAGAQDVDAAIDAARHAFDHGPWPQLPPSERSAWLLRIAAAIEADAAQLARLETLNTGKTLCESEADMACVVATFRYYAGLLEARTDRAHPHAPDHVISVTRHEPVGVCALIVPWNYPLLQTAWKLAPALAAGNTVILKPSELTPLSALHLTALLAALALPAGVFNLVCGDGTVGHHMALSDRVDMVSFTGGAQAGAKVMQAASGNFKRLALELGGKNPNIVFADADLDVALDQALNAVFFNAGQVCSAGSRLLLQASVHDRFVARLVERIDAIVLGDGFDSRTRMGPLISAAQRNRVLSLIQAAQGEGARLRAGGQRPTDAHLEKGFWLRPTLLSDVQADMRIAREEIFGPVITVERFTDEAHAVRLANDTPYGLAAGVWTGDLGCANRMARRLRVGTLWVNDYNLAFPQAPWGGFKASGIGRELSATGLEEFSELKHVLLNCEPRALNWFT

SEQ ID NO: 6013 - protein, 620 aa, Shigella flexneri 2a str. 301
MDSHTLVQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 6014 - protein, 148 aa, Azoarcus sp. EbN1
MSKLHVIRTLLLDVKKIVTRLKAEGHTLTDTHRKVHRPWGWYDSIDAGDRFQVKRIVVKPGASLSLQRHHHRAEHWVVVSGTAEITNGDKVLLLSENESTYIPLGHVHRLSNPGKMPLEIIEVQSGSYLGEDDIVRFEDTYGRAPAGG

SEQ ID NO: 6015 - protein, 274 aa, Glycine max
MLASEDILSFKSYQNRANLFVKEYLLADSLIPYTSVISGMLACKMVYELTQHIGSNYFKIYSNFSKIQRIEWNNRAISTIHAIFITSMSLYMVFCSNLFSDYQSTELITERSSSLSTFALGVSVGYFIADLGTILWFFPALGGYEYVIHHLFSLVAVAYAMLTGEGQLYTFMVLISETTTPGINLRWYLDVAGMKKSKAYLINGVVIFISWLVARILLFIYMFYHVYLHFDEVEQMHTFGQILVIVVPLVLSVMNLVWFAKIIKGLRKTLAKRQ

SEQ ID NO: 6016 - protein, 383 aa, Vitis vinifera
  misc_feature (56)..(56): Xaa can be any naturally occurring amino acid
MADGSQHSSIFQKINGQSYLFSTLSPNLQSRNTSVHSLSSAYVNGGLQTSLLPAGXGNGLALVSPLSPIFAHAPAEKGAKGFMIDFLMGGVSAAVSKSAAAPIERVKLLIQNQDEMIKAGRLSEPYKGITDCFARTIKDEGVISLWRGNTANVIRYFPTQALNFAFKDYFKRLFNFKKDRDGYWKWFAGNLASGGAAGASSLLFVYSLDYARTRLANDAKAAKKGGERQFNGLIDVYKKTIKSDGIAGLYRGFNISCVGIIVYRGLYFGMYDSLKPVVLVGEMQDSFLASFLLGWGITIGAGLASYPIDTVRRRMMMTSGEAVKYKSSFDAFSQILKNEGAKSLFKGAGANILRAVAGAGVLAGYDKLQLLVLGKKYGSGGGG

SEQ ID NO: 6017 - protein, 458 aa, Clostridium perfringens SM101
METLREKINKQRKYFSTGETKDINFRIEKLKKLRDVLKSEEEKIFEALKKDLMKSSFESYVTEVAMVYDEINMHIKNIKKWSKKRRVKTPLVQFPAKSFIKLEPYGVVLIIGPFNYPFMLTMDPLIGAIAAGNTAVIKPSESAPETSKILKEILEKVFDEKYVLHVNPERGKEVVEELLKEKFDYIFFTGSATVGKIVMKAASQYLTPITLELGGKSPCIIDKDCKLELAARRIVWGKLLNSGQTCVAPDYLYVHKDIEEEFIKKLEEEIKNQFGNNPLESEDYSKMVNEREFNRVLSYIDKEKLVFGGNYNRKTFQIEPTILKNVTWNDPVMEREIFGPIFPILSFENLDEVIRLVNSKDKPLALYYFSEDKNKIEKVINSTSSGGVTINDTLVHVSSSYLPFGGVGNSGMGEYHGKYSFDLFSNKKGVMNRKTFLDLKIRYAPFLNKLTIVKKIMK

SEQ ID NO: 6018 - protein, 510 aa, Listeria monocytogenes EGD-e
MSKSPVAIIILDGFGKRAETVGNAVAQANKPNFDRYWADFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 6019 - protein, 251 aa, Listeria monocytogenes EGD-e
MRKPIIAGNWKMNKTAAKAGQFAEDVKNNVPSSDAVESVVAAPALFLQELVRLTEGTDLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 6020 - protein, 396 aa, Listeria monocytogenes EGD-e
MAKKVVTDLDLKDKKVLVRVDFNVPMKDGKITNDNRIVAALPTIEYILEQNGKAILFSHLGKVKTEEDKEGKSLRPVAVRLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 6021 - protein, 336 aa, Listeria monocytogenes EGD-e
MTVKVGINGFGRIGRLAFRRIQNVEGIEVVAINDLTDAKMLAHLLKYDTTQGRFDGEVEVHDGFFKVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMEAASDPETFGYTSDQVVSSDIKGMTFGSLFDETQTKVLTVGDQQLVKTVAWYDNEMSYTAQLVRTLEYFAKIAK

SEQ ID NO: 6022 - protein, 338 aa, Streptococcus agalactiae A909
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKIAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 6023 - protein, 638 aa, Vibrio fischeri ES114
MTGYFLQAFIYLVAAVIAVPIAKRLGLGSVLGYLIAGVVIGPIIGLVGEETTTIQHFAEFGVVMMLFLVGLELEPKMLWNMRNRLMGLGGLQVVGTTAVVMGLAMFFGQSWTIALTIGLIFALSSTAIVLQTFNEKGLAKTEGGQNAFSVLLFQDIAVIPMLAFIPLLALPELVAKAQLAAATAAEHHEELTLVAGLPGWAYGLVITASIALVVVGGHYLSRPLFRFVASSGLREIFTATALMLVIGIAALMSLVGLSPALGTFLAGVVLANSEFRHELESNIDPFKGLLLGLFFITVGAGIDFGILFNDFFLIIGLTIGVMVLKAAVLYILALIFKIKNSNRWLFTLSLAQAGEFGFVLLSFTVQNHVLPQEVAQPLSLVVALSMFFTPGLFILFDKVILPKFEQQSNERESDTIEEKGTVIIAGGGRFGQVVNRFLVSNHVNTVVLDHQADQVDSLRKVNTKSYFGDATRPDLLHTAGIEHAAMLVVAIDNQESSIELVKYVKHTYPKVKILARAFDRGHSYMLRCAGADFIESETTRSALEMGAEAMRNLGQHPFHVEQQKIAYKKVENQSSDKLYQAWLDDSEGERFDNNYRKLFIELEGTIKHAMSKDRSDKHNQSERAWTPPPKGYADDIDE

SEQ ID NO: 6024 - protein, 535 aa, Oryza sativa Japonica Group
MERALDSLTYKGSIPDAILQSRRDNKLFVVYISGEDETSSSLEQSTLVNESVAEVIGNCCVFLHLKQGNVDASQFSAIYPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 6025 - protein, 417 aa, Glycine max
AQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIITICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGTQPIWRFQSTHNIQVRTV

SEQ ID NO: 6026 - protein, 403 aa, Vibrio fischeri ES114
MYLKYFWYTPYFHNTYNTDIIVSKTISTLSQINIFPVKSIAGVSQSSAYVEKQGLQCDRRFMVTDPNGKMITARTHPQMVKISAIIEPDGLILCYPGLIDLHLTFNELEMKQTEAKVWNDSFSAYSTNQEANQWFSSILSTDAQLLYTGEQSNRIREKIQTNVSFADGYPLLVISEASLAELNKRSSSHHTMSQFRTNLVISGDDAFIEDSWKRIRIGEVEFEIVKPCQRCILTTVNPRTAQYHPDKEPLKTFSTFRADESGNVYFGQNLIAKNEGTIKLGDKIEVLESKEKEFYLDSSSEALEEKAITHTSKKPDTPEEITISLNGHLFTGNTEQPLLMQVEEAGLSINNSCRAGLCGACRVTLESGEVEQEDSPALNQKLKEAGMILACCSVPKTDVEIVD

SEQ ID NO: 6027 - protein, 315 aa, Arabidopsis thaliana
MTHRIAPRCFSTIMLLCLLYTSPLDVIAQGQGGQGDIPVVNPTAPGGSTTTPTITQPSPPSLTFPGPTTPTGGYPPLDGTTPTGGYPPLYGTTPPGGGDVGGGGGGYGGGTPGGGGGGGGDTGAGAGGGGYGGGGDTGAGGGVGSGQWCIAKANASPTSLQVALDYACGYGGADCGQIQQGAACYEPNTIRDHASFAFNSYYQKHPGSDSCNFGGAAQLTSTDPSKGSCHFSSSSGTVSTSPPSQMSPPDFSSPPSSTYPPPITTPTTGITGSGPPFGVAEPTGLPNSATSVSHSLLSIFTAVGILMPLLRENYL

SEQ ID NO: 6028 - protein, 848 aa, Oryza sativa Japonica Group
MDRPQDPFNSRGIAVPPAVKMRNMAGNNSPWIDPLPPPMNARNGLANASLFSTSLPVLPHEKINFLDSARGTPLMDDASAKLKELDDDPEGKDYKFDFDLRQIDDLLPNEDDLFAGITNEIEPAGQTNSMEELEEFDVFGSGGGMELDTDPVESITAGLGNTSIADGLRGNGVNHFGPSNSASTVAGEHPYGEHPSRTLFVRNINSNVDDTELRSLFEQYGDIRTLYTATKHRGFVMISYFDIRAARGAMRGLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRNLMQQLGHDIDQDEPRSYRIPHVGSPIASSPPGAWAQYSSPTDNNLLQAFNASPTGNGMSPIGMPPSLISNAVKIAPIGKDSNWSKYDKVFSNNNQPHGAAFQHSHSYQDHKSEHMSSSPGTLTGPEFLWGSPKPYSEHAQSPIWRPPAIGHAIPSNTRSQGQGLLYGGRQASLFGSQDQLHHHHVGSAPSGAPFESHFGFLPESPETSYMNQVRFGNIGNIGSGRNGTGLMLNMAARASVNPVSALSGNMSDNNSSSFRPILSPRLGQSFYGNPTYQGPGSFGLDNSIERGRNRRVDSSVFQADSKKQYQLDLEKIRKGDDTRTTLMIKNIPNKYTSKMLLAAIDEFHKGTYDFFYLPIDFKNKCNVGYAFINMISPVHIVSFYQAFNGKKWEKFNSEKVASLAYARIQGRTALISHFQNSSLMNEDKRCRPILFHSNGPDAGNQEPFPINGICIHMPLEDGAIATGDPFGNEEDNNQNERTAGEEL

SEQ ID NO: 6029 - protein, 466 aa, Bordetella petrii
MSNGTIVQCIGAVVDIQFPRDQMPKIYEALTLADDTSQFAEKGLTLEVQQQLGDGVVRTIALGSSDGLRRGMKVVGTGAPISVPVGHGTLGRIMDVLGRPIDEAGPIESDEKRAIHQTAPRFDELSPSVELLETGIKVIDLVCPFAKGGKVGLFGGAGVGKTVNMMELINNIAKQHSGLSVFAGVGERTREGNDFYHEMEESKVLDKVAMVFGQMNEPPGNRLRVALTGLTMAEKFRDEGRDILFFVDNIYRYTLAGTEVSALLGRMPSAVGYQPTLAEEMGVLQERITSTKTGSITSIQAVYVPADDLTDPSPATTFQHLDSTVVLSRDIAALGIYPAVDPLDSSSRQLDPQVVGEEHYAVARGVQQTLQRYKELRDIIAILGMDELSPDDKQAVARARKIQRFLSQPFHVAEVFTGSPGKYVPLAETIRGFKMIVDGECDALPEQAFYMVGTIDEAFEKAKKLQ

SEQ ID NO: 6030 - protein, 242 aa, Oryza sativa Japonica Group
MAISQEEQHAGGGRDYAEPAPQPFLGSSELRRWSLYRAAIAEFVATLLFLYVTVATCTAGVSGGHVNPAVTLGLLVARKVTLLRAALYVAAQCLGAGLVRALNSAHFARHGGGANVVGDGYSKGAGLAAEVAGTFVLVYTVFSATDAKRSARDSHIPVLAPLPIGFAVFVVHLATIPITGTGINPARSFGAAVVYNQPNAWHDQWIFWVGPLVGSAIATLYHEHVLRASTLKALGSFKGARQ

SEQ ID NO: 6031 - protein, 160 aa, Zea mays
MEAAVPSRVALSAASRLPNPHAVTGDRSFIYKGRCQSLAIPMALSAAAPGKGGGVLDRPVEKTTPGRQSEFDVKKSRKMSPPYRVILHNDNYNRREYVVKVLMKVIPGMTVDNAVNIMQEAHVNGLSVVIVCSQSEAEEHCTSLRGNGLRSSIEPASGGC

SEQ ID NO: 6032 - protein, 489 aa, Frankia sp. EAN1pec
MAAPGPPSAQEQADTAQPRRPTVSLSTIDRTDSRTPVSRLSRFFDPDTLSLFASADGSGVVAGQGLVDGNEVVAFATDPTVQGGAMGRDGCARIVHAIESAVRMSCPVIGIWHSGGARLQEGVASLDGVGRVFAATVRASGRVPQISLVLGAAAGGAAYGPALTDLVITGPDAKVFVTGPDVVRSVTGEECTADSLGGPEVHSTRSGVVHLACDTDDAAFDRTRAITALLADQGSIGHVAERELGDLLPENPRRAYDVRPLVAGLLDDEVVELHPKWARNIVTALGRLGGRTVGVVANNPLRRGGCLDALSAEKASRFVRMCDSFGIPLVVLVDVPGYLPGVGQEWEGVVRRGAKLLYAFSECTVPRVTVVTRKAYGGAYIAMNARCLGATAVYAWPTAQLAVMGAEAAVGILHRRQLAEVPAQRRPDVMAELAEEHVRTVGGIDRAVELGVVDAVVTPATTRGAVAAALADAVAAARVDKNVHGNIPL

SEQ ID NO: 6033 - protein, 163 aa, Zea mays
MTGSHESVLSSGSGQQTMTAVEAGRETRAGPGNSRTSRALRTQTQAHSTITVSPRTRSRTRSLAHTRPAVPILFRCRHPLRRPPRPAAATRPVSIAMTTSRRLADRKISRFEKNITKRGSVPETAKKANDYPVGPILLGFFVFVVVGSSLFQIIKTASNAGLF

SEQ ID NO: 6034 - protein, 329 aa, Shewanella sp. MR-4
MQVSPRGTASAKLTDFLELANQNIALAKQQNIQYSPQLLRENLNKLAALMSAKPEVSYIADKAWQVKDAQHGDREIGCRVYSPAPSKALPVVLHFHGGGHMCGSVELYDPICRHLASIAQCVVISVEYRLAPEHPYPAGLDDCEYALRHYQSVLTEVQYQQGVSIMGDSAGGALCTSLSQRSLSDSTLNIAKQILVYPSVDYTMTSPSYLSNGAGFLLETPRVQWYFEQYFQEVAKDAERVKQASPLHGEFNAKLPSTLIFTAGCDPLRDEGIAYANALTAAGVQVQHHQFEDMIHAYMLLQDLVSQECLATYRMIAAFLAEPVTAATR

SEQ ID NO: 6035 - protein, 370 aa, Shewanella sp. MR-4
MTNANVDATQLTTKPSQDGFYMPAEWAAQQAVWMIWPYRPDNWRSAGAYAQATFAKVADAIGGATPVYMGVPQAFLAEAQKVMPSHVTLVEIDSNDCWARDTGPTVVVNAEGECRGVDWGFNAWGGHNGGLYFPWDKDEQVAAQMLKQHGFARYSAPLILEGGSIHVDGEGTCMTTAECLLNANRNPDLTKEQIEALLRDYLNVKQFIWLEEGVYMDETDGHIDNMCCFARPGEVILHWTDDETDPQYPRSKAALDVLQNTVDAQGRKLKIHLLPQPGPLYCTEEESKGVTEGTGVPRTAGERLAGSYVNFLITNDRIVFPLLDPATDDIAAQKLQDIFPEHKIVGVPAREILLGGGNIHCITQQIPSGK

SEQ ID NO: 6036 - protein, 641 aa, Pichia jadinii
MTISNTQAADGRRYSTTVGASGASTTRDTTIGSVNEYPDECISKEPIGEAARAAINVAKATRLSAVGPIECSLNGFQLLNSPLFNKGSAFTLEERAAFGLEGLLPAQVNDLNAQVERAYKQLCYLKTPLAKNDFCSSMRVQNKVLFYELVRRHIRELVPIIYTPTEGDAIAAYSHRFRKPEGCFLDITDPDSIDRRLANFGEDKDVDYIVVSDGEGILGIGDQGVGGVRIAISKLALMTLCGGIHPGRVIPVCLDVGTNNKKLITDDLYMGNRFPRVRGKEYDDFVDKFIQVLKRRFPSATLHFEDFGVTTGRPLLQRYRNELACFNDDIQGTGAVVMASLSAALKHTNRNLLDSQIVIYGAGSAGLGIADQIVNHMVTHGATVEEAKSKIHALDIRGLILKSMKETSTPDQHSYADEDADWEGIDTKSLYEVVKKIKPTCLIGCSTQAGAFTQQIVQEMHKHNPRPIIFPLSNPTRLHEAVPEDLMAWTNNDAMVATGSPFKPVDGWVISENNNCFAFPGIGLGSVLSRAKIISDKMISAAVDQLASLSPLSKDPKAGLLPPLEVINDTSAKVAAAVILQALDEGLARIEDEVQPGKDEYVTVPGDFDACVEWVKQQMWKPEYRPMVKVEHRHDIHTHQF

SEQ ID NO: 6037 - protein, 147 aa, Brassica napus
MQHSEVKQDESFLVYLGNLASNAWVSVMEILRIKQSAATTNFQQYQTKQSSAAFSTTAPWPIQESFVVRDEDEPPPVEHKNQTLRKTYAFMSKDAEKMQQLRQSRAFYSSSWEPEFPNQQQQKQQQQHRRHYSSIPHTHYEQNSEQT

SEQ ID NO: 6038 - protein, 138 aa, Brassica napus
MMSRLLFFFVFLYTVTTLTSTTSGACQTSCGSIQINYPFGIDKGCGSPQFQGMLNCSSTDLYFITPSGGYKVRSIDYDKNTMVVFDPLMSTCSTLQPHHDFKLSDIQNAIIRPSYDTVFALFNCSSDVTLPSNAAPPK

SEQ ID NO: 6039 - protein, 561 aa, Oryza sativa Japonica Group
MYSTAISLSAAATAAAAVGGARPGAIRPAELRFCGLRREALGLRSLRAPPRAAATPRKAAAATGNGAAGSGGFDYDLVIIGAGVGGHGAALHAVEKGLKTAIIEGDVVGGTCVNRGCVPSKALLAVSGRMRELQDEHHMKSLGLQVSTAGYDRQAVADHANNLASKIRSNLTNSMKALGVDILTGFGTIVGKQKVRYGKVGFPDNEITARNIIIATGSVPFVPNGIEIDGKTVFTSDHALKLESVPDWIAIVGSGYIGLEFSDVYTALGSEVTFVEALDQLMPGFDPEIAKLAQRILINPRKIDYHTGVFASKITPAKDGKPVLIELIDAKTKEHKETLEVDAALIATGRAPFTKGLGLENVNVVTQRGFVPVDERMQVMDADGNAVPNLYCIGDANGKLMLAHAASAQGISVVERISGKDNILNHLSIPAACFTHPEISMVGLTEPQAREKADKEGFEISVVKTSFKANTKALAENEGDGLAKMIYRPDTGEILGVHILGLHAADLIHEASNAIALGTRVQDIKFAVHAHPTLSEVLDELFKAAKVNAGVPHSVNEPVAA

SEQ ID NO: 6040 - protein, 338 aa, Leavenworthia uniflora
  misc_feature (170)..(170): Xaa can be any naturally occurring amino acid
TGQIIRSKAAVAWEAGKPLVMEEVEVAPPQKHEVRIKILFTSLSHTDVYFWEAKGQTPLFPRIFGHEAGGIVESVGEEVTDLQPGDHVLPIFTGECGDCPHCHSEESNMCDLLRINTERVGMIHDGESRFSINGKPIHHFLGTSTFSEYTVVHSGQVAKINPEAPLDKVXIVSCGLSTGLGATLNVAKPKKGQSVAVFGLGPVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNK

SEQ ID NO: 6041 - protein, 253 aa, Borrelia garinii PBi
MRKTFLAGNWKMHYTSTEASIVAKKIATEVKTLKDDFVIMITPPFTALSKVSECIKGSNILLGAQNMSYMESGARTSEISPSMLLEFGVEYVILGHSECRLYLGETDEIINKKILTGLKHPFKYLILCVGETLNERDSEKTLDVVLNQVKKGLDGVSESDIKRIILAYEPIWAIGTGKTATKEEAEEVHKAIRLEIMKLYSKSVSDNVIIQYGGSVNSSNVKELMNEPDIDGALIGGASLKAESFLSIINNVL

SEQ ID NO: 6042 - protein, 379 aa, Leavenworthia stylosa
  misc_feature (11)..(11): Xaa can be any naturally occurring amino acid
MTTTGRIIRSXAGVAWEAGKPLVIEEVEVAPPQKHEVRIKILFTSLWHTDVYFWEAKGQTPLFPRIFGHEAGGIVESVGEGVTDLKPGDHVLPIFTGECGDCPHCHSEESNMCDLLRINTERRGMIHDGESRFSINGKPIHHFLGTSTFSEYTVVHSGQVAKINPKAPLDKVWIVSWGLSTGLGAILNVAKPKKGQSVAVFGLGAVGLAAAEGARIAGASRIIGVDLNSKRFEEAKKFGVTEFVNPKDYDKPVQQVIAEMTNGGVDRSVECTGSVQAMIQAFECVHDGWGVAVLVGVPSKDDAFKTHPMNFLNEKTLKGTFFGNYKPKTDIPGVVEKYMNKELELEKFITHTVPFSEINKAFDYMLKGESIRCIITMGA

SEQ ID NO: 6043 - protein, 393 aa, Borrelia garinii PBi
MSIKTVKDFNSFAGKRALVRCDFNVPLKEGNISDDTRIKAALPTIEYLKEKGARIVLISHLGRPEGKKNLKYSLKPVANKLSELLGQDVKMLSDCIGREIVNNTLQMKDGDVVLLENVRFYAEEEKNDKNFAKKLSENGDVFVNDAFGAAHRAHASTVGVSDYLPSVGGFLMEKEDKFLGEVLKNPERPFVSIIGGSKVSSKIAVLESLLSKSNVVVIGGGMAYTFLHSKGYSIGKSLLESEYIDIASSFLKKAKELDVKVILPLDHIVADDFNKNSTPEYIDSFDIPENKIGMDVGGKTLKEIEKVIKTAKTIIWNGPLGVFEFDSFSKGTAMVAEMVASCAGLTIVGGGDSVAAVNKFNLSDKITHVSTGGGASLEYLEGKILPGIKVLEK

SEQ ID NO: 6044 - protein, 328 aa, Physcomitrella patens subsp. patens
VLVLVQVLSGGHQILSRVALVTGIDPLLFTFYRNFIAFAVLAPFAYYVERDMRPKMTLATFGNLNILAFFAILGNQQFYLAGLKLTSPLFAAVAQNTIPVITFLLAASIGQEEISCRKMSGLAKILGTFIGFGGAVTMTLYKGAKIYASEAGKDELDGFVNLFKYAGIPALVDIKIDHWALGAFYLLLNCTLWGLYLINQGSVLVKYPALLSMGCLTELFGSIQVGIIGAAMKGVQSLDFRSVTLNHLMVITYAGVVVSAIVQVLQAWCIQQTGAFFVSIFLPVQTLVVAVLAIIVLGETLYLGVVIGGVLVIGGFYIVNYGQKMERK

SEQ ID NO: 6045 - protein, 264 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEKHHHHHH

SEQ ID NO: 6046 - protein, 335 aa, Borrelia garinii PBi
MKLAINGFGRIGRNVFKIAFERGIDVVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDQDINSDLKAVSNASCTTNCLAPLAKVLHESFGIEHGLMTTVHAYTNDQRILDLPHSDLRRARAAALSIIPTSTGAAKAVGLVLPELKGKLNGTSMRVPVPTGSIVDLTVQLKKKDVTKEEINFALKKASETPELKGILGYTEDPIVSSDIKGNSHSSIVDGLETMVLENGFAKVLSWYDNEFGYSTRVVDLAQKLVK

SEQ ID NO: 6047 - protein, 223 aa, Leavenworthia crassa
GQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 6048 - protein, 171 aa, Oryza sativa Indica Group
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 6049 - protein, 562 aa, Oryza sativa Japonica Group
MDFDCKTARGDSSSVNRSCIVTEGTVVQAKPVSHNGKAKHWNSLSTLNNQKCSYELLSDPKKNVETSDGETASKCDSWCFTDLPSALVCEVLEHLDPKELGIVSCVSTLLHTLATDHQGWKKFYCERWGIPTPPVTLNGPLVPGGTSDWKSWKTLFVEREFRSKSFMGRFSVDVLRDHSEDVRTVFLLASVNLIFTGGNDSVIRMWDLEEGLLIDKSRPLCCTIRAIAADTRLLVTAGTNAFIHCWRAVEGNSYPFHISGNGTDQSPEFRLWGHEGPVTCLALDSLRIFSGSWDMTVRVWDRSEMKCVQKFMHADWVWSVAPHGNTVASTAGRDAYVWDIRSGELENVISNAHYGNAFSLARTHLADVLFTGGEDGAIRLFNVSEVSDDEDIKPAATWVPHTGPVHSLAFEYPWLVSASSDGRVALIDLRKLLTPRKSSKQPFRVKNFDPSSIEPPQRMLHGFGCDLFSVAIGADRIVCGGEDGAVKVWNFSEALEIEKRAQALRSMRQENRMRRKKAQVEMNANGRRSDQCGSIAMKRNQLKGDKSVTWHSKRAINDKVKS

SEQ ID NO: 6050 - protein, 355 aa, Chara corallina
LELRDGGKDFMGKGVLKAVSNVNDIIAPALIGKDVTEQTAIDKFMVEDLDGTQNEWGWCKQRLGANAILAVLLAVCKAGAGAKKIPLYQHIANLAGNSKLVLPVPSFNIINGGSHAGNKLAMQEFMILPTGASSFQEAMKIGSEVYHHLKSIIKKKYGQDATNVGDEGGFAPNIQDNKEGLELIKAAIEKAGYTGKVTIGMDVAASEFYSDKTKMYDLDFKTEHNDGSKRITGDQLIQLYESFCSEYPLVSIEDPFDQDDWEHYAKLTALIGEKVQIVGDDLLVTNPKRVAKAIAEKSANALLLKVNQIGSVTESIEAVRMSKKAGWGVMTSHRSGETEDTFIADLAVGLATGQI

SEQ ID NO: 6051 - protein, 380 aa, Leavenworthia stylosa
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGHCPHCHSEESNMCELLRINTERGGMILDGESRFSINGKPIHHFLGTSTFSEYTVVHSGQVVKINPKAPLDKICIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQAFECVHDGWGVAVLVGVPSKDDAFKTHPINFLNERTLKGTFFGNYKPKSDIPGVVEMYMNKELELEKFITHKVPFSEINKGFDYMLKGEGIRCIITMGA

SEQ ID NO: 6052 - protein, 404 aa, Mannheimia succiniciproducens MBEL55E
MELFPKSNKLEHVCYDIRGPVHKAALRLEEEGHKILKLNIGNPAPFGFEAPDEILIDVIRNLPTAQGYCDSKGLYSARKAIVQYYQSKGIHGATVNDVYIGNGASELITMAMQALLNDGDEVLVPMPDYPLWTAAVTLAGGKAVHYLCDEEQDWFPAIDDIKSKITSRTKAIVIINPNNPTGAVYSKELLLEIAEIARQNGLLIFSDEIYDKILYDGAVHHHIAGLAPDLLTITMNGLSKAYRICGFRQGWMILNGPKDKARGYIEGLDMIASMRLCANVPMQHAIQTALGGYQSINELIVPGGRLYEQRNRAYELLNQIPGVSCVKPMGALYMFPKIDIKKFNIYDDEKLVLDLLAQEKVLLVHGRGFNWHAPDHFRIVTLPYVHQIEEALNKFARFMENYHQ

SEQ ID NO: 6053 - protein, 355 aa, Nitella opaca
LELRDGGKDFMGKGVLKAVSNVNDVIAPALIGKDPTEQTALDNFMVEELDGTQNEWGWCKQRLGANAILAVSLAVCKAGAGAKKIPLYQHIANLSGNTKLVLPVPSFNIINGGSHAGNKLAMQEFMILPTGASSFKEAMKMGSEVYHHLKSIIKKKYGQDATNVGDEGGFAPNIQDNKEGLELIKAAIEKAGYTGKVTIGMDVAASEFYDEKTKMYDLDFKTENNDGSKRISGDEIIQLYKSFCDEYPLVSIEDPFDQDDWEHYAKFTALIGEKVQIVGDDLLVTNPKRVAKAVAEKSANALLLKVNQIGSVTESIEAVRMSKKAGWGVMTSHRSGETEDTFIADLAVGLATGQI

SEQ ID NO: 6054 - protein, 181 aa, Saccharomyces cerevisiae
MSISESYAKEIKTAFRQFTDFPIEGEQFEDFLPIIGNPTLFQKLVHTFKTHLEEKFAKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 6055 - protein, 271 aa, Mannheimia succiniciproducens MBEL55E
MKNKLLTFIGGGNMAQAIVFGLLNKGYSAAKLIVCDRNEAKRNLFAQKGVEVNLTNVEAAEKAEVVVLAVKPQAMAETCGPLSAVDFSGKLVISIAAAVSVSRLSALLPTAKNIVRVMPNTPALVSEGMAGLFASAGLNGEYQDFAEDLLNAVGKTCWLQKEEDMHAVTAGSGSSPAYFFLFMEAMEKTLSSMGISPENARTLVQQSALGAAKMVENNPQLPLSTLRENVTSKGGTTAAALAVFNQYQLDKIVQQAMEACVARSQEMEKLF

SEQ ID NO: 6056 - protein, 355 aa, Nitellopsis obtusa
LELRDGGKEFMGKGVLKAVSNVNDIIAPAVIGMDPADQTKIDELMVQQLDGTQYEWGWCKQKLGANAILAVSLAVCKAGAGVLNVPLYQHIANLAHNPNLILPVPSFNIINGGSHAGNKLAMQEFMILPTGASSFKEAMKMGTEVYHNLKSIIKKKYGQDATNVGDEGGFAPNIQDNKEGLELIKEAIAKAGYTGKVTVGMDVAASEFYTEASKTYDLNFKTDNNDGSGKISGQQIIELYQSFCEDYPMVSIEDPFDQDDWEHYAKFTALIGEKVQIVGDDLLVTNPKRVAKAIAEKSCNALLLKVNQIGSVTESIEAVRMAKKAGWGVMTSHRSGETEDSFIADLAVGLATGQI

SEQ ID NO: 6057 - protein, 359 aa, Pycnococcus provasolii
VELRDKDTAPDDYMGKDVLQAVSHVNREITTLHVGKVPTDQKAIDVAMIALDGTENKGRLGANAILTASIAVCKAGAAESGVPLWRHIGKLANNVTFVLPVPAFIIINGGSHAGNRLAFQEYMILPTGASSLTEAMKMGSEVYHKLKDIIKAKYGQDSVNVGDEGGFAPSLENNEEGLKLIVEAIEVAGYTGKVKIGMDVAASEFLVPAASEIAIYKYDLDFKAPEGAAKDEKLAAMPGDELRALYASFVQNYPVISIEDPFDQDDAENTTALTADDLCQIVGDDLLVTNPKRVQRAIDGKWCNALLLKVNQIGSVSEAIEAVGMSKNAGWGVMTSHRSGETEDSFIADLAVGLATGQI

SEQ ID NO: 6058 - protein, 370 aa, Arabidopsis thaliana
MHLPEDLVLEILSKVPAVSLARFRSTCRRWNALVVDGSFAKKHYAYGPRQYPIVIMLIEFRVYLVSIDLHGINNNNGAPSAKLTGQFSLKDPLSNSSEEVDIRNAFHCDGLLLCCTKDRRLVVWNPCSGETKWIQPRNSYKESDLYALGYDNRSSSYKILRMHPVGNPFHIESEVYDFASHSWRSVGVTTDFHIQTNESYGMNVKGTTYWFALSKDWWSSDDRRFLLSFDFSRERFQCLPLPADVKNLHLTVVLSVTREEQQLCMFATLGAGNVYKLDVFVATKTEETTGELTWTKFRRFHSKICINVSADHEKKVLVPHHILLPYYNILHIVGEDIYIRQVNKDGDIGCPILLTYVPSLVQIQQATGLI

SEQ ID NO: 6059 - protein, 449 aa, Streptococcus agalactiae A909
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAACGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASKAADEFGDSGNLVLGANIAGFLKVAQAMSAQGIV

SEQ ID NO: 6060 - protein, 87 aa, Triticum aestivum
MAMRALYNEIRAMKVREVPAYLKPRLTWANVKKSTDQAVDRYIEKYIETSSADPLFHICFGGMAFSYLVGLPQERRHLEHLEKHGGH

SEQ ID NO: 6061 - protein, 270 aa, Vitis vinifera
MGVWGVVLVCLLICARVPSSWSDPDDEACLTHLSESLEDPTKSLQNWTKSTFANACSGFTSYLQGATCNNGRIYKLSLTNLSLRGSISPYLSNCTNLQSLDLSSNSLTGPIPSDLQSLVNLAVLNLSSNHLDGEIPPQLAFCAYLNVIDLHDNSLSGPIPQQFGLLVRLSAFDVSNNRLSGPIPPNLGNRSGNFPRFNASSFEGNKDLYGYPLAPLKSRGLSILAIVGIGLGSGFVSLVLSFTAVCIWLRVTEEKMASEEGKISQLMPDY

SEQ ID NO: 6062 - protein, 356 aa, Streptococcus agalactiae A909
MAKKLLILEDGTVFEGLSFGSSLDVTGELVFCTGNTGYQEIITNPSHNGKILVFTSPLIGNYGIHRSYSEAIIPTCLGVVVAEYSRCVSSDTSKMNLDEFLKMKKVPAMSGVDTRYLMQVIKEKGFVKATLAEAGDVLSHLQDQLIATVLPTNNVEQVSTKTAYPSPASGRNIVVLDFGLKHSILRELSKRQCDVTVIPYNTSLEGIKNLYPEGIILSNGPGNPEKLQEVLNTIKELQKSVPMLGIGLGHQLIAMANGAEIMRLPVAKKGPNYPMRDIATGRLETVSQFNHFTVNRLNLPHDLLVTHEGLNDQEIVALRHRSFPVMSVQFYPEAAPGPHDVTYFFDEFLEMIGSRA

SEQ ID NO: 6063 - protein, 164 aa, Bacteroides thetaiotaomicron VPI-5482
MATAYHNLSEYDFNSVPNAENMKFGIVVSEWNFNITGALLNGAVNTLKKHGVKDENILVKTVPGSFELTFGANQMMENCDVDAIIAIGCVIKGDTPHFDYVCMGATQGITELNATGDIPVIYGLITTNTMEQAEDRAGGKLGNKGDECAISAIKMIDFVWSLNK

SEQ ID NO: 6064 - protein, 515 aa, Vibrio vulnificus YJ016
MNADANRIRANETIRKANMTRSVPLFIQGSFVESQSNEWIDVTNPATGEVIARLPCATPAEMTSAITFASEAFQSWKEVAVSERARLMLRYQHLLKENHDALAQLLSQETGKTLADAKGDVWRGIEVVEQAANIASNMMGETVENVATDIDSYSLIQPLGVCCGITPFNFPAMIPLWMFPIAIASGNTFVLKPSEQVPLTSVRLAQLFADAGAPDGVLQIVHGGKAQVDFLLTHPDVRAVSFVGSVPTAQYIYQTATQNFKRVQAFAGAKNHMVVMPDANKAQVLSNLVGASVGAAGQRCMAISVAVLVGDAKHWVADLKAELAKVKPGAWDDATAAYGPLISAAAKQRVLGLIAEGKAQGAVCELDGSQCQVAGYPNGNWVGPTLFSGVTTEMSIYQQEIFGPVLVCLEVDSLEEAIALINRNPYGNGTSIFTANGAAARKFQHQIQVGQVGINVPIPVPLPFFSFTGWRGSFYGDLHAYGKQAVRFYTETKTVTARWFEEDLPSGPNMTIQLR

SEQ ID NO: 6065 - protein, 308 aa, Burkholderia sp. 383
MTAAFPEILALGEAMIEFNQSQPGRPEFLQGFGGDTSNFCIAAARQGASTGFVSAIGDDPFGRLLADMWRAEQVDTTYVRVDRSAPTGVYFVTHGADGHQFDYLRAGSAASRYAVGDLPLDALAAAKAVHLSGISLAISTAACDAAFAGIDHARRNGAKVSFDTNLRLKLWPLPRARAVMREALRQTDICLPSWDDVTALTGANDRDAIVDAMLEHGPQVVALKLGKEGAYVATPNERRVVPGFAVEAVDATGAGDCFGGAFVARIVAGDDPFAAARYANAAAALSTTGYGAVAPIPHRDAVERLMQG

SEQ ID NO: 6066 - protein, 395 aa, Vibrio fischeri ES114
MLQNIATPAKDPILSLSIEYRADDRDNKVDLGIGVYRNDQGLTPIMKAVSDSVKSIAAEQTTKAYVGLAGCEVFNQSMVDLLLRDTSAYERVSAIQTPGASGALRMLADLIKSTEPGATVWISNPSYVNHQPVMEAAGLNVRHYTYFNPLTKQVDSEAMLADLANAGPKDIILLHGCCHNPTGADIRLSDWIAITELALKNGFIPFVDIAYQGFGDGLEADAAGLRFMADRVPQMFIATSCSKNFGLYRERTGAAMVIAGNIEIAMNAKAKLLQMARATYTMPPDHGAAIVGRILNDEQLTLSWRTELDEMQKRLVGLRTNLCEALRNETQSETFDFIEQHKGMFSVIGFTPEQMASLKSEHGIYAVGDGRINIAGMQEKHIEYIAKSVASVANK

SEQ ID NO: 6067 - protein, 439 aa, Ralstonia solanacearum GMI1000
MTHLALLDSLESAARTTPLIRRFGKVVEVTGTLLRVGGVDVRLGELCTLTEADGTVMQEGEVVGFSEHFALVAPFSGVTGLSRSTRVVPSGRALSVGIGPGLLGRVLDGLGRPADGGPPLDVVEYVPVFANAPDPMTRRLVEHPLATGVRVIDGLATLAEGQRMGIFAPAGVGKSTLMGMFARGTECDVNVIVLIGERGREVREFIEQILGEEGMRRSVVVCATSDRSAVERAKAAYVGTAVAEYFRDQGLRVLLMMDSLTRFARAQREIGLAAGEPPTRRGFPPSVFAELPRLLERAGMSAAGSITALYTVLAEDESGNDPVAEEVRGILDGHLILSRDIAARNRYPAIDILNSLSRVMTQVMPRDHCDAAGRMRQLLAKYNEVETLLQMGEYKEGSDPVADAAVQWNDWMESFLRQRTDEWCSPDETRRLLDEIALA

SEQ ID NO: 6068 - protein, 534 aa, Vibrio vulnificus YJ016
MAVLPTKARKEDALYQSNYQTLAELVRKLSANLNLVHQGGGVKAQQRQREKGKLPVRERIAKLLDENTSLLEIGQFAAWNVYDEPIACAGVVAGIGQIQGIECMVIANDPSVKGGTYFPLTVKKHLRAQEVAMKCQLPCVYLVDSGGANLPHQAEVFPDKDHFGRIFYNQARMSAAGIPQIAVVLGPCTAGGAYIPAMADVSIIVRQQGTIFLGGPPLVKAATGEIVSEEELGGADVHCKKSGVADYYALDEQHALQLARQAIESCNAPALPCAPKPVLEPRYPADEIYGIVNANLRLSFDVREVIARMVDDSDFDEFKAMYGPSLVCGFAHLLGFPIGIVANNGILFSESAQKGAHFIELCAKRKIPLLFLQNITGFMVGKKVEAEGIAKHGAKLVMAVACADVPKFTVIIGGSYGAGNYGMCGRAYDPTMLWMWPNARISVMGGEQAAGVLTQVRRDVKARQGEHWPEQDEHDYRQSILELYESQGNPYYASARLWDDGIIDPVETRAIVGRALRASLNAPIGDSEFGIFRM

SEQ ID NO: 6069 - protein, 131 aa, Triticum aestivum
  misc_feature (93)..(93): Xaa can be any naturally occurring amino acid
NKFVQKSRLVPVRNSRDIVDPRVRTDTVKLSTCQRLLLLQYDKKTEAIDFLHYSIKLHPGGVSRKIRKLVQNSQMPYLTDLKDVNDYVEKAGXGSKGEPNHQGGTVSLGSDIDKLSGAALKSARRLPHIQR

SEQ ID NO: 6070 - protein, 281 aa, Leavenworthia uniflora
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 6071 - protein, 335 aa, Oryza sativa
  misc_feature (194)..(194): Xaa can be any naturally occurring amino acid
  misc_feature (204)..(204): Xaa can be any naturally occurring amino acid
  misc_feature (225)..(225): Xaa can be any naturally occurring amino acid
  misc_feature (261)..(261): Xaa can be any naturally occurring amino acid
MSVGATLAKVAVLGSGSFGTAMASVVARNGYDVCILSRKAHVSESINTKHQNPDYLTSFELPANLRATTDPQEALKDAQFVVHCIPLQATEDYLKNISSFFPPSATVISTSKGLHSQTLEMMCDLLPRVLGPAHPTCFVSGPSFAKELMERRPTGLVLASKSVEAAKSARSLFASDYVRVYLSTDVIGVELGGXLKNIFAIAAXGRGHGLGMNTTAMLVTRGCRXMTRFTEAMGASHATFTDLAGIGDLMLTCFGSLSPNXPVALRLGRGKTIQTSLQTSMKGREGVATTPAGGPLAPKYRVLAPIMVPLAPSLLGKSRALPGFPRLEAIPPPLT

SEQ ID NO: 6072 - protein, 322 aa, Leavenworthia crassa
GQTPLFPRIFGHEAGGIVESVGEGVTDLQPGDHVLPIFTGECGDCPHCHSEESNMCDLLRINTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLNGEGIRCIITMGA

SEQ ID NO: 6073 - protein, 1180 aa, Aspergillus niger
MARHGDTRSPSPVGSTYSSSRRNRRDDDRYERSRRDDGRSYRRSRSPERRYRERERDRDRDAFRRRDRSLDRRDEDSYRPGRRERSRDRRRSRERDDYRRRSRDRDYRSRREDSRDRARRRTDDSADLKYKSRRDDSRDRAKDAPRSRETSKPSTPAATAAPTEDEKRAERLAKLEAWKQKQAAEKERKQREAAAAGGARSILEEIDRKSGLSPAVSSPQSPATPGVDATPGTYTGKFDPKAIAKSASSTPAPPAVLGNDVAVPPSVKPVTTIPSQVKPKSTTSASATLKAKGNVGGFGLGTKQAADTEKSTATKTLGFGEEESTRRKLERLPTPPLEDAKDVNGTADGAADEDEDDVDMQDGGTEEEAAAAARAAAERREERLQSEAIKAQSNGAESNDTVMGDAPSQEAADNMEVDAQEEEEIDPLDAFMSELAESAPPKKKVGAKFSRTKEQQPEALFGDEHDIDMTAVGDGDADDFLAIANKAKKKKDIPAVDHKKVEYETFRKKFYTEPSDLAQMSDEEAASLRLELDGIKVRGVDVPKPVQKWSQCGLGVQTLDVIDKLGYEKTTSIQAQAIPAIMSGRDVIGVAKTGSGKTIAFLIPMFRHIKDQRPLDNMEGPVGLIMTPTRELATQIHKDCKPFLKALNLRAVCAYGGAPIKDQIADLKRGAEIIVCTPGRMIDLLAANAGRVTNLRRVTYVVLDEADRMFDMGFEPQVMKIMANIRPDRQTVLFSATFPRNMEALARKTLTKPIEIVVGGKSVVAPEITQIVEVRNDDQKFVRLLELLGNLYSSDENEDARALIFVDRQEAADALLRELMRKGYPCMSIHGGKDQIDRDSTIEDFKAGIFPVLIATSVAARGLDVKQLKLVVNYDAPNHLEDYVHRAGRTGRAGNTGTAVTFLTEDQERYSVDIAKALKQSGQKVPEPVQKLVDAFLEKVKAGKEKASASGFGGKGLERLDQERDAARMRERRTYKTGEEGEDEEEKEEKNEQAEERFNKAISSVQSTAAPSLPGVPKGIDLDGKITVHKTEKDPNSTSKNPLDKVGSAVADIHARLSRAGVMRSGVPIDNRGPDAGAFHATLEINDFPQKARWAVTNRTNVAKILEATGTSITTKGSFYPTGKVPGPGENPKLYILVEGETELAVTNAMRELMRLLKEGTIAAADSDARAPVGGRYNVV

SEQ ID NO: 6074 - protein, 322 aa, Leavenworthia stylosa
  misc_feature (253)..(254): Xaa can be any naturally occurring amino acid
  misc_feature (256)..(256): Xaa can be any naturally occurring amino acid
GQTPLFPRIFGHEAGGIVESVGEEVTDLQAGDHVLPIFTGECGDCPHCHSEESNMCDLLRINTERVGMIHDGESRFSIKGKPINHFLGTSTFSEYTVVHSGQVAKINPEAPLDKVRIVSCGLSTGLGATLNVAKPKKGQSVAVFGLGAVGLGAAEGARIAGASRIIGVDLNSNRFEQAKKFGVTEFVNPKEHDKPVQQVIAEMTNGGIDRSVECTGSVQAMIQAFECVHDGWGVAVLVGVPSKDDASRTHPMXXLXERTLKGTFFGNYKPKPDIPGVVEKYMNKELELEKFITHTVPFSEINKAFDYMLNGEGIRCIITMGA

SEQ ID NO: 6075 - protein, 224 aa, Mannheimia succiniciproducens MBEL55E
MMKKLLSTAAALLVSGFILSGCSTTEKHWGYTGDVSPEYWGGLSDKFKTCAVGQKQSPVNIQVQKATDKDLPALNINYLASKATVVNNGHSIQTDLTDENSTLTINGKVYTLKQFHFHSPSENTIDGQYLPLEGHFVHVAKDGGIVVVAVLYEIGGENAQLADIWAGMPEKAGEKVKLKAKFNPATLISSKQSYYSFEGSLTTPPCTEGVDWIVLKAYCSGQLI

SEQ ID NO: 6076 - protein, 167 aa, Zea mays
GGRRLGAWEPGSGTLGGLAWPLGRLGAVAEDEKKFRYKEDVLNHKKKDADKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQVKALSS

SEQ ID NO: 6077 - protein, 407 aa, Oceanobacillus iheyensis HTE831
MDVNAIKQQFPILNQEVNGHPLVYLDSSATSQKPLSVIEAVNAYYRENNSNVHRGVHTLGTRATDQYEGSREKVRSFINANSTKEIIFTRGTTTSINIVASSYARMNVGPGDEIVITQMEHHSNLIPWQQVAKATGASLVYLPLQEDGTITIEDAKKTITDQTKIVAMAHVSNVLGSINPIKEIAAIAHQHDAIMVVDGAQGAPHMKVDVEDLDCDFYAFSGHKMCGPTGIGVLYGKQHLLENMEPIEFGGEMIDFVNLYDSTWKELPWKFEGGTPIIAGAIGLGAAIDFLENIGYQEIVNHENELAAHALKQMRTIDGISIYGPEQRAGLVTFNLDDVHPHDTATVLDAEGIAVRAGHHCAQPLMKWLNVSATARASFYLYNSKEDVDRLVEGLLKTKEYFGNVFE

SEQ ID NO: 6078 - protein, 335 aa, Salmonella typhimurium
DPTGKIVERFTPEVAPISEERVIDVAPPSYASRVGVREPLITGVRAIDGLLTCGVGQRMGIFASAGCGKTMLMHMLIEQTEADVFVIGLIGERGREVTEFVDMLRASHKKEKCVLVFATSDFPSVDRCNAAQLATTVAEYFRDQGKRVVLFIDSMTRYARALRDVALASGERPARRGYPASVFDNLPRLLERPGATSEGSITAFYTVLLESEEEADPMADEIRSILDGHLYLSRKLAGQGHYPAIDVLKSVSRVFGQVTTPTHAEQASAVRKLMTRLEELQLFIDLGEYRPGENIDNDRAMQMRDSLKAWLCQPVAQYSSFDDTLSGMNAFADQN

SEQ ID NO: 6079 - protein, 248 aa, Bacillus cereus ATCC 14579
MIIRNEQDLEGLRKIGRIVALAREEMKKQAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVRAGSKQNQIGRAVSNFAHKSGYNVIQNLTGHGIGLSLHEAPNHILSYYDPMDNALLKDGLVIAVEPFISMKADHIIERGDDGWTFVTPDKSLVAQCEHTVVVTRGEPIILTEI

SEQ ID NO: 6080 - protein, 197 aa, Vibrio vulnificus YJ016
MPNLTNLKEIKNMINTTIKPFSATAYKDGKFVDITEQDVLGKWSVFFFYPADFTFVCPTELGDLADHYEELQSRGVEVFSVSTDTHFTHKAWHDSSDTIGKIKYFMVGDQTGNITNNFGVMRPGQGLADRATFVIDPQGVIQAVEITAEGIGRNAEDLLRKIKAAQYVAAHPGEVCPAKWKEGEQTLAPSLDLVGKI

SEQ ID NO: 6081 - protein, 318 aa, Shewanella sp. MR-4
MSRPIILDCDPGHDDAIALILALAHPELNPLAVTTSAGNQTPDKTLNNALRILTLLNRSDIPVAGGAVKPLSRELMIADNVHGETGLDGPALPAPSFQPQAVNAVELMAEKIRQSDKPVTLVPTGPLTNIALLLASHGELHAKIERIVLMGGAAGVGNWTPAAEFNIFVDPEAADIVFKSGIPITMCGLDVTHQAQIMDEDIERIRAIPNPVAKCVAELLDFFMIYHRDPKWGFVGAPLHDPCTIAWLLNPALFDAQDCWVGIETQSELTLGMTVVDRYQLTGKPTNATVLFGIDRQGFVDLLVDSLAVYTPTYLNRR

SEQ ID NO: 6082 - protein, 303 aa, Shewanella sp. MR-4
MSHILVIGSANADHVMNFEYLPAPGQTLMSRSYRLEHGGKGANQAVACARLCQADSRVDFICHLGQDSVGNEMRENWLKDGIEADGITQVANLSTGTAMIFVADNGENSIGIAAGANANLTPPELEKHYALFVNAQYMLIQLETPMETVNHALQTAKRLGITTVLNPAPAVSQELDYLKWVDIITPNETEAEALTGIEVNNEDDAKLAAQLLHQQGVTTVVITLGSKGAFISSAGFTGLIPALEVQAIDTVAAGDTFNGALVVGLSEGMSIAAAVGFANAASAITVTRAGAQRAIPYRHELPR

SEQ ID NO: 6083 - protein, 316 aa, Bradyrhizobium sp. ORS278
MHKPVDLTDTAAFETQLDRWRGRIGEAVAEAMAFGTTVPAPLQAGMSHAVLAGGKRYRGMLVLALGSDLGVPEEQLLSSAVAIETIHAASLVVDDLPCMDDARRRRSQPATHVAFGEATAILSSIALIARAMEVVARDRQLSPASRSSIVDTLSHAIGPQALCGGQYDDLYPPYYATEQDLIHRYQRKTSALFVAAFRCPALLAEVDPETLLRIARAGQRLGVAFQIFDDLLDLTGDAHAIGKDVGQDHGTVTLATLLGPARAAERAADELAAVQKELRETVGPGRALDLIRRMAARIAGTGKKSAGRDDLRPHAG

SEQ ID NO: 6084 - protein, 226 aa, Vibrio fischeri ES114
MKYQWILFDADETLFHFDAFAGLQRMFAGYGVEFGKEEFIEYQLVNKPLWIDYQNNEITAQQLQETRFEEWAKKVGVTPKAMNSAFMMAMAEICTPLDGARELLDSLLASNVKMGIITNGFTELQKIRLEKTEFSHYFELIVISEQVGIAKPDKRIFEHTFSMIGNVDLSTVLMVGDNPDSDVLGGMNAGIDTCWLNVDGKACPEGVEPTYEVASLSELKTILKSL

SEQ ID NO: 6085 - protein, 813 aa, Arabidopsis thaliana
MNCNVLFLLSVLVSVTAGVTAAYHPTDVFLFNCGDTSNNVDNSGRNWTVESRQILSSNLVNASFTSEASYQKAGVSRIPYMKARIFRSEFTYSFPVTPGSIFLRLYFYPTQYKSGFDAVNSFFSVKVNGFTLLRNFNADSTVQASIPLSNSLIKEFIIPVHQTLNLTFTPSKNLLAFVNGIEIVSMPDRFYSKGGFDNVLRNVSSDVDFQIDNSTAFESVHRLNVGGQIVNEVDDSGMFRRWLSDDSFGNSGSIVNVPGVKINYTEKTPAYVAPYDVYATSRLMGNSSNLMFNLTGMFLTVDAGYNYLVRLHFCETLPQVTKAGQRVFSIFVEDKMAKKETDVIRLSGGPRIPMYLDFSVYVGFESGMIQPELRLDLVPLKDTNQTYYDAILSGVEILKLNDSDGNLARPNPELLVSTDSTPDDSNVTPPIKGKPHVLVIILIVVGSVIGLATFIVIIMLLIRQMKRKKNKKENSVIMFKLLLKQYIYAELKKITKSFSHTVGKGGFGTVYRGNLSNGRTVAVKVLKDLKGNGDDFINEVTSMSQTSHVNIVSLLGFCYEGSKRAIISEFLEHGSLDQFISRNKSLTPNVTTLYGIALGIARGLEYLHYGCKTRIVHFDIKPQNILLDDNFCPKVADFGLAKLCEKRESILSLIDTRGTIGYIAPEVVSRMYGGISHKSDVYSYGMLVLDMIGARNKVETTTCNGSTAYFPDWIYKDLENGDQTWIIGDEINEEDNKIVKKMILVSLWCIRPCPSDRPPMNKVVEMIEGSLDALELPPKPSRHISTELVLESSSLSDGQEAEKQTQTLDSTII

SEQ ID NO: 6086 - protein, 446 aa, Photobacterium profundum SS9
MRDLFQELNARLSLAVEHVPDVPIARTYGRLTRMAGLTLEAVGCRLCTGQRCMIETDHGTLVEAEVVGFDRNASVLMPIRHTTGLRPGSRVFPLHGDSKINVGYSMLGRVLNGLGEPLDSRGPITADQRINLQGETINPLQRLPISTQLDVGVRVINSMLSVGKGQRMGLFAGSGVGKSVLLGMMTRNTTAEITVVGLIGERGREVREFIEHSLGPEGMKNAVVIASPADDPPLMRLRASMLCHRIAEFFRDQGHDVLLLMDSLTRYAQAQREIALAVGEPPATKGYPPSVFSMLPQLVERAGNGATEKGSITAFYTVLSEGDDQQDPIADAARAILDGHIVLNRELAEQGHYPAIDIEQSISRAMPQVVTPEQLQKAQQVKQLYARYRQVQDLISLGGYQQGQDQNLDMAVHYYPEICDFLQQGMNERVLLADSQQQLMQLTGGQ

SEQ ID NO: 6087 - protein, 196 aa, Vitis vinifera
MFGFITNPSSITFNPTTSKYSVILAGKTIETTLTDKAAIADEWVREILSIHAGKPMVVGLDIEWRPHPIRSMSNKSATLQLCIDDKCLILQLFYMDEIPESLKSFLADSNFTFVGIEVGDDIAKLKNEYGLDCSRSADIRDLAMQRWPGRFRRPGLKDLAWEVTNLPHEKAQACNGYIKKSFFASFLIIPTRPSAY

SEQ ID NO: 6088 - protein, 219 aa, Vitis vinifera
MVARNYTELMIMMNPNNTITFNPNTSKYSVNFAGKTIETTLTDKAAIVDEWVQEILSIYAGKPMVVGLDIEWRPNRIPSMSNKSATLQLCINNKCLILQLFYMDEIPQSLKGFLLDSNFTFVGVEVGADIDKLKNEYGLECSCSADVRILAMQRWPGRFRRPGLKDLAWEVVNLRMKKPKHVCMSNWEARVLNENQVDYACIDAYASYRIGHKLIIEKY

SEQ ID NO: 6089 - protein, 339 aa, Vibrio vulnificus
MCADDGSGYGTDHCRQLMQMPKVDVLSRIEALTGKQPTFYQGDIRDEAFLDSVFAQHDIQAVIHFAGLKAVGESVAKPLEYYDNNVNGSLVLARCMRKAGVKSIVFSSSATVYGDPEIVPITEDSPTGATTNPYGRSKYMVEQCLSDLFLAENDWSITLLRYFNPVGAHPSGSMGEDPQGIPNNLMPFIAQVAVGRREKLSVFGNDYPTPDGTGVRDYIHVMDLADGHIAALKSVGATSGLHIYNLGTGKGSSVLEMVEAFAAACGKPVPYELCPRRPGDIAECWARAHLEEAERELGWKASTLCIGGRNDRRYVELAVETIPMAISSVLAVTALSSAF

SEQ ID NO: 6090 - protein, 541 aa, Rickettsiella grylli
MNGAPSRFTHSDEWKNLKQHASDLKKIPLTELFLNDPFRAKTFSLTEKPLTVDYSKNPILEKTLTLLIQLADRLHLKQKINDLFQGACVNTTQHLPALHTALRNPHKKGLLINGEDILVKIHTNLDKMQQFVDAIHQHRWRGWSGKKITDIIHLGIGGSDLGPRMVVHALKKTWKENSINLHFISPIDDSLSYLIKKINLETSLFIITSKSFRTHETLSSATQLFKHFQEKYGAQSTKRHFLAVTHHIEKAIAFGIDPAHIFPLWNWVGGRYSLWSAVGLPIALAVGMSNFRTLLQGAYTMDQHFLNQPWRTNLPVILGLLGVWQVNFFQTSAHAILPYDTRLHYLPAYLQQLEMESNGKSISIHGKPIDYATCPIIFGAHGLNAQHTFYQLFHQGTAHFSADFICTLRDPSMNINDHRQVISSVLSQSKVFMEGYVSDNGYQCLPGNHANTILALNELNPFSLGLLIALYEHKVFVQSVIWQINPFDQWGVEYGKQLNKTIYQQLNNTDTSLMTPLDSSTRAFIERFQTLNCSLKHTRKI

SEQ ID NO: 6091 - protein, 415 aa, Pseudomonas fluorescens Pf-5
MSHENISRSISTVHPIRLSHGRNAEVWDIDGKRYIDFVGGIGVLNLGHCHPRIVSAIQQQATRLTHYAFNAAPHGPYIEFMQRLANFIPVSYPVSGMLTNSGAEAAENALKIVRGATGRSAVIAFDGGFHGRTLATLNLNGKVAPYKQKVGVLPGPVYHLPYPSADNDVSCEEALKALRRLFSVEIDVQEVACFILEPVQGEGGFLALDATFARALRSFCDEHGILLIADEIQSGFGRTGQRFAFSRLGIEPDLILLGKSIGGGVPLGAVVGRKALLDVLPKGGLGGTYSGNPIACAAALATLDEMTDEHLQAWGERQERAIVQRYEHWKSSGLCPFLGRLTGVGAMRGIELVNARGEPAPEQLSTLLGSARDAGLLLMPSGKSRHIIRLLAPLTTEPEIFEEGLDILQECLARL

SEQ ID NO: 6092 - protein, 354 aa, Zea mays
  misc_feature (220)..(220): Xaa can be any naturally occurring amino acid
MGVYLSTPKTDKVSEDGENDKLKFGLSSMQGWRATMEDAHSALLDLDNDTAFFGVFDGHGGKVVAKFCAKYLHREVLHTEAYAAGDLGAAVHRAYLRMDEMMRGQRGWRELQALGDKINQFTGIIEGLIWSPKASDSNDRHDDWAFEEGPHSDFTGPNCGSTACVALVRNRQLVVANAGDSRCVISRNGQAYNLSRDHKPELEAERERIQSAGGYIKMGXVNGSLNLSRAIGDMELKQNKFLSPDKQILTANPDINIVELCDDDEFIVLACDGIWDCMSSQQLVDFIREHINTEESLSAVCERVLDRCLAPSTAGEGCDNMTMILVQFKKPFAQVKDASGAEQLTGDAGCSETQ

SEQ ID NO: 6093 - protein, 282 aa, Vibrio vulnificus
VTFVTARFCNTSLLSTISRRYPLCRPIRSDWRIGCTPLYGYHIYCVRHPISHATGKLDTAGVKSLIFLFRQPPSMVISLSEPIREDFPTSATNPYGRSKLKVEETLTVFHKANPHWSITLLRYFNPVFCSRVWLARSGSSRHSKQLIALCRSCVSLVDAKNCLVFVDKYTTPHGTGVRDYIHVIDLADGHLASLYKVGQQAGLHIFNLVTGQGNSVLEMVAAFEKAAQRPIPYEIKPRRAGDIAECWADPAYAEQVLGWKATRSLETMVVDTWRWQSASLHL

SEQ ID NO: 6094 - protein, 380 aa, Chlamydomonas reinhardtii
MAANLRYCFISEWLDPASGILWKYQLFYYPESKEVEMVDIKNRRHFLKRTKYEELKPSLLFLGSVVTVFSRQLKLTEYGDEFTRNRMESQSERTLAMIKPDAYKNMGKIINAICQSGFLISKLRIGKLSKEEAGEFYAVHAGKPFVDRLTDFMSSGRVVAMELVAPGAIRKWRELIGPTDSNQARAEAPGSLRAQFGTDKTFNACHGSDAPDTAAEECNFWFGPGRYPGKCDLAAGTTLCLVKPHLVADGAAGLVIDLIQESFEVTAGGLYNLDRNAAAEFLEVYKGVLPAGDFNSMVEQLTSGACIALEVADRDGADAVEPFRQLAGPLDPELGRVLRPASLRARFGLDAVRNGVHCTDLPEDGVLEVNYFFTILPTAS

SEQ ID NO: 6095 - protein, 618 aa, Arabidopsis thaliana
MGSQTARFCLILLFLFYYLPCALSQDDLWGCGTPFRCGNITAGFPFLGGIRGEVCGHHSLKLNCNKHSNTTSLIFSGHNYTVLYIDNNNNSVTLGLSRQDFSGPFCSASFSSTLLSSGLFQNLPSYKSLTVFYACDPRRHFLGNFTCPVKGLGSIIQNSTYGILCDGSFSVPVPTSFVSEEEVLDLTHLESVLRKGFEVKLNIDEIPCPLECFSSRANCLFLAGSCCKYHDRTTTCGGDTGDLLREIIPNTRSILITIGQVVGFHVFIIVVMIIAFLFWRRKKVNDLRKQNLEALVTSRRYSYRQIKKITKSFTEVVGRGGFGTVYKGNLRDGRKVAVKILKDSNGNCEDFINEVASISQTSHVNIVSLLGFCFEKSKRAIVYEFLENGSLDQSSNLDVSTLYGIALGVARGIEYLHFGCKKRIVHFDIKPQNVLLDENLKPKVADFGLAKLCEKQESILSLLDTRGTIGYIAPELFSRVYGNVSHKSDVYSYGMLVLEMTGARNKERVQNADSNNSSAYFPDWIFKDLENGDYVKLLADGLTREEEDIAKKMILVGLWCIQFRPSDRPSMNKVVGMMEGNLDSLDPPPKPLLHMPMQNNNAESSQPSEEDSSIYSEV

SEQ ID NO: 6096 - protein, 436 aa, Fusarium proliferatum
MSVHWHGLRQLETFEMDGVNGVTQCPIAPGDSYTYTFRAVQYGTSWYHSHYSLQYADGLAGPITIYGPSSAPFDEGRNPILITDWSHRSAFQSWQRELVPNPTRPMMNGVLINGVGNFAGSFPRERFNMTVTKGKKYVLRVINTSVDTTWIFSIDNHNFTVMSTDFVPIQPYSVSHLVLGIGQRYHIVLDANPTNTTKMPANPDGNYWVRTVGATGCKGFEPGNEPDERQGILRYNASSKLVPTTFRENYSLECRDEAYDRLSPVYEWNVDKVKINYTKSQFDIGLSKFAHRPELMDNFTWWAFGENPLWLNFSNPTILNLKNTTWNPDYAVDLVVPDEKKDKWVYIAITAPPAPMKTKPNRAFAPVAHPLHLHGHDFALLAQGTNFSDLDTGKVNLKFDNPPRRDVALLPAGGYLVVAFKADNPGSWLFHCHIES

SEQ ID NO: 6097 - protein, 450 aa, Physcomitrella patens subsp. patens
MPPSTMHDNYPSTPGKVKVERSNYFGRVASRWHTTASTRLLACTAVLLTLTLFVFYRMSGTSGGAIDGGIVGRSVAAFKPTHQWELKVRQSCLPKRSEEEAMVVLVTGAAGFVGTHVSLALKKRGDGVVGLDNFNDYYETSLKRARQDLLEKHGVFVVEGDINDETLLKALFELGQFTHVMHLAAQAGVRYAMQNPGSYVHSNIAGLVNLFEICKAANPQPAIVWASSSSVYGLNNKVPFSESDRTDQPASLYAATKKAGEEIAHTYNHIYGLSITGLRFFTVYGPWGRPDMAYFSFTRDILRGKAINIYTGNGGKDLARDFTYIDDIVKGCVGALDTAEKSTGSGGKKTGPAQLRVFNLGNTSPVTVPTLVDILEKYLKQKAKRNIIKMPRNGDVPFTHANISYAQSQFNYHPTTNLDTGLKKFVKWYLSYYGVGTDHKLWLGDHEQIV

SEQ ID NO: 6098 - protein, 374 aa, Arabidopsis thaliana
MADQTESPRSYHIFITIMSKRRTWVCLFIAVYAILVSSSWNLLRSVLNWYKLQYTSSNSDYSPSRLPAVYASVVLGAMFGAMSMVAAMTVAVPAVMVIWISVVVLLAFFGKSRRVLVVEGRKITREVVGFVFKCANVTMIEEKLSKLMEEIESVEADESEDTSDDEETKTNVHEANFDMLMAPEWDVHSFEEKTMIKDSMEASSSVVVSSCLKKRKAEFDPEDEEESNGEKEEGSDGKAKIEEPKAKTDYYFKVPEWDVDSFDALKPTDHYKGFRPMNLEWEAIRGIKNFREYREEMVYVVSKNLTKTRFDLNVELVEVVRGYYRGGPKSKSYITFMVRKKPDGPLGEYQAKCMVTLHRKRHPILCRPTPTPKP

SEQ ID NO: 6099 - protein, 209 aa, Brassica napus
  misc_feature (178)..(178): Xaa can be any naturally occurring amino acid
  misc_feature (197)..(197): Xaa can be any naturally occurring amino acid
MEEILATIAIALAATIFIVLSFSIYLTIRIFTGKSIRNKAYSPVHATVFDLLFHSQELYDYQTELATKKPTFRFLSPGQSEIFTADARNVEHILKTRFDNYSKGHSSRENLADLLGHGIFAVDGDKWRQQRKLASFEFSTRVLRDFSCSVFRTNACKLVGLVSEFALSGKSFDAQDMXMRYTLESIFKVGLGVELKXLDEFTKEGEEFR

SEQ ID NO: 6100 - protein, 470 aa, Oryza sativa Indica Group
MALPFPVPRGAHWAVTSTAHVLVGFTGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQQILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLD

SEQ ID NO: 6101 - protein, 505 aa, Mycobacterium sp. MCS
MTSSPGWPPRPRSPSPTPHPVRIRTGSRRKNSIPTSSCCSGRPAIWRNANSCPGWPTWSSPRWRPRSGWSARHWRTSAATSSGRWREAVDAFGSHELSDEEWEGFACRISYVPQSAGPEALADAVKAAKAELGPDTRRLHYLSVPPKAAKAVITMLKESGLVDRSRVVMEKPFGTDLASACELNAFVHDTFDESQIFRIDHFLGKEAAQNILAFRFANGLFEPIWNRNFIDHIQIDIPEKLGLDERADFYESTGAYKDMVVTHLFQVMAFVVMEPPTALEPRAISEEKNKVFRSMLPVDPAKVIRGQYVGYRREDGVAPDSETETFIALQVGIDNWRWAGVPIYLRTGKKMAEGQRIISIAFREAPRSMFPAGSGVGSQGPDHLTFDLADNSKVSLSFYGKRPGPGMKLDKLSMQFSTQETGRVGDVLEAYERLILDAMRGDHTLFTTAAGIESLWDRSTPLLEDPPPVKVYQPGTWGPNAIHQLIAPNAWRLPFEREWREKTPE

SEQ ID NO: 6102 - protein, 547 aa, Pseudomonas aeruginosa PAO1
MSELIRVPDIGNGEGEVIELLVKPGDKVEADQSLLTLESDKASMEIPSPKAGVVKSIKAKVGDTLKEGDEILELEVEGGEQPAEAKAEAAPAQPEAPKAEAPAPAPSESKPAAPAAASVQDIKVPDIGSAGKANVIEVMVKAGDTVEADQSLITLESDKASMEIPSPASGVVESVSIKVGDEVGTGDLILKLKVEGAAPAAEEQPAAAPAQAAAPAAEQKPAAAAPAPAKADTPAPVGAPSRDGAKVHAGPAVRMLAREFGVELSEVKASGPKGRILKEDVQVFVKEQLQRAKSGGAGATGGAGIPPIPEVDFSKFGEVEEVAMTRLMQVGAANLHRSWLNVPHVTQFDQSDITDMEAFRVAQKAAAEKAGVKLTVLPILLKACAHLLKELPDFNSSLAPSGKALIRKKYVHIGFAVDTPDGLLVPVIRDVDRKSLLQLAAEAADLADKARNKKLSADAMQGACFTISSLGHIGGTGFTPIVNAPEVAILGVSKATMQPVWDGKAFQPRLMLPLSLSYDHRVINGAAAARFTKRLGELLADIRTLLL

SEQ ID NO: 6103 - protein, 552 aa, Cucurbita pepo var. melopepo
SQIRHYKWEVEYMFWAPNCNENIVMGINGQFPGPTIRANAGDSVVVELTNKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSESCAPYIFHVSPKKTYRIRIASTTALAALNFAIGNHQLLVVEADGNYVQPFYTSDIDIYSGESYSVLITTDQNPSENYWVSVGTRARHPNTPPGLTLLNYLPNSVSKLPTSPPPQTPAWDDFDRSKNFTYRITAAMGSPKPPVKFNRRIFLLNTQNVINGYVKWAINDVSLALPPTPYLGAMKYNLLHAFDQNPPPEVFPEDYDIDTPPTNEKTRIGNGVYQFKIGEVVDVILQNANMMKENLSETHPWHLHGHDFWVLGYGDGKFSAEEESSLNLKNPPLRNTVVIFPYGWTAIRFVADNPGVWAFHCHIEPHLHMGMGVVFAEGVEKVGRIPTKALACGGTAKSLINNPKNP

SEQ ID NO: 6104 - protein, 304 aa, Shewanella sp. MR-4
MSQLYLEDGIKQLVSEFIAAGCPSVREQSLEERRQGYIASTVLAGEPEAVFEVKTLSLESIELTLFKPSADNNLPVVIYYHGGCFVSGGIATHNQQLRKIANDSGALVVAVSYRLAPEHVYPAAHDDAFNAANLVQQHCQQWGGDNTNITLMGDSAGGHLALVTCLRLKSKGQWLPKKQVLIYPMLDATAKSQSYIDNGDKYIITRDTLLTGFDMYLDWHPRTDVEASPLRSQELEGLPETHIITAEFDPLLDEGEQLFRNLLDAGVNAHCRRYLGVIHGFFQLAGVSQSARDAMVQVTHIIRA

SEQ ID NO: 6105 - protein, 171 aa, Raphanus sativus
GGAGVRGLEIQGRFVIFTVIGVYLDPVSVPSLSVKWEGKTTEELTESVPFFREIVTGAFGKFIKVTMKLPLTGQQYSEKVTENCVAIWKSLGIYTDSEAKAVERFLEVFKDETFPPGASILFALSPEGSLTVAFSKDDSIPETGKAAIENKLLAEAVLESIIGKNGVSPGA

SEQ ID NO: 6106 - protein, 121 aa, Zea mays
  misc_feature (28)..(28): Xaa can be any naturally occurring amino acid
NPRMGGPKGAPKIKKLFPLTKDYYVPKXVNPSRGTFSPKNGKKVSKALKIPRLVTPLPPQRKGARIAAKKKGILKKKFGAVEYQKLFAQRLKEQRAPRSESLAKRGSKLFAPVKAFAAPPA

SEQ ID NO: 6107 - protein, 786 aa, Rickettsiella grylli
MSRYAIPLYYFTFFLALLFAHQAEAKVQSINLVVAYKQVNFTGKSVQAIAVNNQIPGPILHLKEGQPVLINVYNRLNKGTTVHWHGLIVPWQMDGVSGVSQKPIPPGGVFHYRFTPYQSGTYWYHAHDGFQEQQGLYGGIIIDPKTPFRYHSNKDFVVVLSDWSNTPPTGIYNNLKKIDGYYDSRFPLQPSLLKFLHDYRHATPLKRQGLLQSYKMMQMSRMNIYDFSDIAYDAYLLNGRVWQRPWTRHVSVGDKVRLRFINAGASTNYNVKLDHGMMELVQVDGNNIKPYFIKHFKIEPGETYDVLVSIKHPGATVIYAESMDTLGRAMGVLTTTPNTPVNIQNIKPFPEPPPIMMMKHNGMQSSMRMPAMNLAKNSSDMGMNNRQTMSRMKNLTVGTKYQKMIAAVKTNNPNKPIEKTIHMDLSGYMNRYIWFINGVTMNNAKPILLKPGKRYRIIFTNHSMMDHPMHIHGHWFILRNGHGAYDPLLHTIVVPPMSTVVADLDADASGQWFFHCHQLYHMAAGMARVFQYTTLIDVTPANQHPKNVIKPFAYRNRAIVRVQHLPVDQRLIDHPSDPAPRFFSANLLDINQNLMNNDQEITYKGMFGGDNNKLQLYLEKAEIKQGIIENANLDMFYWHAISQFWAVKGGVNYVYRPTMTPYFQPGIGIEGLTPFFIETDIRAYYHNGSSKLDLDLTRDTQIGHNFFVRTEVEALFASKTVTHDLVGSGFNELQLTLRPYYQINPMLAIYLQYQHTGNYGYTKQLFQENNLSTNDNTYSLGVSLLF

SEQ ID NO: 6108 - protein, 55 aa, Brassica napus
MRLFDPWPVFFKREWKRTWPFLTGFAVTGVLITKLTAGFTEEDAKNSKFVQQHRR

SEQ ID NO: 6109 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 6110 - protein, 348 aa, Saccharomyces cerevisiae
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 6111 - protein, 417 aa, Saccharomyces cerevisiae
MTDPIRTKPKSSMQIDNAPTPHNTPASVLNPSYLKNGNPVRAQAQEQDDKIGTINEEDILANQPLLLQSIQDRLGSLVGQDSGYVGGLPKNVKEKLLSLKTLLCELFEVEKEFQVEMFELENKFLQKYKPIWEQRSTMISGQEQPKPEQIAKGQEIVESLNETELLVDEEEKAQNDSEEEQVKGIPSFWLTALENLPIVCDTITDRDAEVLEYLQDIGLEYLTDGRPGFKLLFRFDSSANPFFTNDILCKTYFYQKELGYSGDFIYDHAEGCEISWKDNAHNVTVDLEMRKQRNKTTKQVRTIEKITPIESFFNFFDPPKIQNEDQDEELEEDLEERLALDYSIGEQLKDKLIPRAVDWFTGAALEFEFEEDEEEADEDEDEEDDDDHGLEDDDGESAEEQDDFAGRPEQAPECKQS

SEQ ID NO: 6112 - protein, 422 aa, Borrelia garinii PBi
MDFKQIKSNAEKVKFLRKDFPILNKQFDNKHIIYFDNAATSQKPKKVIYSIIEYYENYNANVHRSGHKFAIQSSIKIEKTRELVKNFINAESSKNIIFTSGTTDGINIIANSFFYSKYFKKKDEIILTTLEHNSNLLPWANLAKLANLTIKFAKFNEMGIITPEEIEKLITEKTKLISISGINNTLGTMNDLESIGKIAKKYNISLFVDAAQMAPHIKIDVKKIGCDFLVFSGHKMLAPTGIGILYISNNMAEKLDSPKLGGNTVEEIFIKNEKIKFKSLDAPNKFESGTPNIAGIIGLKEAIKYINNISMDFILEHDQQLIEYGVKKLQELDEVEFLLNTNLKRNSIISFTVKNIHSHDIETYLDTIGIATRAGKTCSYVAFFPENLNKNHLLRISFYFYNTQEEIDIFILGLKKVIKELS

SEQ ID NO: 6113 - protein, 393 aa, Pseudomonas fluorescens Pf-5
MRYSPFVQRISGESVSAWDIHYAAIEARGRGEDVIVLSVGDPDFATDERISAAASAALEQGDTHYTHVLGRPALREAIAAKQRRLLGIEVSADNVALVAGAQNGLFATSLCLFSSGDEVLVPEPMYLTYEACIHASGAQIACVQQPAANGFRLTAAALEAALTDKTRGIALATPCNPTGNVYSREELEAVAEVARKHDLWVISDEVYGQLTYDREHLSIASLPGMAERTVILNSLSKTHAMTGWRVGWVIAPPALVGHLDNLLLCMLYGLPGFIQEAALKALELDEEVIGSAREVYRRRRDLVVAGLKQVQLLDCREPEAGMFMLVDVRRTGLSSMDFAWQLFRATGVSVLDAQAFGASAEGFVRISFTVADEVLKDACQRIAGFVETLGAQR

SEQ ID NO: 6114 - protein, 186 aa, Salmonella typhimurium
SLINTKIKPFKNQAFKNGEFIEVTEKDTEGRWSVFFFYPADFTFVCPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 6115 - protein, 353 aa, Gibberella zeae PH-1
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAVHIVKQARVKPGDSVVVMGAGPVGLLCAAVAKAYGASKIVSVDIVQSKLDFAKDFASTHVYASQRIAPEENAKNICDLAGLPDGADVVIDASGAEPSIQASIHVLKNGGSYVQGGMGKADITFPIMAFCIKEATASGSFRYGAGDYPLAVELVATGKVDVKKLITGIVDFKQAEEAFKKVKEGEAIKVLIKGPNEQ

SEQ ID NO: 6116 - protein, 476 aa, Streptococcus equinus
MTKQYKNYVNGEWKLSKEEIKIYAPATGEELGSVPAMSQEEVDYVYASAKAAQKAWRALSYVERAEYLHKAADILMRDAEKIGAVLSKEIAKGYKSAVGEVIRTAEIINYAAEEGVRLEGEVLEGGSFDPASKKKIAIVRREPVGLVLAISPFNYPINLAGSKIAPALISGNVVALKPPTQGSISGLLLAEAFAEAGLPAGVFNTITGRGSVIGDYIVEHEAVNYINFTGSTPVGEHIGHLAGMRPIMLELGGKDSAIILEDADLDLAAKNIVAGAYGYSGQRCTAVKRVLVMDSIADKLVEKVSALVNNLTVGMPEDNADITPLIDTKAADYVEGLIKDAQEKGAKEVISFKREGNLISPVLFDNVTTDMRLAWEEPFGPVLPFIRVNSVEEAIEISNKSEYGLQASVFTNNFPLAFKIAEQLEVGTVHINNKTQRGTDNFPFLGAKKSGAGVQGVKYSIEAMTTVKSTVFDIAK

SEQ ID NO: 6117 - protein, 497 aa, Saccharomyces cerevisiae
MLKSTATRSITRLSQVYNVPAATYRACLVSRRFYSPPAAGVKLDDNFSLETHTDIQAAAKAQASARASASGTTPDAVVASGSTAMSHAYQENTGFGTRPIYLDMQATTPTDPRVLDTMLKFYTGLYGNPHSNTHSYGWETNTAVENARAYVAKMINADPKEIIFTSGATESNNMVLKGVPRFYKKTKKHIITTRTEHKCVLEAARAMMKEGFEVTFLNVDDQGLIDLKELEDAIRPDTCLVSVMAVNNEIGVIQPIKEIGAICRKNKIYFHTDAAQAYGKIHIDVNEMNIDLLSISSHKIYGPKGIGAIYVRRRPRVRLEPLLSGGGQERGLRSGTLAPPLVAGFGEAARLMKKEFDNDQAHIKRLSDKLVKGLLSAEHTTLNGSPDHRYPGCVNVSFAYVEGESLLMALRDIALSSGSACTSASLEPSYVLHALGKDDALAHSSIRFGIGRFSTEEEVDYVVKAVSDRVKFLRELSPLWEMVQEGIDLNSIKWSGH

SEQ ID NO: 6118 - protein, 458 aa, Oryza sativa Japonica Group
MGLVYFWAATATRRWWPICVMSSTARPHGDVTVPDPAGGPHLPGAHNSRHDELYLWGVREVVVLLRPSAIAADRSIRSHSFSDAGDGRFPPGGVEPETPPGSSSGGSTPVGGKPPRHHLTSIRHCASSARIAAATAEFDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 6119 - protein, 205 aa, Pinus taeda
MPSVSELTKEEEETLAAKLEQQELEHSDEPILEDDEDDDDEEDDNDEDDAQGEQGGEGKSKQSRSEKKCRKAMLKLGMKPVSGVSRVTIKKSKNILFVISNPDVFKSPTSDTYIAFGEAKIEDLSSQLQTQAAEQFKAPNLSHVTMKPESSTAAQEDEDEVDDTGVEPKDIELVMTQAGVSRTKAVKALKAADGDIVSAIMDLTT

SEQ ID NO: 6120 - protein, 486 aa, Pseudomonas aeruginosa PAO1
MKSLDDLDFDNRFARLGGAFSTEVLPDPIAEPRLVVASPAALALLDLPAETSDEALFAELFGGHKLWSEAEPRAMVYSGHQFGSYNPRLGDGRGLLLGEVINQAGEHWDLHLKGAGQTPYSRMGDGRAVLRSSIREFLASEALPALGIPSSRALCVIGSSTPVWREKKESAATLLRLAPSHVRFGHFEYFYYTRQHDQLKQLAAFVLEHHFADCNAAERPYAAMFRQVVERNAELIARWQAYGFCHGVMNTDNMSILGITFDYGPYAFLDDFDANHICNHSDDAGRYSFSNQVPIAHWNLAALAQALTPLVEVDELRASLDLFLPLYQAHYLDLMRRRLGLGVAAENDHALVQELLQRMQGSAVDYSLFFRRLGEETPERALASLRDDFVDREAFDRWAEAYRRRVEEEGGDQESRRRRMHAVNPLYVLRNYLAQQAIEAAEQGDYTEVRLLHQVLSRPFEEQPGMERFTRRPPDWGRHLEISCSS

SEQ ID NO: 6121 - protein, 393 aa, Streptococcus suis 89/1591
MSKLSRRVLEMEESVTLAAGARAKALKAEGRDILELTLGEPDFVTPKNIQEAAIKSIEDGKASFYTVASGHPELKDAVNTYFENFYGYSIERNQVVLATGAKFVLYAFFAAVINPGDEVIIPTPYWVSYADQIKMNDGVPVFVTAREEHNFKVTVDQLEAARTDKTKVFLLNTPSNPTGMIYSREELEAIGNWAVEHDILILADDIYGRLVYNGNGFTPISSISESIRQQTIVVNGVAKAYAMTGWRVGFAVGNPEIIAAMSKIVGQTTSNLTTAAQYAAIEAFTGPQDTVETMRQAFEERLNTIYPLLAEVPGFEVIKPEGAFYLFPNVKKAMEMKGYTDVTEFTTAILEEVGVAMVTGAGFGAPENIRLSYATDMDTLKEAVARLHTFMKK

SEQ ID NO: 6122 - protein, 508 aa, Neisseria meningitidis Z2491
MNTPLPYSNYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTDDEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 6123 - protein, 221 aa, Triticum aestivum
  misc_feature (23)..(23): Xaa can be any naturally occurring amino acid
  misc_feature (101)..(101): Xaa can be any naturally occurring amino acid
MDSGGGRPAPPAAAAAAGGASGXHEPRDARVVRELLRSMGLREGEYEPRVVHQFLDLAYRYVGDVLGDAQVYADHAAKPQLDADDVRLAIQANVNFSFSQXPPPREVLLELARSRNKIPLPKSIPPPGSIPLPPEQDTLLTENYQLLPALKPPTQTEEAEDVDEGADAIPGNPSPNYSQDQRGNEQRQPQSQSQRVSFQLNAVAATAAKRPLVTIDQLNMG

SEQ ID NO: 6124 - protein, 265 aa, Zea mays
MQIPDKIQSSLKVQFGRFLNKDGAVRRMSAEISSEKAKQSCSAAASAEVRLDRHLQAWWDNPSWTDEPPEIKVNVPEGSLCNLNLRFKAGLPPDAVYNIIIDPENKRVFKNIKVKFRQGRAGFMRKFEGCWTIEPLFVDKELCLPLNPHSLEEYESCTGGRGRVGSAITLDQLIEPALLPPPPISWYLRGITSRTTEMLVNDLIAETARLRTISNNANAKQGTEETGDANIGDPVRECGDIKERWRQRRKSGRHGSSLRLTSRFL

SEQ ID NO: 6125 - protein, 733 aa, Gibberella zeae PH-1
MAAKMGAPSQMPPIPNREDIGATWTYLQAGIARVMNDLEQAHLLGEELYNKLIDYLKHHLEDLVNQSKTHTDEALLAFYIKEWGRYTVAAKYIHHLFRYLNRHWVKREIDEGKKNIYDVYTLHLVQWRKELFEKVHAKVMDAVLKLVEKQRNGETIEHNQIKQVVASFVSLGLDEADPNKSTLDVYRYNFERPFLGATKEFYVAESKQFVAENSVVEYMKKAETRLAEEEERVRMYLHGDIALPLKKTCNQALIADHSPLLREEFQVLLDNDREDDMARMYNLLSRIPDGLDPLRARFETHVRKAGLAAVQKIQSAEGDKLEPKVYVDALLDIHTQYQGLVERAFKNEPEFTRSLDNACREFVNRNEVCKSGSSKSPELLAKYADVLLRKSSTSIEESELEHTLNQIMTVFKYIEDKDVFQKFYSRMLARRLVNSNSSSDDAETSMISKLKEACGFEYTNKLQRMFQDMQISGDLNKEFRVHLEGVESTKVVDSTFSILGTGFWPLTAPSTDFNPPPEIAAEIERFTRFYKHKHDGRKLTWMWNLCKGEIKASYCKASKTPYTFQVSIYQMAILLLFNEKDSYSYDDILSTTQLSKEVSDQAIAVLLKAKVLIMSGAAGEKPGSGKTFKLNYDFKSKKIRINLNIGGVKEAKQEEVETNKTIEEDRKLVLQSAIVRIMKARKKMKHTQLVSETINQIRSRFVPKVGDIKKCIEILLDKEYLERLEDDELGYLA

SEQ ID NO: 6126 - protein, 206 aa, marine gamma proteobacterium HTCC2143
MNNQEINNLGLVPMVVEQTAKGERSYDIYSRLLKERVIFMVGQVEDNMANLIVAQLLFLESENPDKDIHLYINSPGGSVTAGLSIYDTMQFIRPDVSTMCIGQAASMGAFLLAGGAKGKRFILPNARTMIHQPSGGAQGQATDIDIQAREILIIRERLNQLMAEHTGNDVETIRRDTERDNFMNADDSKTYGLVDEVLRGRNSVEA

SEQ ID NO: 6127 - protein, 439 aa, Ustilago maydis 521
MESQLANLHLDGGSTADLKQGSRPSHAQASHGNRHVHPTNSSLRPLAPSSSIASNMGINMGVNMQHFNRLAASSTGLTNPNSIAQGMSRAAQQPLNGSRPSTQQQPTQAHIKSRPPSVAGGLNAAAGPSYRPAAPAAQSTKQPASAGSAVASVDLGRYDGGLERDEARGRRGTMQFDPLTLSSADAGKQHPPTRVWSLKDFEMGRPLGKGKFGRVYMVRTRAAPNKGYIIALKCMYKNELVENKVEKQLRREIEIQMNLRHPHILRLHGYFHDEGRVFLMIEFAGRGELYKLMNKLHDRRFEEKVAATYIAQMADALSYLHSKHVIHRDIKPENLLLGIKGDLKIGDFGWSVHAPGNRRQTLCGTLDYLPPEMVNGEQHDKAVDLWALGVLCYEFLEGVPPFEELENAPAGTYKRINNIDFKIPRHFSPEAADLTTGYP

SEQ ID NO: 6128 - protein, 141 aa, Burkholderia sp. 383
MAIERTLSIIKPDAVAKNVIGQIYSRFEGAGLKIVASRMAHLSRADAEKFYAVHAARPFFKDLVDFMISGPVMIQVLEGEGAILKNRDLMGATDPKKAEKGTIRADFADSIDANAVHGSDAAETAAVEVAFFFPEMNVYSR

SEQ ID NO: 6129 - protein, 381 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMAIFVRRTVGGGGNTQLERNEPGTKPMARVLLLRTCVAEHLSENMGRQTRERERSSDHSLGPCQGQFVGSARKIHR

SEQ ID NO: 6130 - protein, 197 aa, Rickettsiella grylli
MHYLNENEEENKAMSMLKVGDKLPEFKLTATVDTDISKAFTEITHASYPGNWLVLFFWPKDFTFVCPTEIVAFNELNDKFKESNAVLLGGSTDSEFVHRAWRQYNDELRALSFPMLSDIKRELCSHLGILDNDAGVAQRATFIIDPEGIIRFNMVTDLSVGRNPQEVLRILHALQNGGLCPCNWQKGQQTIDITEAA

SEQ ID NO: 6131 - protein, 186 aa, Salmonella typhimurium
SLINTKIKPFKNQAFKNGEFIEVTEKDTEGRWSVFFFYPADFTFVCPTELGDVADHYEELQKLGVDVYSVSTDTHFDHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 6132 - protein, 170 aa, Saccharomyces cerevisiae
PENANVTVLNKNEKKARELIGKLGLKQIPGIIRVTFRKKDNQIYAIEKPEVFRSAGGNYVVFGEAKVDNFTQKLAAAQQQAQASGIMPSNEDVATKSPEDIQADMQAAAEGSVNAAAEEDDEEGEVDAGDLNKDDIELVVQQTNVSKNQAIKALKAHNGDLVNAIMSLSK

SEQ ID NO: 6133 - protein, 209 aa, Bacillus cereus ATCC 14579
MKTSEWIDISQPLNNNIATWPGDTPFSYEVSWSKEESGSVNVGKLTMSIHTGTHIDAPFHFDNDGKKVLDLDVQVYVGPARIIDVSNLESIGKKELESFHLEGVERLLLRTSSHGKAEEFPEVIPHLRADIASFLSEKGIRLIGVDVPSVDPLDDKELAAHHQLFKHGIHILENVVLDHVADGDYELIALPLALTDADGSPVRAVIRPI

SEQ ID NO: 6134 - protein, 370 aa, Mesorhizobium sp. BNC1
MATRKLFLLPGDGIGPEAMAEVSKLIAVLNSEFGAGFETEAGLVGGIAYDTHGKAISDEDMARALAADAVLLGAVGGPKWDGVPYDVRPEAGLLRLRKDMELFANLRPAICYPALAESSSLKKEAVEGLDILIVRELTGGVYFGEPKEIIDLGNGQKRGIDTQVYDTFEIERISGVAFELARTRGNKVCSMEKHNVMKSGVLWKEVVTATHRAKYSDVELTHMLADAGGMQLVRWPKQFDVIVTDNLFGDMLSDVAAMLTGSLGMLPSASLGAPDPKNGKRKALYEPVHGSAPDIAGKGIANPIAMISSFAMCLRYSLNMVAEADRLEKAIAAVLDDGLRTRDILSEGMREVSTSAMGDAVARKFRELAP

SEQ ID NO: 6135 - protein, 186 aa, Salmonella typhimurium
SLINTKIKPFKNQAFKNGEFIEVTEKDTEGRWSVFFFYPADFTFVCPTELGDVADHYEELQKLGVDVYSVSTDTHFIHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 6136 - protein, 178 aa, Synechococcus sp. CC9605
MIEALEPVPLQELRALGTAKVWDVEGELYELPSLTPVRGHVSAEHRGNVLAVEGKLSTIVTLCCDRCLNQFNQSLSCTPAELIWLGEEQPTADELELSGEVAEMEGLADVLDPRGQFDPQQWAFEQLNLLLPVVNHCGDHCPGPPGLQQQPVTSDAKPKDVDPRWQALQQLQQQIDQP

SEQ ID NO: 6137 - protein, 328 aa, Physcomitrella patens subsp. patens
MDKTVRLWHISYDECLRIFPHNDYVTCAQFNPLDDRYFLSGSLDDKVRIWSIPDHHVVDWSDLQEMVTAVCYTADGKRAIVGSYKGTCRFYNATGNKLQLEAHIDVREESKKARGKKITGLHCMPGDPKKVLVTSNDSRVRVYDGLNLVAKYKGLRNVKSQISSSFSPSGDFIVSASEDSRVLVWSSFNKDTSNKTSLYRRDKQLSCEEFTARHVSVAITWPDSSARSASEPLGRSDRFGSVQRRPSFFPEGGLRGTATWPEEKLDSLRMTRPNMTQAASITSNISTAEATPTRDLAPVSAAWGLVIVTAGLGGEITAFQNYGFPVRL

SEQ ID NO: 6138 - protein, 650 aa, Physcomitrella patens subsp. patens
MGEDFVSDDEFHETFEDITSSSSSDSADEGNGRCVRMRAAGVAPAVGIDRPSIWTSSAFKSKFSVWKDVPGTINERRERFFKQMGLKGFRDDSTDAHDATLVGGFDSSEVGLKTSRTLREKVATGIRADEYVKLICEKCGSKRKGVLTQGNAHLESFRPEDSGIHAERALSSLSTENGFKTDSGIGHKGPQANHEKKVADTYSIAREGDSEPDSNPSGPRFSISPGQKTCDCADSVTIDGIHHLDENRGNGSEFISKLGNIHETLNSNSSSPLESAPRVESIFQHVASSSQDKLFQFLDTDGEYEIGSPDSQNPVENLMEERFKIRDLDSGKQFLMKKFNRDGSLNMLREIGTGKDLTFAEFEKALGLISPVTQEMKRRQRVSDGQIRSKNPESKTDNKAPAVTKRKSWLRKLKGSMKRNSKGGLVKSTSARSVAVSDSVDDTDASSVAGSLSGDASPKRDSSFAGLDRGEFTKRGSLSGLPVDDIDDSIRRKPLKVKVRLRQKSSRDLSDLHLTQEILAHQGAIWTMKFSPDGRYLASAGQDRVIHVWEVVDSPMMAESDLWGGFGKSDRELGRMEDSLKSAKAGQDRNTTKNDNEGSTKCGKGTSRKQKSTNLSKGPVPKLFWLSEKPMCSFKGHTEDILDLSWSQSQ

SEQ ID NO: 6139 - protein, 222 aa, Oryza sativa Indica Group
MASWDDDEFSDEEEQSMGKKLWEDEDAGDDFAAVKDSWDDDDDVKPGKETAATAASTKPPATKGKKSQANAKAKAEAADATPSETSTSNAAAEIAQKQPDDNEPIEKFVPKSEKEFAEYAERIAKDLLRPYEKSYHYIGLMKAMNKLAVASLTSTSVKEIVSSMTTVANEKLKAEKAADAGKKKPGQKKRLHVTRPKGKSFVMLTTTTTTIVYHLNSQRASQ

SEQ ID NO: 6140 - protein, 322 aa, Physcomitrella patens subsp. patens
MIKSRYIKVPCEYLNAHESSLHHSRNGIPQSLTSSKIPIQTNCSRNFPTVPALADFKPSMSNHADRNNKVQIARLTYKNDVISIPVQPTDTRSYTLTSKEMEEAVLDAESKGITARMLLVTNLGNPLGTLYPEATLKLHTSLSERVACCSDFSIQKRSWSRPSMDEFVSMEKVAKNAFAEGLLSAQTAAELVHTAYGMSKDFGMNGFRVGCLHTKNKDLLEFWQNMGMFAAVSNDTQHALAIMLEDENFVDTYVQENKRRLKNYEILTKSFEAAGLRYMPGCAAMFGRIDLRNLLTEVKHAITQNQVSFGSAMHQWHRQALK

SEQ ID NO: 6141 - protein, 437 aa, Thiomicrospira crunogena XCL-2
MATQQINIPDIGDFDSVEVIEVLVAEGDEVAVDDSLLTLESDKATMEIPAPYAGKITKVTVSVGDKVAEGDAVFEIEVSEAAASEEKPADKPAPEKTPEAPKEAPKPAAETAPAPATPSPTAQALTKPVNAQSMGAASHASPSVRAFARKLGVDISSVSGSGPKGRIQQSDIEAMIKSVMQGGAGAGQAQGGMGIPSVPEIDFSQFGETETVELGRIKKISGKFLQTSWLNVPHVTQFDECDITEMDAFRKSMKAKAEKEGVKLTPLVFVMKAVVKALQDFPSFNSSLSPDGQSLIKKQYYNIGVAVDTPNGLVVPVLRDVDKKGIYELSRELMEISGKARDGKLSPKDMSGGTFTISSLGGIGGTQFTPIVNAPEVAIMGLSKAKMQPVWNGSEFEPRLVMPFSVSYDHRVVDGAEGVRFTTTVGQYLTDLRQLIL

SEQ ID NO: 6142 - protein, 170 aa, Synechococcus sp. RS9916
MDLHSLLPSPSPGLVNLVVEIPAGSRNKYEYLESAGVMALDRVLHSSVRYPFDYGFIPNTLAEDGSPLDAMVIMEEPTFAGCLIVARPIGVLDMHDTGHYDGKILCVPVADPRQRGIESIRQIAPNQLEDVAEFFRVYKNLEGRVTSIGGWRDVDAVQPLLRDCMAAART

SEQ ID NO: 6143 - protein, 118 aa, Panax ginseng
LCAGGELFDRIIAQGHYSERAAATICRQIVNVVHVCHFMGVMHRDLKPENFLLSSKNEGAMLKATDFGLSVFIEEGKVYRDIVGSAYYVAPEVLRRSYGKEIDIWSAGVILYILLSGV

SEQ ID NO: 6144 - protein, 594 aa, Thiomicrospira crunogena XCL-2
MSKIVDILIPDIGDFAEVDVIEVLVSAGEEIIQDDSLLTLESDKATMEIPAPYAGRVVEMNVDVGDKVKEGSVVGKIEIADVETVSSNVEESVTPEPTPEKTDQKTTETPAPKAVSAADLPDADMQCDVLVLGSGPGGYTAAFRAADLGKKVVMIERYESIGGVCLNVGCIPSKALLHMSVVLNETREMGAHGIEFAEPKIDTNKMRAFKDSVIGKLTGGLSGLAKARNVDVVQGYGKFSSANTVTVDLADGGTKTIAFENAIIAAGSRVVKLPFIPHDDPRVMDSTDALELEEVPKRMLVIGGGIIGLEMAQVYDSLGSNITVVELGDTIIPGADKDISKPLLRRIKKKYENIYLKSKVTNVEAKEEGLVVTFEGKDCPETDTFDRILVAVGRAPNGKLIDAEKAGVAVNDWGFIEVDERQKTNVDHIYAIGDIVGQPMLAHKAVHEGKVAAEVINGMPSAFTPMGIPSVAYTDPEVAWAGKTEDELKAEGIEYEKGAFPWAASGRSLSLGRDEGLTKALFCAETHRLLGCGIVGPNAGELVAEAMLAIEMGADMQDIGLTIHPHPTLSETLCFAAEMAEGTITDLMPPKKKK

SEQ ID NO: 6145 - protein, 309 aa, Pseudomonas aeruginosa PAO1
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 6146 - protein, 228 aa, Glycine max
MGMTPKIAPSMLSSDFANLASEAQRMLHFGADWLHMDIMDGHFVPNLTIGAPVIESLRKHTKAYLDCHLMVTNPLDYVEPLAKAGASGFTFHVETSKDNWKELIQRIKSHGMIPGVALKPGTPVGEVYPLVEAENPVEMVLVMTVEPGFGGQKFMAETMDKVRILRKKYPSLDIEVDGGLGPSTIDVAASAGANCIVAGSSVFGAPEPVQVISLLRNSVEKAQQTLIQ

SEQ ID NO: 6147 - protein, 477 aa, Pseudomonas aeruginosa PAO1
MSERLNSDRLNNDFQFIEVGRKDPKKKLLRQRKREFVEIHDLFKPQQAADQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDLSKVKPTGRRVAVIGAGPAGLGCADVLVRNGVTPVVFDRNPEIGGLLTFGIPEFKLEKHVLSRRREVFTGMGIEFRLNTEIGKDVTMEQLLDEYDAVFMGMGTYTYMKGGFPGEDLPGVHDALDFLIANVNRNLGFEKSAEDFVDMKGKRVVVLGGGDTAMDCNRTSIRQGAKSVTCAYRRDEENMPGSRKEVKNAKEEGVKFLFNRQPIAIVGEDRVEGVKVVETRLGEPDARGRRSPEPIPGSEEIIPAEAVLIAFGFRPSPAPWFERFEIATDSQGRVVAPAQAQFKHQTSNPKIFAGGDMVRGSDLVVTAIFEGRTAAEGILDYLGV

SEQ ID NO: 6148 - protein, 443 aa, Synechococcus sp. RS9916
MSLRLLLVRHGLSSFNVERRIQGRDDLSVLTPEGQEQARRTGSALKDVSITAAYSSPLRRAASTCEGLLQAWGGVLNPVMDDGLLEIDLEPWSGMSADERAAQDPDGFKTWKQCPEELELTRKDGSRYRPLPELMAQARDFLSRLLERHSIDSNDTVLVVGHNAILRCMMLVLLGEPEQGFRRLQIDNASLSVFNLSPKSGGGRQVQIECLNNTAHLGQSLPKKGQGARLVLVRHGETNWNRQGRFQGQIDIPLNENGHAQAEAARGFLEGVSLQRAYSSSMSRPRQTAEGILRSHPGVPMTVTRGLVEIGHGLWEGKLEEEIKAEWGDLLEEWKRTPETVQMPEGETIQDVWQRSVNTWTTIANSLDPSETALVVAHDAVNKTILCHLLGLTPADIWAVKQGNGGVTVVDMPTVPGQPAVVTCLNLTSHLGGVLDHTAAGAL

SEQ ID NO: 6149 - protein, 323 aa, Xylella fastidiosa Temecula1
MTVLVTGAAGFIGAHVCRALAARNDTVVGLDNYNAYYDPQLKRDRVTALCPDVYIRTLDLTDRERCAALFNEVQPDQVVHLAAQAGVRYSIENPHAYVDSNLVGFLNVLELCRHCRVQHLVYASSSSVYGDSAIPPFSEQQRVDQPRSLYGATKVANEVMAYSYAQLYGLRATGLRFFTVYGPWGRPDMAPLIFSRAVMEGRPIEVFNHGRMERDFTFINDIVAGVIGALDAPGEQAVPHRLFNLGNHTPVSLEHFIKVIEQAAGRPADKHYKPMQPGDMMATMADIAAARAAFGFEPVTSIEIGMPQVVEWCRHYFDTRAST

SEQ ID NO: 6150 - protein, 619 aa, Clostridium perfringens ATCC 13124
MSEVLQRITDPKEIKDLDEKELEILAEDLREFLIESVSNTGGHFASNLGVIDLTVALFKNFDFSEDRIIWDVGHQSYAYKILTGRKDKFNTLRQYGGLCGFPKRTESEYDFFATGHSSTSLSSAAGMARAQRLLGKDNKVIAVIGDGALTGGMALEALNDIGYRKDNLIIILNDNQMSICKNVGGLATYLNKLRMGVGYNKLKSDIGSTLDTTSFGKRVKNSLSKLKDGIKKIVVPSMYFEDIGLKYFGIVDGHNIRELNEVLSIAKNIKGPVIIHTVTKKGKGYELAEKNPNKYHGVSPFDLGEGVISKFASRNYSSTFGEEMIKLAKNDDKVVAITAAMPDGTGLKEFREEFPDRFFDVGIAEQHAVTLAAGMAAEGLKPFFAVYSTFLQRAYDQVLHDVCIQKLPVTLCLDRAGLVGEDGETHQGIFDISFLSPMPNMTIVAPKCIDEMEVILKWASNFNAPLAIRYPRGGDIDVNLKPLSKIEYGKWEKVQEGDKIAIVATGKMVQHAMIAAQKIKEEKNIDILIINATFIKPIDKELLNSLSKDGFKIVTIEDNIKKGGFGEGVLEYLNEIGHKEKIVTLAFNDKFIEHGKPDILYKINGLDAEGIKNTLIELL

SEQ ID NO: 6151 - protein, 229 aa, Yersinia pestis KIM
MEKRMKKYLIAPSILSADFARLGEDTAKVLAAGADIVHFDVMDNHYVPNLTIGPMVCKALRDYGITAPIDVHLMVKPVDRIVPDFAKAGATYITFHPEASEHVDRTLQLIKESGCKAGLVFNPATPLSYLDYVMDKLDVILLMSVNPGFGGQSFIPETLNKLRQVRKLIDDSGYDIRLEVDGGVKVENIRQIAAAGADMFVAGSAIFNQPDYAAVIDAMRNELAMAANG

SEQ ID NO: 6152 - protein, 791 aa, Burkholderia sp. 383
MTYQVLARKWRPKDFASLVGQEHVVRALTHALDGGRLHHAYLFTGTRGVGKTTLSRIFAKALNCETGVTSQPCGVCRACREIDEGRFVDYVEMDAASNRGVDEMAALLERAVYAPVDARFKVYMIDEVHMLTNHAFNAMLKTLEEPPPHVKFILATTDPQKIPVTVLSRCLQFNLKQMPAGHIVSHLERILGEEQITFEPQALRLLARAAQGSMRDALSLTDQAIAYSANEVTESAVSGMLGALDQTYMVRLLDALAAGGGPEILAIADEMSLRSLSFSTALQDLASLLHRIAWAQFAPGSVLDEWPEAGDLRRFADTLSPEQVQLFYQIATVGRAELGLAPDEYAGFTMTLLRMLAFEPAVAAGSATGGQPSVPRAVPGPRVAAASVAAAKPASAAPAEAVRQQAVAPAAPAVPAAPVVHTAPVQSGDETDRPAVKPAAVQAAAPAPVDAPVIETPQPQTAAAPQAEPAGDTPAPVRKEPESPAVVEQRSDEPAAPSEPTPRAAPPEPAARPAARSGGAAAALDVLRNAGMRVSSDRGRAGAAPAAKPAAQPAAEKPVAPRPAAVQVPTPRAAARAPQAADSRQASPPWEDIPPDDYVPLSADEMFGGPPDDGFVPVFDSGPDDVRVTPRPAETRPSAPVDTRPLPPAIALDPVGFDGEWPALAARLPLKGVAYQLAFNSELTAVDATTLKLSVPVPQYADAAQVAKLKAALADALGKPVEVAVEVGPARRTAAALDAAARAARQREAEQEIHGDPFVQQLVRDFGARIVEGSVRPLADAAPDGPPPTLH

SEQ ID NO: 6153 - protein, 420 aa, Pyrococcus horikoshii
MVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 6154 - protein, 341 aa, Glycine max
FGSRDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 6155 - protein, 439 aa, Aspergillus oryzae
MTKEAPSQSVTELNACVSTGHRPAVKETTFREWVVDNQIGISLTILSMLLAVHHLYPSLRPYTAPFFQLSYYQASQGVYVQGWDDIYFVASSAIAFTAIRAIVIDWVLRPIAMHTGLKRKASVRFAEQGWMWLYYAFFWTFGMYIWSNSNHWMNFAAIWDEWPARGVSGSLKWYLLAQLSFWIQQIFVINIEERRKDHYQMFTHHIITSTLLTSAYIYGFYNVSNVVLCLMDIVDLLLPTAKILKYFGYELACNVAFGVFMLTWLITRHIMYPLLCWSIFKEVPARMSYGCYSGTTAEMISNDGYPDQLAHLFYPFLNIDGPICMNRTIKWIFLSLLLFLQVLSIIWFAMVIRVAVGVLRTGNAEDSRSDDEEEEEMEMRISSKDGPNGSAAGSDGTTADWRRLNGSSTVRPRARGRVRLGEQSDRKALLGRIGCDKPT

SEQ ID NO: 6156 - protein, 564 aa, Mesorhizobium sp. BNC1
MLARVHEPGFLHLFTPKLFTVLREGYGRASLKADAVAGLTVAIIALPLSMAIAIASGVAPERGLYTSIIGGFFVSALGGSRFQIGGPAGAFIVLVLATVHMHGVDGLILATFLSGFVLLAIGLLRLGTFIKYVPYPVTVGFTSGIALIILTSQLKDFLGLELHEQEPGPFIPKLQALGTALPTLNPPAVSIALLAVAIILVLRRYRPHWPGFLIAVALTTLFAWLLSLPVETIGTRFGGIPQTLPTPLLPDLSLAKIISVLPAALSFALLGGIESLLSAVVADSMSGRRHRSNAELVAQGAANIASSLFGGFCVTGTIARTAANVRAGARGPVAGMLHSVFLLAFMLVAAPLARFIPLSALAAILVVVAWNMAEKHQFAALIRSSWADAVVLIATFLLVVFRDLTEGILIGVGLSALFFLNRISKEIKVDRVHGAVDSSKLDQALNEESYSTSLRTDDNILVYRISGAFFFGAAASVAAALDRIGGQPKAYVIDISAVEVLDSTAAATMEGFVRKAGWQGAKVYLVGARTHVRHLLHKHGLHAPQVRFYRKLDTAVAAASKLQE

SEQ ID NO: 6157 - protein, 537 aa, Triticum aestivum
  misc_feature (319)..(319): Xaa can be any naturally occurring amino acid
  misc_feature (340)..(340): Xaa can be any naturally occurring amino acid
  misc_feature (375)..(375): Xaa can be any naturally occurring amino acid
MSMQQQQQQPARANLLGAMPAASMISLAFTAAVATAALWVAVAVARYNRKYRGLRLPPGPHGWPIVGNLFQVAFSGKLFIHYIRDLRREYGPILTLRMGVRTLVVISSAELVHEALVEKGTEFASRPAENTTRNIFSSNKFTVNSAVYGAEWRSLRRNMVSGMLSTSRLREFRPARLRAMDRFVARMRAEAAASADGASVWVLRNARFAVFCILLDMTFGLLDLEEEHIVHIDAVLKRVLLAVGVRMDDYLPFLRPFFWRKQRRALAVRREQVDTLLPLINRRRAILRDMQSSPPDPNVAAPFSYLDSLLDLHIEGREXADDELVTLCAELINGGTDTTXATAIEWAMARIVDNPSIQARLHEEIMQQVGDARPXDDKDIESMPYLQAFVKELLRKHPPTYFSLTHAAVKPGSKLAGYDVPTDANLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 6158 - protein, 186 aa, Salmonella typhimurium
SLINTKIKPFKNQAFKNGEFIEVTEKDTEGRWSVFFFYPADFTFVCPTELGDVADHYEELQKLGVDVYSVSTDTHFVHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 6159 - protein, 328 aa, Gluconobacter oxydans 621H
MRYLVTGGAGFVGSHAVLALLDAGHDVVVLDNLSTGYREAVPDGVPFHKVDLLDYAATSAVVAQGKWDGVLHFAALSLVGDSMRDPFHYLRQNYLTALNLVQICVEHGVKKIVFSSTAALFGGPERLDPIPETAPVQPGSPYGESKFMIERVLHWADAIYGLRSACLRYFNAAGADPQGRAGEDHRPETHLIPLTIDAALGRRPALKLFGTDYPTRDGSCVRDYIHVTDLADAHVRALGQIDHRSVTYNIGNGQGYSNLEVIQSVERVSGRKVPWEAAPRREGDPALLVADSTTLRNDTGWTPRFGNIDSIVETALRWRESHPNGYGM

SEQ ID NO: 6160 - protein, 437 aa, Saccharomyces cerevisiae [sequence omitted]

SEQ ID NO: 6161 - protein, 251 aa, Borrelia garinii PBi
MTRLRLKSKDEIKKIKASARLLALTLLEVERNIVPGISTKELDLIAYDFIIKNRAKPAFKGYHGFKGTICASVNEEVIHGIPGKRKLASGDIISIDCGVILDGFYSDMAKTFKVGSVDPSIDKLLEVTNASLYKGIAEMKVGNRILNISKAIEEYIKPFGFGIVREYTGHGVGFQLHEEPSVPNYYAPFFKNIRIQEGMVLAIEPMVNLKGHKVSIKSDGWTVFASDLSYSAHFEHTVAVVDGLPLILSEV

SEQ ID NO: 6162 - protein, 281 aa, Aspergillus niger
MKQFSAKYALILLATAGQALAASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTW

SEQ ID NO: 6163 - protein, 690 aa, Spiroplasma citri
MDYISLYRKYRPNNFDKIVGQIEIRKALKNAIINNTFSHAYLFSGPRGTGKTSIAKIFAKAINCINLDNGNPCNECASCKEINRAGAVDVFEIDAASNNGVDEIREIRNNVQLLPTMTKYKVYIIDEIHMLTNSAFNALLKTLEEPPQHVVFILATTESHKIPATIISRCQQYNFRKISKVELENNIINILQKEEIKYDLTAIKEIALLADGSARDSLSILEQVIMFSDRNVTLENVNIIFATVSKTIKLKLLKDILEYKTTEVLIASKKIYQAGSDFEVLTLNLLDILKEIFEFKQTNNLIFLSLLSEEQAKGFAEQLSSKELIMLLDLFTEAASKMRNSKTQEMYFELILLKALAIFENNIKNLEALKLSDLMILTYEEGKKINQHKTEQISINKKIIENNSEKSQVQILKDDLIVEKKLKTNDEVIHLKEPKLPNNQPLFHNFSLFDDEEPNITSFNNIESQQDKIIVDENDIQTNFKQTKEKESFETIGSEQVSYGKELEGITDLQKYRDDMKNKINIYEFSNINYSNNQIFNILIKASKEEREKFESKFMELINEKSKVVQLDKLISFYDVKYAAASEQGLIIVTNTKPEANWISFEMCDWEFRNKIFQAFDFDFIIIALSENEWNNVRNDYVKIRQANKLPQPTLIDVEEFYQNLLVKQIDNYEEHKDVLETGKQIFDNIKIVE

SEQ ID NO: 6164 - protein, 280 aa, Aspergillus tubingensis
MKQFSAKYAIAVVVTAGHALAASTQGISEDLYSRLVEMATISQAAYADLCNIPSTIIKGEKIYNSQTDINGWILRDDSSKEIITVFRGTGSDTNLQLDTNYTLTPFDTLPQCNSCEVHGGYYIGWISVQDQVESLVQQQVSQFPDYALTVTGHSLGASLAALTAAQLSATYDNIRLYTFGEPRSNQAFASYMNDAFQASSPDTTQYFRVTHANDGIPNLPPADEGYAHGVVEYWSVDPYSAQNTFVCTGDEVQCCEAQGGQGVNNAHTTYFGMTSGHCTW

SEQ ID NO: 6165 - protein, 284 aa, Oryza sativa Indica Group
MAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQR

SEQ ID NO: 6166 - protein, 395 aa, Neisseria meningitidis Z2491
MNTLLKQLKPYPFARLHEAMQGISAPEGMEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRLYQEKFERVIPILQQVFDVKLPDASFYIWLKVPDGDDLAFARNLWQKAAIQVLPGRFLARDTEQGNPGEGYVRIALVADVATCVKAAEDIVSLYR

SEQ ID NO: 6167 - protein, 409 aa, Oryza sativa Indica Group
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDIGYDECIVPCDMNLIKDQDFTELVQKVPDGCLFTMVSDSCHSGGLIDKTKEQIGSSTKQSKIQQRERELRRQQAPSPGTCSCASLLQIALRHLPRRGGQRIIGSRSRDGVGEDQPPRSQAELLAADATRASIKNRSLPLSTFVEMLRERTGKDDVGVGSIRTTLFHHFGDDASPKIRRLVNAMLGRRHGSATASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 6168 - protein, 467 aa, Oryza sativa
MSLQTPRIGRLLSRQALHAPIRRRAFHRSSRLDVVKPFLLADIGEGITECQLIQWFVQPGARVEHFDKLCEVQSDKASVEITSPFDGVIKKLYYEPDDMAVTGRPLVDIDMDGDEAEAEAEKLGEAETSADKGENTKVNTASHETESRPTERRRNGNGKDDFSSLATPAVRHLMKELNVNITDVEGTGRDGRVTKEDVHRFVSQKTQQQMEVESPSTSPASTSASTSTLSTATQDQKLPLTPVQTQMFKVMTKSLSIPHFLYSCSADMTSVTATRKKLNAMKTSEKLTHLPFIIKATSLALQQHPLLNSALDTSDPKKPSLTYRSSHNFGVAVDTPSGLLVPVIRDVQNLSIAQIAQQLKALSEKARNGKLAPGDFSGASFTISNIGSVGGGVVAPIISEPQVAILGVGRSKVVPAFDENDQLVRREELVLSWSADHRVVDGAECARCAEKVKGLLEEPTAMLLEMR

SEQ ID NO: 6169 - protein, 447 aa, Nitrosomonas europaea ATCC 19718
MKYNSIEEFKNYVSERNPGQPEFLQAVSEVIESLWPFIVDHSRYAEQGLLDRLIEPERMIIFRVAWVDDRGEVKVNRGYRIQYNSAIGPYKGGTRFHPSVNLSILKFLAFEQTFKNALTTLPMGGGKGGSDFDPKGKSPGEIMRFCQAYAAELFRHVGADTDVPAGDIGVGGREVGYMAGMVKKLTNRSDCVFTGKGLTFGGSLLRPEATGYGLVYFAEEMLNHSGCSLKGMRVSVSGSGNVAQFAIDKAMSLGAKVVTVSDSSGTVVDEAGFTPEKLAILAEVKNRLYGRVNEFAERVEAQFLPGEKPWHVPVDVALPCATQNELNENDAAILIRNGANCVAEGANMPCTAGAVERFHHAKVLFAPGKASNAGGVATSGLEMSQQAMRLSWTSGEVDMRLQEIMRAIHHSCTEYGKKPDGTVNYVDGANVAGFVKVAEAMLAQGVI

SEQ ID NO: 6170 - protein, 393 aa, Thiomicrospira crunogena XCL-2
MSFSKLGLSDPIVKAVSERGYDAPTDIQKQAIPIILSGKDLMAAAQTGTGKTASFVLPLLEKLNTDNAIRGRSIRALILVPTRELAMQVETNVVDYAKHLNLSSMAAYGGTDIDAQKQRLMQGIDILVATPGRLLDLAYQRALFFDDLEFLVLDEADKMLDMGFIDDLYKITDRLPHQRQSLLFSATLTEAVRYLAADTVSDDATEISISPQNKTTPKIKQWLITVDKDTKSALLSHLINEQHWDQALIFVEKKHSAAKLVEQLGKRGIIADSIHSGRSQAAREQVLSEFKSGKLKFLIATGIAARGIDIDNLSRVVNYDLPYPAEEYIHRIGRTGRAGATGEALSLVSKDDFKNLCAIESLLGHLIERIEIAGFPVKKIVPVSILNYRSKQK

SEQ ID NO: 6171 - protein, 425 aa, Serratia marcescens
MSVTASDLAFDQRHIWHPYTSMSRPLPCYPIESASGVELQLADGRSLVDGMSSWWAAIHGYNHPRLNQAASQQLEKMSHVMFGGITHPAAISLCRRLVEMTPEALQCVFLADSGSVAVEVSLKMALQYWQARGERRQRILTLRHGYHGDTFGAMSVCDPDNSMHSLYQGYLAPHLFATAPQCRFDEEWREEDIAPFAALLEQHAGEVAAVILEPVVQGAGGMRIYHPTYLKRVRDVVRVAIKLLLIADEIATGFGRTGKLFACEHAQVVPDILCLGKALTGGYMTLSATLTTRHVAETISNGAAGCFMHGPTFMGNPLACAVADASLALLAENRWQAQVSAIETQLKRELLPLGRCRRWPHVRVLGAIGVVEMREPVDVAELQRGFVERGVWIRPFGKLIYLMPPYIIEAEQLSRLTAAVADAAR

SEQ ID NO: 6172 - protein, 169 aa, Oryza sativa Indica Group
MATGGPSSMSAGLLFLNLVLYVVVAVIAGWAINYSIDESFNSLQGVSPPVRLFPIYFPIGNLATGFFVIFALLAGVVGVSTSLTGLHDVSQGYPASMMSAAAASIVTWTLTLLAMGLACKEISIGWRPPSLRALETFTIILAGTQLLCAGSLHAGAHAAIIQNPMVSRV

SEQ ID NO: 6173 - protein, 422 aa, Pseudomonas aeruginosa PAO1
MSDLKTAALEYHAQPRPGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDDVFNG

SEQ ID NO: 6174 - protein, 570 aa, Shewanella sp. MR-4
MIKTIKSICTLVTVATAMSSSGVLAMDRITGKAFATRSEVYATHGMAATSQPLATQVAIDVLKQGGSAVDAAIAANAMLGLVEPTGAGVGGDLFAIVWSAKDKKLYGLNASGRSPKSLTLEKLKSLGLDYLPPFGPLPVSVPGAVDGWFELHDKFGKLPMADNLAPAIRYAREGFPVSELIAYYLNGSGKKLGQFPGFKETYMPNGKMPAVGEIFKNPALANTYEKIAKGGRDAFYKGDIAKSIDKYIKAQGGYLSYEDLASHTSDWVEPVSANYRGYDVWELPPNGQGIAALQILKTMEPFDVAAMGFNSPEYVHLFVEAKKLAFADRAKFYADMAFNKVPVKDLISQQYNYDRAKLIDLNKAAKSVDAGNPALQHGDTVYLTTADKDGNMVSLIQSNYRGMGSGMTPPDLGFVLQDRGQMFDLTEGRFNTYAPGKRPFHTIIPAFVTKDGKPWLSFGVMGGATQPQMHAQIIVNLIDFKMNLQEAGDAPRILHTGSTEPTGEVMNDGGYVSLESGFPVETRRELIKKGHVLRDGLGDFGGYQAIGFNAETGVYRGASESRKDGYAAGY

SEQ ID NO: 6175 - protein, 209 aa, Xylella fastidiosa Temecula1
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLHAAWPSLRTGKPVVIKTHISKNRQN

SEQ ID NO: 6176 - protein, 559 aa, Petunia x hybrida
MERASLRIVALLLCLSIGNVVVKAEDPYLPFDWNVTYGTISPLGVPQQGILINGQLPGPTINCTSNNNIVVNVFNHLDEPLLITWNGIQQRKNSWQDGTPGTMCPIMPGTNFTYHFQVKDQIGSFFYFPTTDLHRAAGGFGPINVHSRNLIPIPFDSPAAEYNVFVGDWYNKGYKSLKKILDGGRTIGRPDGIHINGKSGKVGDNAAEPLFTMEAGKTYRYRMCNVGMRTSVNVRIQGHTMKLVEMEGSHTVQNVYESLDLHVGQCLSVLVTADQEPKGYYMVVSSRFLKQAELSSVAIVRYANGKGPASSDLPAPPPDNTEGIAWSINQFRSFRWNLTASAARPNPQGSYHYGQINITRTIKIANSRSQVGGKLRFALNGISHSPAETPFKLAEYFGATDKVFKYDLMADEPPSGDKVTVDHNIKNATYRNYVEIIFENREKTIQTYHLDGYSFFAVAIEPGKWSPEKRKNYNLVDAVSRHSIQVYPNSWAAVMTTLDNAGLWNLRSDMWERYYLGQQLYFSVLLPTRSLRDELQPSLTTTLSVVLSKGMPMPPPYKA

SEQ ID NO: 6177 - protein, 491 aa, Zymomonas mobilis
MLSLPIWFSCDYRKSGKGRVSKMPEKSPKLSKTLSSFHLWGIAVGLVISGEYFGWSYGWATAGTMGFLIATVIVAAIYTSFIFSFTELTCSIPQAGGPFAYSFRALGKWGGAIAGMATLVEFLFAPPAIALAIGSYLNVQFPSLSPKMAAACAYIVFMALNIVGVRIAATFELFITVAAIFELLVFMGVVAPAFSWEQFLHDGWGVASHFDIQAIGGIFAAVPFAIWFFLAIEGVAMAAEEAKNPRRSIPIAYTAGILTLVSLAFGVMVFAGGSMDWHQLANLNDPLPQAMKHVVGAHSGWLHMLVFLGLFGLVSSLHGIIMGYGRQIFALARAGFLPATLGKLHIKLQTPYAATIAGGLVGIAAIFADDVLSFGGHSLTAILVTMSVLGSLTMYVLSMVSLFRLRQTMPDLPRPYKAPLYPFLPALALIGAFFLLAAVIYYNAGISFIYALLMCIACPLCLYSYKRSQNKKTEENDITTSAILAAEGAEE

SEQ ID NO: 6178 - protein, 258 aa, Vibrio vulnificus YJ016
MEILSDQEMLRYNRQIILRQFDFEGQEALKQSSILILGAGGLGCAASQYLATAGVGKLTLIDDDIVELSNLQRQVLHHDADIGRKKVESAAQSLRELNPHIEVVTVAQRLSDSELETLIKNHSLVLDASDNVETRNQLNRLCFATKTPLVSGAAIRMEGQVSVFTYQNANEPCYQCLSALFGSNALSCVEAGVMAPVVGIIGAVQAMEAIKVLAHFGTPKSGKILILDAMTMSWREMNLMKLPACPVCNDDSQRISQT

SEQ ID NO: 6179 - protein, 420 aa, Pyrococcus endeavori
MVEQDPFEIAVKQLERAAQYMKISEEALEFLKRPQRIVEVTIPVEMDDGTVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREARKVLGWGDLKGKTIAIQGYGNAGYYLAKIMSEDYGMKVVAVSDSKGGIYNPDGLNADEVLKWKQEHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDADYVVAVQRVYQAMLDRGWVKH

SEQ ID NO: 6180 - protein, 419 aa, Thermococcus litoralis
MVEQDPFEIAVKQLERAAQYMDISEEALEFLKRPQRIVEVSIPVEMDDGSVKVFTGFRVQYNWARGPTKGGIRWHPEETLSTVKALAAWMTWKTAVMDLPYGGGKGGVICNPKEMSDREKERLARGYVRAIYDVISPYTDIPAPDVYTNPQIMAWMMDEYETISRRKDPSFGVITGKPPSVGGIVARMDATARGASYTVREAAKALGMDLKGKTIAIQGYGNAGYYMAKIMSEEYGMKVVAVSDTKGGIYNPDGLNADEVLAWKKKTGSVKDFPGATNITNEELLELEVDVLAPSAIEEVITKKNADNIKAKIVAELANGPTTPEADEILYEKGILIIPDFLCNAGGVTVSYFEWVQNITGDYWTVEETRAKLDKKMTKAFWDVYNTHKEKNINMRDAAYVVAVSRVYQAMKDRGWIKK

SEQ ID NO: 6181 - protein, 391 aa, Anabaena variabilis ATCC 29413
MTNFTSRMQAVQSPIIPVVGELIQNSPGTISLGQGVVSYSPPPEAIELLPKFLADPANNLYKAVEGIPPLLNALTDKLSTFNKMEITTDNCIVVTAGSNMAFMNAILAITSPGDEIILNTPYYFNHEMAIAMAGCRAVLVETDENYQLRPEAIAQAITPKTRAVVTISPNNPTGVVYCEDLLRNVNQICANCGIYHISDEAYEYFTYDGVKHVSPASFAGSSEYTISLYSLSKAYGFASWRIGYMVIPKHLLVAIKKVQDTILICPPVVSQYAALGALQAKPEYLQDHIQAIAQVRKIVFDYLNQLQGLCTITPADGAFYVFLKVHTQIDAFTLVKQLIQEYKVAVIPGTTFGMESGCYLRVAYGALQKDTVQEGIERLVQGLKTILYPEK

SEQ ID NO: 6182 - protein, 360 aa, Oryza sativa Japonica Group
MARVHHKNGRGGGGGGGGGKGKGKGKWKMPASVARKQQAAMANVDQVTGDKIPKSFVFSRGKLPSTLRHLQQDLRKVMLPYTALNLKEKKRNNLKDFVNVSGPLGVTHFFILTNPKSSPHLRMAKTPQGPTYTFQIKEYALAADIANSQKRPRCPPEIFKNSPLTVLSGFGGLGEPFKSLVEYFRHMTPAIDPVTVKLSTCQRILLIHFDREKEMINFRHYSIKLQPVGVTRKIRKLMQNNQVPDLRDLNDVSDYVTKAGYGSESEVDDEAATVSLASDVDKLNRASRKSAIRLQEIGPRMKLHLVKVEAGLCSGDVLYPQPVGKEGLGKKGKEVEEETEGQEDEDLMESDDDPEDESEE

SEQ ID NO: 6183 - protein, 453 aa, Burkholderia pseudomallei K96243
MEFDYDLFVIGAGSGGVRLSRVAASYGARVGIAEEERIGGTCVLRGCIPKKLLVYASHYSHDVEDAAGYGWTFDIGLFSWPTLIEAKDREIARLSGIYVDLLNKSGVEIHTGRATLVGAHTVDVAGRRVTARHIAVATGSRPVLPPIPGIEHAITSREALELPELPQRIAIVGGGYIAVEFAGIFNGLGVDVDLFYRGEQILRGFDDDVRHALHGEMTKQGVAIHTRATIEAIERGADGGLTLRLAEGAYGPYDAVLYATGRVANGDGLGLEAVGVARDANGAIEVDAYSATTVPSIHAIGDVTARPQLTPVATRDGMLLAANLFGGKRIAADHRYVPSAVFSQPEIATVGLTEAQARAELGALDIYKTSFRALRHTLSGRDEKTFMKLVVARDSQRVVGAHMVGRDAAEIIQGIAIAIRAGATKAQFDETVGIHPTAAEEFVTLRQKEPDDA

SEQ ID NO: 6184 - protein, 397 aa, Mesorhizobium sp. BNC1
MNIHEYQAKELLRGYGAPVAQGVAIFTSGEAEAAAKKLPGPLYVVKSQIHAGGRGKGKFKELSPDAKGGVRLAKSIEEVVANAKEMLGNTLVTKQTGPEGKQVNRLYIEDGADIARELYLSILIDRTVGRPAFVVSTEGGMDIEAVAEETPEKILTLAIAPERGVTNDDVTKLNAALKLDGAAAKDGETLFPILYKAFTEKDMSLLEVNPLIVMQNGRLRVLDAKVSFDNNALFRHEDVVELRDTSEEDEKEIEASKYDLAYVALDGDIGCMVNGAGLAMATMDIIKLYGAEPANFLDVGGGASKEKVTAAFKIITADPNVKGILVNIFGGIMRCDVIAEGVIAAVKEVGLKVPLVVRLEGTNVDLGKKIISQSGLNVIPADDLDDAAKKIVAAVKS

SEQ ID NO: 6185 - protein, 433 aa, Arabidopsis thaliana
MSIPCLTEETAKTVLRQVEFYFSDSNLPIDDFLKKTVTESEDGLVSLALICSFSKMRGYLKLGDSKGDDIPEDTIKAVADTLRTSSALKISDDGKKVGRSTELLKLEDLIEQLNARTVAASPFSYDVKREDVESFFSQYGKVNSVRMPRHVAESRIFSGVALVEFPTEEDAQNVMKQNLVFAGQELELKPKKEFDNEREKDEVKFANYQPQKGSANQKNGSDHKNNSAYEQDYPKGLIISFTLKRSAEEGTTEQKSSEEPTDKTMEESETKPADTPDADKENTGEVQAEGAEDEDDEKEEKGALATHKDNKDVVLREDLKAVFGKFGDVKFVDFKMGSETGYLRFDEPEASQKARAAAVLANEGGLAVKNFIAVLEPVIGEAEKEYWTLLRSKDRFDKGGRGGRGGRRGGRFGRKRGSDSPGGRWNKSQKVEA

SEQ ID NO: 6186 - protein, 880 aa, Oryza sativa Japonica Group
METFLSAVLADLLSRSISFVIDRYCQQQQGVEENLQQLQRMLLRIQTVDEEANGRRITNQAMLLQLKTMRNVMYRGYYFLDNFRYRIALGHAPDEVDDHSLASFPFNPLKRFRFSTMARKIVSEDQEKKELLKMLGRLESIISEEFVMSLRSYPRMVRQPYCSYLLLENCMFGRQAEQERIISFLLEPHRAGAEGVAVLPIIGPARVGKSTLVENVCHDERVRKYFSTIVFYYTGSTEGAVADTGVIKHQNPASTKQSLVVIELVDDMDDETWRRILSSLRGDNIAAPVSKIIITSQSNKIATFGTTETLQLDMLPKEAFWYFLKTIAFGSTNPEEEPKLTSICMEIAAQANGAFLHANIIGGILRSNFSVQFWYKVLKRMKIITNWHFRLLGEHPRDMFAAKSGRTIVWFSKLNRFVPVTYNEASSSRLNDHPTSNAFIAKKGQLDENIDALEWQSSIPPYYKYRTRYAMIEQPNTLSTGKRSRSLSEGCTLKLRTEFELTFLPASYAAKIVRRPKITTVVAQQPPGIRRALADVSNLVNGRAALPVVNRQKAPAAADKCRKPIKQRNENNKAKPEVIVISSDSEKQKKSPAQRAASRRAPIQTLTSILTKCSRASGGVISPKKELIYDIDASDAHNELAVIDYVEDIYRFYRSTENTYRPLCTYMVSQTEINERMRAILTDWLIEVHYRLMLMPETLYLTVYIIDQYLSLENVARNELQLVGVSAMLIACKYEETWAPLLAIVFSAAQFAYDVQLAIMFNAVQFAHDFKDFLVISDNSFSRQQVLSTEKSILNKLQWNLTVPTMYMFILRYLKAALGDKELEHMTSVIAAAAVYAARCTLGPCPEPTMERSSGVPHRLSRATIAVCLLLHDLIFAHEI

SEQ ID NO: 6187 - protein, 428 aa, Anabaena variabilis ATCC 29413
MNIAVVGLSHKTAPVEIREKLSIPEPQTESAIAQLTSYPHIDEVAILSTCNRLEIYIVAGETDHGIREVTQFLSEHSKLPVHSLRQHLFVLLHEDAVMHIMRVAAGLDSLVLGEGQILAQVKNTHKLGQQYNGIKTILNRLFKQALTAGKRVRTETSIGTGAVSISSAAVELAQIKAENLAACRVTILGAGKMSRLLVQHLVSKGATQISIVNRSRERAQELAKQFSEHPIRTHLLPEMMTVIAESHLVFTSTSATEPILDRAKLEMVLAPNQPLMLFDISVPRNVHTDVNELANVQAFNVDDLKAVVAQNYESRRKMAQEAERLLEEEIEAFDIWWRSLETVSTISSLRSKIETIREQELEKALSRLGSEFGDKHQEVIEALTRGIVNKILHDPMVQLRAQQDVEARRRCMQTLQMLFNLDVGEQFS

SEQ ID NO: 6188 - protein, 459 aa, Bacillus cereus ATCC 14579
MSKLVVIGGGPAGYVAAITAAQNGKGVTLIDEAELGGTCLNVGCMPTKSLLESAEIHDIVRKANDYGVTLNTGSISIDWNQIQARKSQIVMQLVQGIQYLMKKNKIKVVKGKAKFETDHRVRVVQGNKEEVVDGESFIIASGSEPTELPFAPFDGKWILNSSHAMSLESVPSSLLIVGGGVIGCEFASIYSRLGTKVSIVEMAPQLLPGEDEDIANILREKLEKDGVKIFTGAVLKGLNNYKKQASFEYEGITHEVTPEFVLVSVGRKPRVQQLGLEKAGVQFSNKGISVNEHMQTNVSHIYAAGDVIGGIQLAHVAFHEGTTAALHASGEDVKVNYHAVPRCIYTAPEIASVGLSEKGAREQYGDILIGEFPFTANGKALILGEQVGKVKVIVEPKYQEIVGISIIGPYATELIGQGTVMIHTEVTADIMRDYIAAHPTLSEAIHEALMQAVGHAVHA

SEQ ID NO: 6189 - protein, 399 aa, Bacillus cereus ATCC 14579
MAVEVVMPKLGMAMKEGIITNWNIKAGDNVAKGELIASINSEKIETEIEAPADGTVLDIAVSEDEGVPPGTVICYIGKPNEKVEMQESTHVVEEKTFNIEVQNVQNQEPNGKEVAKQRIKISPVAKKIAKSENLGIKVLVGTGPGGRITKADVLKALEVRGIVPEISEQEESNVIPVTGMRKAIANRMHASLQNSAQLTLTMKVDVTDLVALHKEIAKVVQKRYDNKLTITDFVSRAAVLALGEHKEMNSAYIDDAIHQFEHVHLGMAVALEKGLIVPAIRFANNLSLVELSKEIKNVAQKARAGSLSSDDMHGTTFTISNLGSFGIEYFTPVLNTPETGILGIGAIEHVPVYKGKKLKKGSMLPLSLTFDHRVLDGAPAAAFLRTIKHYLEEPITILL

SEQ ID NO: 6190 - protein, 396 aa, Synechococcus sp. CC9605
MPTSKRLASLGNAVFARVDAAKQAYRLEASSLERPGLVDLSIGSSDLRPPTTLLDTMASAVMAFDSSSYCLQAGLRPFHAAVADWCRHRFDVAVDPDHEVQLLVGSQEGTAHLPLALLDSGDAALHLDPCYPSHTGGLHLAGARTKALALSPDNDWRPDLSTISPQLWDQLKLFVLGYPHNPSARVGDQEDLNRITAIAARHDVVIAHDNPYVDLALDGEPPALLKAPSWRECGIEFFSLSKGWCLGGFRLGFAVGAAPLIAALRRAKAVIDFNQSLALQQGAIQALQSFPDWPRQLHPTYRERRDRVVETLRARGWSVPCPEMAMYLWFPLPDAAHRRGWSDEDAARELLQRSGVALTPGSGFGDGGRQWLRMALVRPVNELVEVAERLADAMDD

SEQ ID NO: 6191 - protein, 428 aa, Mesorhizobium sp. BNC1
MATEIRVPTLGESVTEATIGRWFKKVGDAIAADEPVVELETDKVTVEVPAPSAGTLQEIAVKEGDTVEVGALLGSIGEGAAAAPAKAAPAAREKKEAVAQAAGASGAGSTGEAIEKTANVGGEPPIEERKRPPAPSAAKLLAENRLSTDEVAGSGKDGQVLKGDVLAAIERGGRGAPSQPAELPKVARAPSAPEDEVREERVKMTRLRQTIARRLKDAQSNAAMLTTFNEVDMTAVMDLRKKYKDLFEKKHGVKLGFMGFFTKAVCHALKEIPAVNAEIDGTDIIYKNFCHIGVAVGTERGLVVPVVRDADRMTIAEIEKEIGRLGAEARDGKLALADMQGGTFTISNGGVYGSLMSTPILNAPQSGILGMHKIQERPMVVGGQIVVRPMMYLALSYDHRIVDGKEAVTFLVRVKDVLEDPERLVLDL

SEQ ID NO: 6192 - protein, 458 aa, Sulfolobus tokodaii str. 7
MKLSDIFKPLDQRNFDVWHIKSLLTTGMGVFTDGYDLSSIGIVLAMVLSSFGITSKSPDYTLWQSLVSGSALIGAAVGAIIFGILSNRGRKTFYGIDVALLSIGALLQAFVSTPLELVIVRGLLGLGVGADYVLSPMIMAEYSNAKDRGKLLAFGFGLMWGFGATTAAAIALGLEALSVPTNIIWRVVLVTGAIPSASVIYLRRKIPETPRYLARIKGDVEKFREVVRTLANTDIHVNKELKDINSFSSYFSKFWKTFLAACLLWFLFDIVAYSGILFGPTDIAKSIGINNSAIFQFVIEFGFTLPGGIIALLTLDRIGRKPMQTFGFFGMAISLLLFSLLKSSIPATTALILYGLQNLFSQAGPGSVSASGMLGVELAPTKVRGLVQSLTVASGRIGAALTAFVFPALFNTYGESFAVAFLSSVAFVAAVLTLIAVPETKGKPLEVSSQEDLIVQEI

SEQ ID NO: 6193 - protein, 470 aa, Mesorhizobium sp. BNC1
MPDTYDVVVIGTGPGGYVCAIKAAQLGLKTAVVEKRTNHGGTCVNVGCIPSKALLHATEMFAEAGHSFADLGIDVGTPKLDLKKMLAHKEKTVDQNVKGLDFLFKKNKIDVFRGAGRIAAAGKVVVTGEDGKEQTVETKNIVIATGSDVAGIPGVDVDFDERVIVSSTGALELPAVPARMVVVGGGVIGLELGSVWSRLGAKVTVIEYLDTILGGMDGEVAKQFQRMLAKQGFGFKLGAKVTGIAKTEGGASVTFEPAKGGEAETIDADVVLVATGRKPYIDGLGLKEAGVEVDERGRVKTDGHLRTNVPGIYAIGDVITGPMLAHKAEDEGVAVAEIIAGQAGHVNYDVIPSVVYTSPEVASVGKTEEELKKAGIEYNAGKFPFSANGRARSMLHTDGFVKVLADKKTDRVLGVHILGFGAGEMIHEAAVLMEFGGSSEDLARTCHAHPTMSEAVKEAALATFYKPIHS

SEQ ID NO: 6194 - protein, 507 aa, Triticum aestivum
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 6195 - protein, 380 aa, Oryza sativa Indica Group
MGAVTSTVAARFAFFPPSPPSYGAEAPPPPAAAGAGVGVEKDGGGGGVVVELTDVPRRGNVEARRLRTKRGTEVVAMYVRQAGARLTLLYSHGNAADLGQMFELFVELSAHLNVNLMGIRIRRLYDYSGYGQSSGKPSEHNTYADIEAVYRCLVETYGASEENIILYGQSVGSGPTLDLASRLPHLRAVVLHSPILSGLRVMYPVKHTYWFDIYKNIDKIPLVRCPVLVIHGTADEVVDCSHGRALWELSKVKYEPLWVKGGNHCNLELYPEYIKHLKKFVGAIEKSPPLYDESPESSGPSDNTQTNPEGTEESRKSTDCREKTRSSIDHRQSTDRRDKSRGSTDRRDKNRKSVDQPRASVDQPDRPRKSVDRYGYLVDL

SEQ ID NO: 6196 - protein, 472 aa, Chlorobium tepidum TLS
MAIPRQKMPAQDPVERVGNFKEVNLGLTPEQAQQEALRCIQCKDPVCIAGCPVNIKIDQFIKLIAEGDFMGAVRKIKEDNVLPSICGRVCPQEDQCEKVCVIGKKHEPVAIGNLERFVGDYERTSGQKIDPKIAPPTGKKVAVVGSGPAGLSCANDLAQYGHKVVVFEALHELGGVLMYGIPEFRLPKEIVREELDGLRRMGIEFRTDVVVGRTITIDELMEEEGFDAVFIGVGAGLPWFMGIPGENLVGVLAANEFLTRVNLMKAYDFLKSSDTPVFDCKGKNVAVFGGGNTAMDAVRTAKRLGAEHAYIVYRRSEKEMPAREEEIHNAKEEGIEFLLLTTPLEFVGDEKAWLTGAKCQKMELGEPDDSGRRRPVPVEGSEYILPIDMAIISIGNGPNPLIHQTTPDIEVSKRETIVVDVNTMQTSKENVYAGGDIVTGGATVILAMGAGRKAAAAINEKLGGTAKNFNEW

SEQ ID NO: 6197 - protein, 516 aa, Mycobacterium sp. MCS
MTGRTTAQQLAELREKLELAKEPGGEKAAAKRDAKGIPSPRARIHALLDPGSFLEIGALARTPGDPNALFGDGVVTGHGTIDGRPVGVFSHDQTVFGGSVGEMFGRKVSRLMEWVAMVGCPIIGINDSGGARIQDLATSLAWYAELGRRHELLSGLVPQISIILGKCAGGAVYSPIQTDLILAVRDQGYMFVTGPDVIKDVTGEDVTLDELGGADAQAKYGNIHTVVDTEKDAFQYVRDYLGFLPSNTFDDPPIVNPGLEPEVTPHDLELDSIVPDSDNTAYDMHEILLRIFDDGDFLEVAGQAGQAIITGYARVDGRPVGVIANQPMHMSGAIDNEASDKAARFVRFCDSFNVPLVFVVDTPGFLPGVEQEKNGIIKRGGRFLYSVVEADVPKVTITVRKSYGGAYAVMGSKQLTSDFNFLWPTARIAVIGAEGAAQLIVKRFPDPNAPEVQEIRRQFIEGYNRDMATPYVAAERGYVDAVIEPHETRLKLRSAMRLLRDKQIQRVQRKHGLIPI

SEQ ID NO: 6198 - protein, 462 aa, Gibberella zeae PH-1
MSTVFFVSVIAGGISCVVLVWLLSGLAGLIPTRYQPAEKPEDDHIQVLVVGDVGRSPRMQYHAMSVAKHGRQVDIVGYKETSRHPDLIGNPRVTMYALPPQPEVLRWGTLPFFLNIPLKVLWQFWGLFRTLMYDAPAAKWIIIQNPPSIPTFHVALMVSLLRGSKLVVDWHNYGYTILAQNKWYYKPLVPIYRWYETGFGRYLGDANLAVTDAMARQLKVKPFNVKRSVYTLHDRPAEVFQPILSTKERHAFLSRLAETRSVAKDIVEGAVRLIVSSTSWTPDEDFGLLLDALVSYASTAEAAPILAIITGKGPQKEHYLERIQALQDEGKLPGIRILTAWLSTRDYASLLASADLGISLHKSSSGVDLPMKVVDMFGAGLPVAAYSAFESFSELVKEGQNGCGFETSSELTDILTRLLSFSGHEELSWLKKGAVSEGALRWDHEWDRVVGKVIGLVGEEST

SEQ ID NO: 6199 - protein, 158 aa, Triticum aestivum
MHPTRWELSHMVDLQAAALVISVGPAEGPIVSGGKKVTPSKRAPPHALSPAEPPPPPPLHSPRVNNPWTMEMNAATSLEPRAKATLVLGGESFTVSSESGALSEQLAAMREKSMVILKEYITKHNVPNDVPDESIEGPSDEEGEALAKNPPKKSKKQK

SEQ ID NO: 6200 - protein, 571 aa, Oceanobacillus iheyensis HTE831
MAKKIEGIAASSGIAIAKAYELKTPELSFERSNIDDPTSEINRLDKALEISKQELEKIKAHTLKEIGEEHAEIFSAHLLVLSDPELIGPMKDKINEEKINAEAALDEVATMFIEMFKAMDNEYMRERAADIQDVTKRVMSHLLGVTFPDPALIDEQVVVIAEDLTPSDTAQLNREFVKGFATDIGGRTSHSAIMARSLEIPAVVGTKNITSSVQKDDVIIVDGLDGNIIINPSEEEIQAYKQKQADFAKKQEEWAKLKDEPSFTKDGEQVELAANIGTPEDVEGVLNNGGEGVGLYRTEFLYMGKSELPSEDEQFDAYKTVLEKMKGKPVVVRTLDVGGDKEISYLDLPKELNPFLGYRAIRFCLENEHVFRPQLRALLRASAYGNLKIMFPMIATIEEFRQAKALLMEEKDSLKNDGIEVSDDIEIGIMVEIPSTAVIAKQFAKEVDFFSIGTNDLIQYTMAADRMNEQVSYLYQPYNPAILNLINTVIEAAHAEDKWVGMCGEMAGDSIAIPLLVGLGLDEFSMSATSILPARTQLLSLNKKELVKAKEQFLAMSTSEEVVAFVKEITE

SEQ ID NO: 6201 - protein, 179 aa, Zea mays
  misc_feature (109)..(109): Xaa can be any naturally occurring amino acid
  misc_feature (114)..(114): Xaa can be any naturally occurring amino acid
  misc_feature (174)..(174): Xaa can be any naturally occurring amino acid
WNLLQHRSPQPSLLLHSRLVDQRPLAKILHLTLNVLQRPRNQGADLFFRAVISNMEKVYLSRNPTAKTILELVRSYDGDHICYDHFAFRTFGVITSIYSVIVLHSVKSXILITXLRFPAKKLRALWFSPPTNDGYSGTGTYGPLPRIFISELLVDELTTQSQENYHKYIKTSGXGNNHA

SEQ ID NO: 6202 - protein, 327 aa, Oceanobacillus iheyensis HTE831
MVKKVLLFGDIGIDDIITLIYAALDEEIEVIAVVASYGNISREKATNTISYIQDLLNYKNLQVPLILGAQRPMTGEIPKEVSDIHGEYGMGPIIPPINDAEVVENFLQIIDIIEKNEDIYIANIGRLTDLATLFILYEDLMGKVKGIYIMGGAFWVPGNITAVAEANFHGDPVAAQLVMRFASNLKILPLNVSNQAIVTPEMVNYIDQVGQISIVKPMIDYYYDFYKKRDPSIIGSPMHDVLVLMAIKNKDMFQFFSRPITIVQSLLGEERGQSIADIRSYEDGYYTITETNHHQIAFQMDYQQFFFDFMTNMSNGQFDRSLYKKEK

SEQ ID NO: 6203 - protein, 429 aa, Oceanobacillus iheyensis HTE831
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 6204 - protein, 409 aa, Yersinia pestis KIM
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGRTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 6205 - protein, 292 aa, Triticum aestivum
  misc_feature (31)..(31): Xaa can be any naturally occurring amino acid
  misc_feature (41)..(41): Xaa can be any naturally occurring amino acid
  misc_feature (102)..(102): Xaa can be any naturally occurring amino acid
  misc_feature (152)..(152): Xaa can be any naturally occurring amino acid
  misc_feature (157)..(157): Xaa can be any naturally occurring amino acid
  misc_feature (180)..(180): Xaa can be any naturally occurring amino acid
  misc_feature (207)..(207): Xaa can be any naturally occurring amino acid
FRLNPVPGQGRPLEFKVKGPKSPLFGRRRVXLFGLRNPKKXPMGPLWSEDPFRSTGVFPNKDKAHAHLKGGPKKVIIFAPSKDAPMFVCGVNEKEYKSDIDXVSHASCTTNCLAPLAKVINDRFAIVEGLMTTVHAMTAPQKTVDGPSSKDXRGGRXAASFNIIPSSTGAAKAVGQGAPXFNGKLTGMAFRVPTVDVSVVDLTVRLXKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 6206 - protein, 118 aa, Oryza sativa
  misc_feature (23)..(23): Xaa can be any naturally occurring amino acid
  misc_feature (56)..(56): Xaa can be any naturally occurring amino acid
CGPPINTPSLQNYKRMVDAWGGXWSLFHALLQTLKKVSLKHGAFYINSLLVRYILXNQTSVAGSMVGVRLGLSEHIKDTNAIFSLELDEEDMNSITEASNKGRNLMDIIGDCGDEYRA

SEQ ID NO: 6207 - protein, 301 aa, Yersinia pestis KIM
MPPLQPHGVSANMSTKHPVIAVTGSSGAGTTTTSLAFRKIFQQLDIRAAQIEGDSFHRYTRPEMDAAIRKARDQGRHISYFGPEANDFGQLEQSVAEYSKHGTGRSRKYLHTYDEAVPYNQIPGTFTPWEPLPEPTDVLFYEGLHGGVVTEHHDVAKHVDLLVGVVPIVNLEWIQKLVRDTGERGHSREAVMDSVVRSMDDYINYITPQFSRTHINFQRVPTVDTSNPFAAKAIPSLDESFVVIHFRGLDHIDFPYLLAMLQGSFISNINTLVVPGGKMGLAMELIMAPLVQQLLEGKQIA

SEQ ID NO: 6208 - protein, 482 aa, Nostoc sp. PCC 7120
MVTTAEKTNIGYITQIIGPVVDVKFPNGKLPQIYNALTIKGTNEAGQQLNLTVEVQQLLGDNQIRAVAMSSTDGLVRGLEVVDTGAPISVPVGKATLGRIFNVLGEPVDNRGPVNNQETLPIHRPAPKLTELETKPSVFETGIKVVDLLTPYRRGGKIGLFGGAGVGKTVIMMELINNIATQHGGVSVFAGVGERTREGNDLYNEMIESGVINNENLNESKIALVYGQMNEPPGARMRVGLSGLTMAEYFRDVNKQDVLLFIDNIFRFVQAGSEVSALLGRMPSAVGYQPTLGTDVGQLQERITSTTEGSITSIQAVYVPADDLTDPAPATTFAHLDGTTVLSRGLASKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDDLPEQAFYLVGDINEAIAKAEKIKG

SEQ ID NO: 6209 - protein, 570 aa, Aspergillus oryzae
MANMSPLRGYITSYSPRVRQYGNALLTPVIPPSQTGPTPRMTKRGTAAINYAEDGFDDDDFEDSEGPRRPTGLRSLRREESTIDKVPLAEKLGKEVHAPVEVQGVFRDWMIKRMLRPVCADQLQIQAQLPLTLIPIRIDLEVPAHQPLEPFQLPRTVLDPGINPALPGYRRPEPLPAYRIKDTFLWNLHEALATPEEFATGFVRDLDLPNPQAMTMAISNQIRQQLEEYAGVALHPLFQSTLPKPPSASQAGVSRDVSATPVPTHAATPDSRSNTVTVTKEPFVNDSFLNPDDAYRCMINLNINLQNKLYTDKFEWSLLHPPGMAEEFAKITCADLGLSGEWVGAIAHGIYEAVLKLKKEVCESGGLVSGIGGYGNEIDNQAANGTEAGWRYDPEGLGDEWEPKVETLSKEEIEKREGDRERQIRRLRRETARFSSTAGITPDVSRQGSGGYFDVDSETPLGRGERSKRKRRFRSLSPLGRGGTPGGRGTPDTSSGAGYGGGGGTLSDWERQNWRCSNCMVWGTAVWAVRDGPAGPRTLCHNCGLLYERDKVAPEWSRDLHRHDIPIGRA

SEQ ID NO: 6210 - protein, 280 aa, Oryza sativa Japonica Group
MAKDIEASAPEGGEFSAKDYTDPPPAPLIDVEELTKWSLYRAVIAEFIATLLFLYITVATVIGYKHQSDATVNTTDAACSGSRHPRHRLGLRRHDLHPRGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 6211 - protein, 528 aa, Anabaena variabilis ATCC 29413
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDKILTHLRNNLASTLVLVISKSGGTPEPRNGMIEVKKAYAGQNLDFAQYAVAITSTGSNLDKVAQAEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGKTVYQGIAVYGNKGSTDQHAYVQQLREGVPNFFATLIEVLEDRNGASPEIDPGVTSGDYLSGFLLGTRQALYENQRDSITVTIPQVNARTVGALIALYERTVGLYASLVNINAYHQPGVEAGKKAAAVILDLQTKVVGLLQKEKTALSLEQIAEKIGAADQVEAIYKILRHLQANQRGVVFQGNLGQPSSLKVSIS

SEQ ID NO: 6212 - protein, 406 aa, Rhodobacter sphaeroides 2.4.1
MFDVASIRRDFPILSREVNGKPLVYLDNGASAQKPQVVIEAMNLAYSHEYANVHRGLHYLSNLATDKYEAVRATIATFLNAPSPEEIVFTTGTTEGINLVSYGWAAPRLQPGDEIVLSIMEHHANIVPWHFLRERQGVVLKWVDVDQNGDLDPQAVIDAIGPKTKLVAVTQMSNVLGTVVDVAAICAGARDKGVPVLVDGSQAAVHMPVDVAAIGCDFYAITGHKLYGPSGSGAIWIRSERMEEMRPFIGGGDMIHEVTRDTVTYARPPMRFEAGTPGIVQQIGLGVALHYMMNVGMAEIAAHERTLRDYARDRLAGLNWLDVQGNSAGKGAIFSFTIRGGAHAHDISTVLDRKGVAVRAGTHCAMPLMQHMGVGATCRASFAMYNTPDEVDRLVEALELCHELFG

SEQ ID NO: 6213 - protein, 827 aa, Zea mays
MATRAGRLPTTPAPALLLLLAFPFLLQGVLPSRAGDTVAAGRPLSGGQSLVSKRGKFRLGFFRPGATDNSSQRWYLGIWYNQLSVHTTVWVANRGTPISDPESSQLSISKDGNMVVLDHSRSSTAVWSTNVTTGVSSTSTVGVIRDNGNLVLADASNTSAVLWQSFDHSGDTWLPGGKLGRNKRTGEVTRLVAWKGRDDPTPSLFALELDPRGSSQYLLNWNDSERYWTSGNWTGTAFAAVPEMTSTGASPVSDYTFGYVDGANESYFTYDVADESVVTRFQVDVTGQIQFLTWVAAAAQWVLFWSEPKRQCDVYAVCGPFGLCTENALPSCTCPRGFRERDLAEWMQDDHTAGCARNTALQPCGAGAAARDGQKRRRDDDRFYTMPDVRLPSDARSAAAASAHDCELACLRNCSCTAYSYSGGCSLWYGDLINLQDTTSAGSGTGGGSISIRLAASEFSSNGNTKKLVIGLVVAGSSFVAAVTAIVLATVLVLRNRRIKSLRTVQGSLVAFTYRDLQLVTNNFSEKLGGGAFGSVFKGVLPDATLVAVKKLEGVRQGEKQFRAEVSTIGTIQHVNLIRLLGFCSEGSRRLLVYEHMPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLLDGDVRSAVDSQLGGNADVAEVERACKVACWCVQDAESLRPSMGMVVQVLEGLVDVNAPPVPRSLMVLADPSKYAVEFFSGLPST

SEQ ID NO: 6214 - protein, 696 aa, Ralstonia metallidurans CH34
MSDIVNYELRGPVAVLSMNKGPVNGLGAALRTAIADAVDRANADPAVQAIVLTGTPRAFSAGADITEFGTPNASREPNLRVVIDQIEGGAKPVVAAIAGQCLGGGLELALGCHFRVALPDAQLGFPEVKIGLLPGGGGTQRMPRLIGLEPAVNMVTLGNPAPAKSFAGTPLIDRVADGDVVAAAVAFAQELIAAKTPPRRTRALSVSHPQGESFLQFARNSVAQQAKGQIAPMKALEAVAASLTKSFDEGMRVEREGFMSLMASPESRALRHIFKAEHAASKIADLPAGTPLREIRKVGVIGAGTMGGGITMNFLNAGIPVVLLEMKQEALDKGLATIRRNYENSMKKGKLKPEQVEQRMGLITGTLSYADLSDVDLVIEAVFENMDVKKTVFETLDKTCKAGAILASNTSYLNLDRIASFTKRPTDVIGLHFFSPANVMRLLEIVRGAQTAPDVLATCMALAKKIKKIAVVSGVCDGFIGNRMLARYGAAAGALINAGALPQQIDGALQKFGMAMGPYRMGDLAGLDIGYATRKRKAAEAGVPLRPSVADKLAEAGRLGQKTGAGWYRYEAGNRDPIPDPATEALIAEFRSAQGITPRAISDEEVVERCIFALVNEGARILEEGIAARASDLDVVYLNGYGFPRLRGGPMLYADMVGLPNVVRSLRRFAAEPGADPAWQPAPLLVRLAEAGKSFD

SEQ ID NO: 6215 - protein, 337 aa, Anabaena variabilis ATCC 29413
MKIRVGINGFGRMGRLALRAAWGWPELEFVHINEIKGGAVAAAHLLKFDSVHGRWTPEVEAEGERVLIDSTPLSFSEYGKPEDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVNRPTTVEEINALLKAASEQAPLQGILGYEERPLVSIDYKDDPRSSIIDALSTMVVDETQVKILAWYDNEWGYVNRMVELARKVALSLK

SEQ ID NO: 6216 - protein, 77 aa, Triticum aestivum
  misc_feature (51)..(51): Xaa can be any naturally occurring amino acid
  misc_feature (65)..(65): Xaa can be any naturally occurring amino acid
MASDGRVERIASSIRAIPNFPKPGILFQDITTLLLDPQAFRDTTDLFVEAXYRTKDITVVAGVEXAEGFIFGPSQWH

SEQ ID NO: 6217 - protein, 512 aa, Oceanobacillus iheyensis HTE831
MSQNKLAALIILDGFAIRDEVKGNAVKQANTPNFDRFWNQYAHNQLEASGKAVGLPDGQMGNSEVGHLNIGAGRIVYQSLTRVNVSIDEGDFYEVDAFIKSVEHAKKHDKALHLFGLLSDGGVHSHINHLFALLRLAKKHELENVFVHAFLDGRDVGPKTASKYIKETQDVMDELGVGQFATISGRYYSMDRDKRWDRVKKCYDAMVYGEGPSYKSAQEVVDDNYANEIYDEFVIPSVITDDNDEPVATIKDEDSIIFYNFRPDRAIQISRTFANEDFRDFERGDKAPKKLDFVMLTNFSETVDGYVAYQPVNLDNTVGEVLAQNNLNQLRIAETEKYPHVTFFMSGGREKEFPGEKRILIDSPKVATYDLKPEMSVYEVTDALLKELDKGEQNAIILNFANPDMVGHSGKLQPTIDAIEAVDECLGKVIDKITELGGHAIITADHGNSDEVMTLEDKPMTAHTTNPVPVIVTKDDIELRDGGILADLSPTLLDLLNVEKPKEMTGNSLIKK

SEQ ID NO: 6218 - protein, 252 aa, Oceanobacillus iheyensis HTE831
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 6219 - protein, 393 aa, Oceanobacillus iheyensis HTE831
MNKKTINDLQVEGKRVFTRVDFNVPLKDGEITDDTRIRAALPTIEQLTAQGAKVILASHLGRPKGTVVEELRLDPVADRLSDLLGKEVLKTDQVYGEEVDQAISELENGGVLLIENVRFEAGEEKNDPELVEAFANMADLYVNDAFGAAHRAHASTTGVAEKLPAAAGKLMEKEIEALGNALENPERPFTAIVGGAKVKDKISVIDNLLDKVDNLIIGGGLAYTFIKAQGHEIGKSLLEEDKIDLAKEFMNKAKEKGVNFVLPVDAIVADDFSEEANTKIVDIDKIPSDWEALDIGTKTREKYSSIVKDSKLVIWNGPMGVFELNAFAGGTKAVAEALASTEGYSIIGGGDSAAAVEKFGLAEEMDHVSTGGGASLEFMEGKVLPGLAALNDK

SEQ ID NO: 6220 - protein, 225 aa, Oryza sativa Indica Group
MAAPTAAALSTLSAASVTSGKRFITSSFSLSFSSRPLATGVRAAGARAARRSAASASTVVATIAVGDKLPDATLSYFDPADGELKTVTVAELTAGRKAVLFAVPGAFTPTCSQKHLPGFIEKAGELHAKGVDAIACVSVNDAFVMRAWKESLGLGDADVLLLSDGNLELTRALGVEMDLSDKPMGLGVRSRRYALLADDGVVKVLNLEEGGAFTTSSAEEMLKAL

SEQ ID NO: 6221 - protein, 346 aa, Synechococcus sp. RS9916
MFGLIGHSTSFEAARRKASELGFDHIAEGDLDVWCSAPPQLVEHVEVTSATGKTITGAYIDSCFVPEMLSRFKTARRKVLNAMELAQKKGINITALGGFTSIIFENFNLLQHQHVRSTTLEWERFTTGNTHTAWVISRQVENNAPLLGIDLSSAKVAVVGATGDIGSAVCRWLSQRTGVGELLLVARQQQPLLDLQQELGGGRILSLDEALPEADVVVWVASMPRTLEIDAASLRKPCLMIDGGYPKNLDAKVASAGVHVLKGGIVEFGSDIGWSMMEIAEMEKPQRQMFACFAEAMLLDFEECHTNFSWGRNNITLEKMDFIGEASVRHGFSTLNLNPQPQAAVA

SEQ ID NO: 6222 - protein, 335 aa, Oceanobacillus iheyensis HTE831
MAVKIGINGFGRIGRNVFRQSLKNNEVEVVAINDLTDANMLAHLLKYDSVHGKLQEEVTVNGSNLVIDGKEIKVLSERDPAELGWGDLGVDIVIESTGRFTNKEDAEKHIQAGAKKVIISAPAKGEDLTIVMGVNDDQYDPSEHNVISNASCTTNCLAPFAKVLNDNFGIKRGLMTTIHSYTNDQQILDLPHKDYRRARAAAENIIPTSTGAAKAVGLVLPELNGKLNGNAVRVPTPDGSLTDLVAELDKNVTIEDVNNAMKEAAEGPLKGILEYSEEPLVSSDIVGNNHSSIFDALSTIVMEDNMVKVVSWYDNEMGYSARCIDLAIFMNNKGL

SEQ ID NO: 6223 - protein, 422 aa, delta proteobacterium MLMS-1
MSRRLDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRTYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPQAVVRDSILFHDCRVAAGATVDLAILDKRVQVGEKAVVGQGEDKTVANRANPKHLYSGISLIGKQARIPAGAVIGRNCIIAPGCRDDDFPTATLASGESL

SEQ ID NO: 6224 - protein, 296 aa, uncultured bacterium
MSQQQLQEIIQLLKSQPITGSPSIEETRAGFEKMAGMFSVEADVKSERVNAGGVKSEWVTAPGADAGRAVLYLHGGGYVIGSINTHRSLAGRISRAAKARVLVIDYRLAPEHPFPAAVEDSVAAYRWMLSTGLKPSRIAVAGDSAGGGLTVATLVAIRDAKLPVPAAGVPLSPWVDMEGLGDSMKSKAAADPMVQKDGLLQMAAAYLAGKDPRTPLAAPLYADLAGLPPLLIQVGTAETLLDDSTRLAERARKAGVKVTLEPWENMIHVFQIFAPILDEGQQAIEKIGAFIRANAE

SEQ ID NO: 6225 - protein, 256 aa, Pseudomonas aeruginosa PAO1
MNDPRKGADAEPTTHFGYQNVPESQKAKKVAEVFHSVAAKYDLMNDLMSGGIHRLWKRFTIELSGVRSGNRVLDIAGGTGDLTRQFSRLVGPTGEVVLADINASMLKVGRDKLLDKGVSGNVSFVQADAEKLPFPDNHFDCVTIAFGLRNVTHKDEAIRSMLRVLKPGGRLLVLEFSKPSSNLLSKAYDAYSFSLLPLMGKLVTNDSESYRYLAESIRMHPDQETLKAMMVEAGFDRVTYHNMTGGIVALHRGIKP

SEQ ID NO: 6226 - protein, 446 aa, delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPDSLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEEAVISNSLVYNGCQVEGRVENSVLFPGVQVKPGAVVRDSVLFFDNVVGRDCHLEKVVSDVNVTVGDGVVIGVPAPSPAAGGATGTGRASGAENLAGGESGGDATTVTVLGWNNQIPAGMVIGAGCTLYPSLGPEKMARQRVADGEVLR

SEQ ID NO: 6227 - protein, 167 aa, Arabidopsis thaliana
AYNLSRDHKPDLEAEKERILKAGGFIHAGRVNGSLNLSRAIGDMEFKQNKFLPSEKQIVTASPDVNTVELCDDDDFLVLACDGIWDCMTSQQLVDFIHEQLNSETKLSVVCEKVLDRCLAPNTSGGEGCDNMTMILVRFKNPTPSETELKPEASQAEGNHDEPSSSN

SEQ ID NO: 6228 - protein, 503 aa, Tropheryma whipplei TW08/27
MRPVLVVDFGSQYSQLVVRAIRECGYYAEFASPSISAAECLALSPIAIFLSGGPASAYKDNAPKLDEEIFNCGIPIFGICYGFQLLAQAFGGSVKKANAPEYGPADITIVNKAFFSGQPDRQTVWMSHGDSVIRAPKNFCILSTSQDAVLSFCNRDRTIAGVQWHPEVKHSRFGKHTIKAFLSSFAAPNWDPEQTICGTVDSIRKTVGCKRVLCALSGGVDSVVAATLTHRAIGDRLRCVFVDHGLLRLNEREQVEEYCSSLGLNVSTYDASDCFLSALSGIRDSEQKRKVIGREFIACFSKLQERFDIKPHFLLQGTLYPDLVESGATPGGATIKSHHNVGGLSDNLGFELLEPLKYLFKDEVRKIGLQLGIPKHIVHRQPFPGPGLAIRIIGEVTNKKLSILRAADAIVRHELRDWTDIWQCPVILLSDVQSVGVRGDSRSCGFPIVIRPVSSDDAMTADWYRLPYDVLARISGRITNEIPEIVRVVLDITPKPPATIEWE

SEQ ID NO: 6229 - protein, 371 aa, Mycobacterium sp. MCS
MNHVLPSPYQAHRAQHSPRRAGRFERPATMVGQTPVLRIGEPFTPSGRGFWAKLEGFNPGGMKDRPALHMVQRARARGELRPDARIVESTSGTLGLGLALAGTVYGHPVTLVTDPGMEPIIQHMLAAFGAQIELVTQPHPQGGWQEARRQRVGELLAADPQAWHPDQYSNPDNVEAYRGLAMELIEQLGAVDVLVCSVGTGGHSAGVARVLRERNPQMRLIGVDTIGSTIFGQPASTRLMRGLGSSIYPGNVDYDAFNEVHWVAPSEAVWACRTLASTHYASGGWSVGAVALVAGWAARQGDSGTTVAAVFPDNPQRYFDTIYNDDYCRTHGLLDTAPPSEPATIEDPLAHTVTAWTRCATVIDPTQELPR

SEQ ID NO: 6230 - protein, 2228 aa, Gibberella zeae PH-1
MALVPQPPASARQFGAEDDGLVCLELEDGSTFQGYSFGAQKSIAGELVFQTGMVGYPESVTDPSYRGQILVITFPLVGNYGVPSREAMDELLGDLPAHFESNQIHIAGLVTASYAGEDFSHFLATSSLGTWLKEQGVPAMYGVDTRALTKKIREKGSMLGKMRLEMRGVTNGAVTSQVDGALAALPLDHFEQVEWVNPNNKNLVQEVSIKEPKLYKPPQSVARKHPSGRTIRVLCLDVGMKFNQLRCFLKRGVEVLVCPWDYDIASAIDEFDGLFLSNGPGDPAVLENTVKNIASVLEKNEIPVFGICLGHQLLARAAGATTKKMKFGNRGHNIPCTSMVTGKCHITSQNHGFAVDTDSLTNGWKELFVNANDGSNEGIYHTEKPYFSVQFHPESTPGPRDTEFLFDVFINTMANCAEKPELLKTPVHFPGGTIEENEALHPRVSVRKVLVLGSGGLSIGQAGEFDYSGSQAIKALKEEGIYTVLINPNIATIQTSKGLADKVYFLPVNADFVRKVIQYERPDAIYVTFGGQTALQVGIQLKDEFESLGVKVLGTPIDTIITTEDRELFARSMDSIGEKCAKSASANNIDEAMHAVKDIGFPVIVRAAYALGGLGSGFANNEDELMELCNKAFAASPQVLIERSMKGWKEIEYEVVRDAQDNCITVCNMENFDPLGIHTGDSIVVAPSQTLSDEDYNMLRTTAVNVIRHLGVVGECNIQYALNPFSREYCIIEVNARLSRSSALASKATGYPLAFIAAKLGLNIPLKEIKNSVTKSTCACFEPSLDYCVVKMPRWDLKKFTRVSTQLGSSMKSVGEVMSIGRSFEEAIQKAIRAIDPHNLGFNDTEALMSIEDELQTPSDQRLFAIANAMHEGYTVDKIWELTKIDKWFLTKLKGLSDFSKRMTGYSTTDITSSPSILLQAKRLGFSDRQLAKFWSSNEIAVRRLRLEAGIQPFVKQIDTVAAEFPAFTNYLYMTYNASEHDVSFDDHGVMVLGSGVYRIGSSVEFDWCSVRAIRTLRASGFKTIMVNFNPETVSTDYDEADKLYFENILLETVLDIYQLENSSGILGAMGGQTPNNIALALHRAGVKVLGTSPEMIDNAENRYKFSRMLDRIEVDQPTWKELTSFSEAQDFCNAVSYPVLVRPSYVLSGAAMNTVYSEKDLKNYLDQAVEVSRDHPVVITKYIENAKEIEMDAVAKDGKVIGHFVSEHVENAGVHSGDATLILPPQDLEATTIQRIEEATRKIGAALNVTGPFNIQFIAKDNDIKVIECNVRASRSFPFVSKVMGVDLIEMATKAIMGQPFQAYPPTDLAPNCVGVKVPQFSFSRLSGADPVLGVEMASTGEVACFGVDKNEAYLKALMSTGFKIPKKNILLSIGSYKDKREMLPSVQKLEKLGYKLFATSGTADFLQEHGVQCQYLEVLGKEEDRSSEFSLTQHLAKNTIDLYINLPSNNKYRRPANYMSKGYQTRRMAVDYQIPLVTNVKNAKILVEAIARHFELEVSKRDYQTSHRTIVLPGLINIAAFVPGIASANSDDIQTVTQASISAGFSMIRVMPLGVDGAITDALTLNTAQQNSRRGGYCDYNFSVAATSDNADQISHVTGEVGSLFIPFNHLSGNISKVAAVTAHFDSWPNHKPIVTDAKLTDLASILLLASLHNRRIHVTSVTNKDDIKLIALSKAKGLQVTCDVSIYSLYLSRDEYPECERLPTAVDQKALWAHLSTIDVFSIGSLPYRLATSLGHKGDPHMGIYDALPLLLTSVAEGRLTVDDIKDRLYTNPMEIFELHEQSGTTIEAEIDRPYNLAPGNFWSPFEGRVMRGSVQRVTFQNTTVCLDGEVLKVSPQGKDMSSHIAPPMSPPTKPTTSIAQATDSPRDRRLSMLANFQPLNRLRGVDSDAAPVGELAPGLQPQPMVSSSLQQLLARPSSFKNTHVLSVKAYSRADLHLLFTVAQEMRLGVQREGVLNILRGRLLTTLFYEPSTRTSASFDAAMQRLGGRTIAISTSHSSVKKGETLQDTLRTLACYGDAVVLRHPEESSVHVAEKYSPVPVINGGNGSKEHPTQAFLDLFTIREELGTVQGLTITFLGDLLYGRPVHSLVYLLRHYQVQVQLVAPKSLALPPKVREQLVASGQLLCESETLTPEILARSDVLYCTRVQRERFPTEEEYQQVKNSYRVDNASLKHAKSSCIVMHPLPRNEEVAEEVDFDQRAAYFRQMRYGLYCRMALLALVMADS

SEQ ID NO: 6231 - protein, 239 aa, Zea mays
MESKRVSDQDALIDLESGNGTTVSNYTNGGDASFTVGQARTAPNGAWNGCVCANGCPRDDRNQHMDCSPPASDAVARSGDDRKSEGEEKLMDSSGGEKTKKKRSKKARGPPRPLTPTPLDVSDQKLLNELSELAVLKRARIERMKALKKMKNAKQGSSGGNLCPLIITIIFCIVILWQGFFSGHESAVSFHGSPESSVRAHSSLISIRFYKKNHSNVRPPSETTAAPDNVETVSRLLEP

SEQ ID NO: 6232 - protein, 135 aa, Arabidopsis thaliana
  misc_feature (105)..(105): Xaa can be any naturally occurring amino acid
  misc_feature (131)..(131): Xaa can be any naturally occurring amino acid
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGXFVYREHGKHFPGTTDGRYWSMWELPXFGCT

SEQ ID NO: 6233 - protein, 339 aa, Armillariella tabescens
MVKVGINGFGRIGRIVLRNALQFSEIEVVAVNDPFIDLDYMVYMFKYDSVHGRFKGTVEAKDGKLYIEGKPITVYGERDPSAIPWGSVGAEYVVESTGVFTTIDKASAHLKGGAKKVVISAPSADAPMFVVGVNLDAYDPSYKVISNASCTTNCLAPLAKVIHDKFGIVEGLMSTIHATTATQKTVDGPSNKDWRGGRGVNNNIIPSSTGAAKAVGKVIPSLNGKLTGLSFRVPTSDVSVVDLVARLQKDASYDDIKAAVKEAAASGPLKGVIEYTEDAVVSTDFVGHSASSIFDAKAGIQLNKNFVKLIAWYDNEWGYSRRVCDLLVYAAAQDKKAGL

SEQ ID NO: 6234 - protein, 169 aa, Methanococcus aeolicus
MKNTHIISVLVLNKPGVLQRISGLFTRRWYNISSITGGSTDSTDISRMTIVVKGDDKVVEQVVKQLNKLIEVIKVIDLDEEECVERELCLIKIYAPTESSKSQVIQYANIFRGNIVDLSQESLTVQITGDKTKISAFIKLVKPMGIKEISRTGLTALMRGPKILKSNKA

SEQ ID NO: 6235 - protein, 461 aa, Yersinia pestis KIM
MDLDAVIWLEKWLKSYTGTLVLISHDRDFLDPIIDKILHIEQQTLNEYTGNYSSFERQRATKLSQQQSMYQHQQEKVAHLQSYIDRFRAQATKAKQAQSRIKMLERMELIAPAHVDNPFHFSFRTPESLPDPLLRMDKVSAGYGENTVLQSIKLNLVPGSRIGLLGRNGAGKSTLIKLLAGTLEPQSGEIALSKGIKLGYFAQHQLEFLRADESPLQHMSRLAPKESEQQLRDYLGGYGFQGDQVTDPTARFSGGEKARLVLALIIWQRPNLLLLDEPTNHLDLDMRQALTEALIDFEGALVVVSHDRHLLRSTTDDLYLVHDGKVEQFDGDLEDYQQWLVDSQRQQSQQDNPAKELSGNSAQQRKDQKRRDAEFRTQTQPLRKQIMTLEKQMDKLSTELAAIEAQLADSALYDIARKADLTQCLLQQTQVKSKLEETEMQWLDVQEQLEILTKEFSDADI

SEQ ID NO: 6236 - protein, 323 aa, Vitis vinifera
MEEKCAIAKDVTELIGNTPMVYLNNVVDGCVAHIAAKLEMMEPCSSVKDRIGYSMINDAEEKGLITPGKTVLIEPTSGNTGIGLAFIAAAKGYKLILVMPSVVTLERKMVVLAFGAELYLTDIAKGIQGVFDKADEILQNTPNGYILNQFENPANPKIHYETTGPEIWKGTGGKVDILVAGIGTGGTVTGAGHFLKEKNPEIKVYGIEPAESAVLNGGNPGSHKIQGIGAGIIPQVLDTELLDEVIQISSDEAIETAGLLALKEGLLVGISSGAAAAAAIKLAESPENAGKLITVIFPSFGERYLSSVLFDSIRDEAENMKFD

SEQ ID NO: 6237 - protein, 221 aa, Saccharomyces cerevisiae
MRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 6238 - protein, 341 aa, Rickettsiella grylli
MPSVILVTGGTGFIGSHVCVAFANAGYNIVILDNLRNSYFEVVDRLECICKFRLKFIEGDILDSNLLDHIFFENNISAVIHLAGLKAVSESIKNPLKCYNNNVEGTLTLINAMRKSNVKKLIFSSSAAVYGEPKCVPIRENFPLSPINPYARSKLMVENILTDLHHAEPDWHIVCLRYFNPVGAHESGLIGEDPKKFTHNLMPYLTQVAIGRSKQFNIFGGNYPTVDGTAIRDYIHVMDLAEGHVAALSNYTNWKRGVLTVNLSTGKGLSVLEVLRAFTEFNQCKIAYRILDRRPGDVAECWADPTNAQRILNWKARRSLAQICKDSWRWQKANPNGYLSH

SEQ ID NO: 6239 - protein, 488 aa, Triticum aestivum
  misc_feature (200)..(200): Xaa can be any naturally occurring amino acid
  misc_feature (218)..(218): Xaa can be any naturally occurring amino acid
  misc_feature (228)..(228): Xaa can be any naturally occurring amino acid
  misc_feature (473)..(473): Xaa can be any naturally occurring amino acid
  misc_feature (480)..(480): Xaa can be any naturally occurring amino acid
MDKAYITILTIAFLFLLHYILGKVSNGRRGRGAVQLPPSPPAIPFLGHLHLLEKPFHAALLRLAARLGPVFSLRLGSRRAVVVSSAECARECFTEHDVTFANRPRFPSQLLVSFDGAALATSSYGPHWRNLRRVAAVQLLSAHRVSCMSGVIAGEVRAMARRLFRAAAASPGGDGAARVQLKRRLFELSLSVLMENIALXETKATRSDAHGHLGPVRXAQEFKRVVDXLISYLGAANTWDYLPVLRWFDVFGVRNKILAAVSRRDAFMLRLIDNERRRLDNAGTEGDKKSMMAVLLNLQKTEPEVYADTMITALCANLFGAGTETTSTTTEWAMSLLLNHPAALKKAQAEIDAAVGTSRLVTADDVPRLAYLQCIVSETLRLYPAAPMLLPHESSADCKVGGYNVPSGTMLMVNAYAIHRDPEAWERPLEFVPERFEDGKAEGRFMIPFGMGRRGCPGETLALRTIGMGLAKXVQCFQWXEPVDGAAG

SEQ ID NO: 6240 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSHNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 6241 - protein, 408 aa, Gluconobacter oxydans 621H
MTEEFHRIRRLPPYVFAEVNKAKAAARAAGDDIIDLGMGNPDSAPPAHVVQKLIETVGNPRAHGYSVSRGIPGLRKAMANYYERRFNVSLDPETEVIATLGSKEGLANLAAAITSPGDTILVPNPSYPIHQFGFIIAGASVRSIPATPDEDMLRALERAVRHSVPKPTALIVNFPSNPTAFVANLDFYKELVAFARREEIWILSDLAYAEIYFNENEPPPSLLAVPGAKDVAVEFTSMSKTYSMAGWRMGFAVGNPRLIQALTRIKSYLDYGAFTPIQVASVAALNGPQDYVSEIRAMYKDRRDVLLRGLQSAGWDVPAPAGSMFAWAPIPPAFAEMGSVAFSKLLLKEAGVAVAPGLGFGEYGEGFVRIGLVENTQRLRQATRAIKGFMSRHGAGAGTADLLGAASS

SEQ ID NO: 6242 - protein, 353 aa, Triticum aestivum
  misc_feature (208)..(208): Xaa can be any naturally occurring amino acid
  misc_feature (221)..(221): Xaa can be any naturally occurring amino acid
MSTVTPAYLDQRLAAAKRSSREAAMAGAKAAAVATVAAAIPTLASVRMLPWARAHLNPTGQALIISTVAGMAYFIVANALFSLPATEGRDGPLVRLPPPANRLPREKHLPRPKPPTKWEQFAKSKGIIKHKKNKRAWDEQTNSWKRTYGYDRVNDDRDVPIIEAKLTDEPGVDPFAQRREEKKGRVDKQEKNRLGNLKNAAKVGALPXAHIQLAATSVPIXGTKADLPRKAKKEDLENVAGMASAATASGGKFDKKLPGEKPLKKAGKNRKVPSPVVEGKGMGNLEKQQNDKILNSLLAKNFEEPLDVSKAITMYKVKKDNKRRKDKQSSSSSGSNKLKPQKKIHKKSSKKSA

SEQ ID NO: 6243 - protein, 384 aa, Picea sitchensis
MESIDRVFSRGTGQQMISSCESAATQELQLYEMMFSAVKPMALKAAVLLKIPDIIAAQGNGGPLSVEQIASHIAAANSSSTSNSHVDVGYLYRILRFLASYGVFTEQEEADQADDADTKKIKYGLTAISKLLAQSENQQSCGPFLFLMAEKVYLEAYQHLHESVLEGCYTFNKAYDMSPWEYLSHDPQANRIFNEAMTANSSTVMASVAKMYEDGFESINTLVDVGGGMGSSLSMIVKEHSHIRGINFDLPHVIATAPPITGVEHMEGNMFEHIPSADAVMMKWILHDWDDEKCVKLLRRSYEATPANGKVLIVDAVVGGGKEAESMSRRLGLLFDIAMMVYTTGGKERTEEEFKRLFQTAGFRSYRIIKLPFLQALIVLSKSE

SEQ ID NO: 6244 - protein, 466 aa, Triticum aestivum
MEPRVGNKYRLGRKLGSGSFGEIYLGTNVQTNEEVAIKLENVKTKHPQLLYESKLYRVLQGGTGISNVKWFGVEGDYNVLVMDVLGPSLEDLFSFCNRKLSLKTVLMLADQMINRVEFIHSKSFLHRDIKPDNFLMGLGKRANQVYMIDFGLAKKYRDTSTHQHIPYRENKNLTGTARYASVSTHLGIEQSRRDDMESLGYVLMYFLRGSLPWQGLKAGTKKQKYEKISERKIATSIEALCRGYPSEFQSFFHYCRALRFEDSPDYQYLKRLFRDLFIREGFQFDYVFDWTILKYQQSQMTSAPPRAIAAAAGQSSGMAPIASNNRLSATEEGRSGWSDDPTRRQVPPTGINAGSLAKQKSPVRPDVSAPKEAVLSSSTFLGRSGVSSRRPAVCSSRDLPSSEAEPSRSRAPDVSPGTFQRNSAPRRTSQTLDYSDPRHKSNSNNYESTIRGIRGLNFNANDRIHY

SEQ ID NO: 6245 - protein, 767 aa, Prunus persica
MAVLLSTLATEIVIPVAAVIGIVFSLVQWFIVSRVKVTLERHAPPAGPNSNKNGFNDYLIEEEEGLHDQNVVAKCAEIQNAISEGATSFLFTEYQYVGVFMVVFAILIFLFLGSVEGFSTKSQPCTYDAQRTCKPALATAIFSTVAFVLGGVTSILSGFLGMKIATYANARTTLEARKGVGKAFIVAFRSGAVMGFLLAANGLLVLYITINVFKVYYGDDWEGLFESITGYGLGGSAMALFGRVGGGIYTKAADVGADLVGKVERNIPEDDPRNPAVIADNVGDNVGDIAGMGSDLFGSYAESSCAALVVASISSFGINHEFTSMLYPLLISSMGILICLITTLFATDFFEIKAVKEIEPALKKQLIISTVLMTVGIAIISWIALPSSFTIYNFGVQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPTGFSAMTMKSVGSAALKMVEEVRRQFNTIPGLMEGTAKPSYATCVKISTDASIKEMIPPGALVILTPLIVGTLFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 6246 - protein, 255 aa, Anabaena variabilis ATCC 29413
MDWKEIRGNWVLVPRNPVGIIHFLGGAFVATAPHLTYRWLLEQLGNKGYVVIATPFVNTLDHIAIANSVLLNFERTIERLHDSGALRKLYLPTYGIGHSMGCKLHLLIGSLFPVERAGNILISFNNYAAKDAIPLVEQFNTTLAIEFTPSPLETNKLVQESYNIRRNLLIKFNNDNLDQSAALTKILQVRFPEMVTAQTLPGTHTTPLGQDVKWQTGSSFTPFDALGQWFKQEVYRDLNQLNRAILLWLNPLSPP

SEQ ID NO: 6247 - protein, 759 aa, Prunus persica
MGLLSEGLTQLLIPLAALVGLAFALLQWFLVSRVKVSGSYGEGNGYKDKLIGEAEEGVDSLEVTIKVAEIQNAISIGATSFLFTQYRYLSIFVGVFSAIIFLFLGSVKGFSTKSEPCTYNTGNTCKPALANALFTTIAFLLGALTSVLSGFFGMKIATYANARTTLEARRGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHDYTAMSYPLIISSMGIVVCLITTLFATDLFEIKKVNEIEPSLKRQLLISTVLMTAGIAAVTFVALPSEFTLFQFGTNKAVKNWYLFFCVAIGLWAGLVIGYTTEYHTSNAYSPVQDVADSCRTGAATNVIFGLALGYKSVIIPVFAIAFAIYVSFSLAAMYGIAVAALGMLSTISTGLAIDAYGPISDNAGGIAEMAGMSHEIRERTDALDAAGNTTAAIGKGFAIGSAALVSLALFGAYVSRAGIETVDVLTPKVFIGLLVGAMLPYWFSAMTMKSVGSAALKMVEEVRRQFNTIPGLMEGTAKPDYATCVKISTDASLKEMIPPGALVMLTPLIAGTFFGVETLAGILAGSLVSGVQIAISASNTGGAWDNAKKYIEAGASEHAKSLGPKGSDPHKAAVIGDTIGDPLKDTSGPSLNILIKLMAVESLVFAPFFAAHGGVLFKWL

SEQ ID NO: 6248 - protein, 543 aa, Arabidopsis thaliana
MAVSSAFVGCPKLETLLNHHNLSPSSSSSSSVSQTPLGLNGVRVLPKNNRTRRGLIQKARCELSASSDSASNAASISALEQLKNSAADRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDATQHIFEVSAGLDSLVLGEGQILAQVKQVVKVGQGVNGFGRNISGLFKHAITVGKRVRTETNIASGAVSVSSAAVELALMKLPQSSNVSARMCVIGAGKMGKLVIKHLMAKGCTKVVVVNRSEERVSAIREEMPGIEIIYRPLDEMLACASEADVVFTSTASETPLFLKEHVENLPQASPEVGGLRHFVDISVPRNVGSCVGEVETARVYNVDDLKEVVAANKEDRMRKAMEAQTIITEESTQFEAWRDSLETVPTIKKLRAYAERIRVAELEKCMSKMGDDINKKTTRAVDDLSRGIVNRFLHGPMQHLRCDGSDSRTLSETLENMHALNRMYGLEKDILEEKLKAMAEQQQK

SEQ ID NO: 6249 - protein, 156 aa, Salmonella enterica subsp. arizonae serovar 62:z4,z23:--
MEERVKTNYDHPNAMDHSLLFQHLQALKRGSAIELPVYSYVEHTRMQETVRVEPKKVIILEGILLLTDARLREEMNFSIFVDTPLDICLMRRIKRDVNERGRSMDSVMAQYQKTVRPMFLQFIEPSKQYADIIVPRGGKNRIAIDILKAKISQFFE

SEQ ID NO: 6250 - protein, 293 aa, Anabaena variabilis ATCC 29413
MQIHKVRKAVIPAAGFGTRLFPATKVVKKELFPIIDQDGRAKPVILAIVEEAINAGITEIGIVVQPDDIGVFADLFKNPPAPELLQKLSPHNQEYSQYLQELGQKVVLLTQSEQEGYGHAVFCAKDWVGNEPFLLMLGDHVYKSDIKKTCAQQVVEIYAQVHQSVVGLTTMPAAIINKAGCVTGLWQEFNSILELTQLAEKPSIDYAREHLRVEYMAEDEFLCVFGLYVLTPKIFDFLEESINQNLRDRGEFQLTTCLDKLCQAEGMTGYVMQGQCFDTGLPNTYRQTLIDFI

SEQ ID NO: 6251 - protein, 437 aa, Magnetococcus sp. MC-1
MTPSADLIQWDKRHCWHPFTQAQTAPDPIPMASARGATLTSVDGRTFIDLNASWWVTTHGHAHPAIAAAIAQQAQTLEQVIFAGFTHAPAVNLATRLSETLGGDLDRVFFSDDGSTAVEVALKMAAQYHINQGTPRHRFVAFRGGYHGDTVGAMSMGQGSGFFDAFQAMLFHVDLLDYPATWLGDPTPELREALVLSQLDDYLATHGPQCGALLMEPLVQGAAGMRMARAGFVQQVMERCRAAGVLVILDEVMTGFGRTGTLFAFQQCGDYPDIICLSKGLTAGFMPMSVTVVREPIYQAFMGEGFERALAHGHSFTANPLGCVAALASLELFEQEGSLARIGQIAALHQQRLEPLQKHAKAVRPRVCGSIGAIDLRVADGGYGAEIGPKLKAFFIEKGLLMRPLGNTVYLLPPYCVSDAQLHQGWDAIEEALDTLL

SEQ ID NO: 6252 - protein, 425 aa, Escherichia coli
MIIAVVGLGYVGLPLAVEFGKSNQTIGFDLSESKINSYKEHIDPTGEVSTEDLRKADKLVCTTDANSLKNADFIIIAVPTPVDESHQPDFTPLIKSSETVGKNLKRGAIVVYESTVYPGATEEICIPILERFSGLKWKEDFNVGYSPERINPGDKERTVTKIVKVVSGDTPVTLKKVRDTYEKIITAGVYCANSIKVAEAAKVIENTQRDLNIALMNELAIIFDKLSIDTLEVLEAAGTKWNFLPFRPGLVGGHCIGVDPYYLTHKADMIGYHPQVILAGRRINDSMGKYIAEQTVKKMIAANISIKGSKILVMGLTFKENCPDLRNSKVIDVIKELESYGVNIIVHDPLVSSIDAYNEYGVILHEWDQIEPCDAVILCVCHNDYINAGFDAIKSKLIPGGVFSDIKSIWTTEEVEAHGINSWRL

SEQ ID NO: 6253 - protein, 341 aa, Escherichia coli
MNSYEIIKKNLLTSKKKWLITGVAGFIGSNLLEQLLKLDQDVVGLDNFSTGHQHNLDLVKELVTPVQWSRFKFIKGDIRNLEDCRAACCEAQYILHQAALGSVPRSIKDPIGTNDNNITGFLNMLVAANEQKVKRFVYAASSSTYGTHPGLPKVEDTIGDPLSPYAVTKYVNELYAGVFSRTYGLESVGLRYFNVFGPRQDPNGAYAAVIPKWVASILNNEVIYINGDGSTSRDFCYIDNAVQANLLAATTLQPDAVNTIYNVAVGQQTSLNELYKYIVDELVRYGVEINSNNLKYRDFREGDVKHSLANISKIKNKLGYEPLFTLKDGLVPSIQWYYSNH

SEQ ID NO: 6254 - protein, 126 aa, Nicotiana tabacum
MAANDATSSEEGQVFGCHKVEEWNEYFKKGVETKKLVVVDFTASWCGPCRFIAPILADIAKKMPHVIFLKVDVDELKTVSAEWSVEAMPTFVFIKDGKEVDRVVGAKKEELQQTIVKHAAPATVTA

SEQ ID NO: 6255 - protein, 315 aa, Mycobacterium sp. MCS
MPRIAYLGPQGTFTESALLQMISGAMVPGGDADDTAVTPVPTDSTPAGLEAVRSGAADYACVPIENSIEGSVLPTLDSLAVGAPLQIFAELTLAVSFSIVVRPDHDGDVGTVAAFPVAAAQVRRWLAEHLPAAQLVPAHSNAAAAADVAGGRADAGISTALAAERYGLRSLAAGVVDEPNARTRFVLVGRPAPPPARTGADRTSVALRLPNTPGALVAAMTELSIRDIDLTRIESRPTRTELGTYVFFLDCVGHLEDDAVAEALKALHRRCEDVRYLGSWPTGTAAGAPPPSSDEATRWLTRLREGLPTPPEGGR

SEQ ID NO: 6256 - protein, 847 aa, Oryza sativa Indica Group
MAIHQLSFVLLLMLLAPATSRARDSIAPGEPLAGHDTLVSAGAGDGGGFALGFFTPPGSNDTYVGVWYARVSPRTVVWVANRADPVPGPVDGNAGATLSVSRACELAVADANSTVVWSVTPATTGPCTARIRDDGNLVVTDERGRVAWQGFDHPTDTLLPGMRIGVDFAAGNNMTLTAWKSPSDPSPSSVVVAMDTSGDPEVFLWNGPNKVWRSGPWDGMQFTGVPDTITYKNFSFSFVNSAREVTYSFQVPDASIMSRLVLNSSGGGLVQRWTWVEAAGAWNLYWYAPKDQCDAVSPCGANGVCDTNSLPVCSCLRGFAPRSPAAWALRDGRDGCARETPLGCANGTDGFAVVRHAKAPDTTAATVDYDAGLQLCRRRCLGNCSCTAYANANLSAPPGRRGCVMWTGELEDLRVYPAFGQDLYVRLAAADLDSTSKSKKKTHIIIAVVVSICALAIILALTGMYIWRTKKTKARRQGPSNWSGGLHSRELHSEGNSHGDDLDLPLFDLETIASATNGFSADNKLGEGGFGPVYKGTLEDGQEIAVKTLSKTSVQGLDEFRNEVMLIAKLQHRNLVQLIGYSVCGQEKMLLYEFMENKSLDCFLFGTNRNLPMFSDKSKSKLLDWQTRYHIIEGIARGLLYLHQDSRYRIIHRDLKTSNILLDKEMTPKISDFGMARMFGSDDTEINTVRVVGTYGYMAPEYAMDGVFSVKSDVFSFGVIVLEIISGKRNRGVYSYSSHLNLLARAWSSWSEGNSLDLVDKTLNGSFNQEEVLKCLKVGLLCVQENPDDRPLMSQVLLMLASADATSLPDPRKPGFVARRAATEDTSSSRPDCSFVDSMTITMIEGR

SEQ ID NO: 6257 - protein, 403 aa, Neisseria meningitidis Z2491
MIIDVKVPMLSESVSEGTLLEWKKKVGEAVARDEILIDIETDKVVLEVPSPQAGVLVEIVAQDGETVVADQVLARIDTAATAAAEAPAAATAAAEAPAAAPAEAAPAAAPAAAQNNAAMPAAAKLAAESGVDVNALQGSGRDGRVLKEDVQNAAAKPAAAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 6258 - protein, 302 aa, Corynebacterium efficiens
MLAEALPWLQHFRDKIVVVKYGGNAMVDDSLKAAFAADMVFLRTVGAKPVVVHGGGPQISDMLRRVGLEGEFKGGFRVTTPEVMEIVRMVLFGQVGRDLVGLINSHGPYAVGTSGEDAGLFTAEKRLVDIDGTPTDIGLVGNIVNVDATSLMDLIDAGRIPVVSTIAPGADGQVYNINADTAAGALASAIGAERLLVLTNVEGLYTDWPNKSSLVSKIVASELDAILPGLDAGMIPKMESCLNAVRGGVNAAHVIDGRIAHSVLLELLTMGGIGTMVLPDNYAREDYPEGTVFRKNYQDGHA

SEQ ID NO: 6259 - protein, 477 aa, Neisseria meningitidis Z2491
MSQYDVVVIGAGPGGYVAAIRAAQLGFKTACVDAGVNKAGNAPALGGTCLNVGCIPSKALLQSSEHFHAAQHEFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELLTEGVTALEFFASSEDIARIIHAHPTLSEVVHEAALAADKRALHG

SEQ ID NO: 6260 - protein, 539 aa, Clostridium perfringens ATCC 13124
MKKGIAASKGYAIGTVFIQEHEEIIISDAKVSDIAAEKEKLSKALAQSKEQLEAIKEKTANEIGEHEAQVFEAHLMLLDDVEFTGQMEMTIENDQLNAMKAVQNVTDTFVMIFDSMDDPYMRERAADIKDVSKRIIANLAGKGGNGMENVGANTVVVAHDLTPSDTAQLDRSKVIGFLTNIGGRTSHSAIMARTLEIPAVVGLGNITTSVKNGDTVIVDGIEGVAIINPDEATINEYKARLEKFKAEQEELKKLIDVKTTTKSGRRIEVCGNIGKPEDIDQVLANGGDGVGLFRTEFLYMDRDEAPTEDEQFEAYKYVLEKADGKQVVIRTLDIGGDKTLPYLPLPEEMNPFLGYRAIRLCLDRKDIFRVQIRALLRASVYGNLAVMFPMISGLEEFQQAKAFVEECKAELKAEGIAYSDSIQWGIMVEIPAAAVYADELAKHVDFFSIGTNDLIQYTLAADRMSEKVSYLYNPMHPAVLRLIKMTIDGAHKHGKWVGMCGEMAGDERAIPTLVEYGLDEFSMSATSILTAKKIIMEQE

SEQ ID NO: 6261 - protein, 388 aa, Neisseria meningitidis Z2491
MNLHEYQAKELLASYGLPVQGGILAHNGEEAAAAYDKLGGKFAVVKAQVHAGGRGKAGGVKVVKSREEAKEVAESLIGTNLVTYQTDANGQPVNSVLVCEDMYPVQTELYLGAVVDRSTRRVTFMASTEGGVEIEKVAAETPEKIFKVTVDPLVGLQPCQAREVAFQLGLKDKQINEFVKLMTGAYKAFVENDFALFEVNPLAVRENGALACVDGKIGIDSNALYRLPKIAELRDKSQENERELKASEFDLNYVALEGNIGCMVNGAGLAMATMDIIKLKGGQPANFLDVGGGATKDRVVEAFKLILEDKSVKGVLINIFGGIVRCDMIAEAIVAAVKEINVDVPVVVRLEGNNAELGAKILNESGLKLTSADGLNDAAEKIVAAVNA

SEQ ID NO: 6262 - protein, 133 aa, Vitis vinifera
  misc_feature (22)..(22): Xaa can be any naturally occurring amino acid
MMSRSLGIPVKLLHEAAGHVVXVELKSGELYRGSMIECKDNWNCQLENITFTVKDGKVSQLEHVFIRGIKVRFMVIPDMRKNAPMFKRLDARVKGKGSALGVGRGRAVAMRARAQAAGRGAPPGRGVAPPGRS

SEQ ID NO: 6263 - protein, 302 aa, Burkholderia pseudomallei K96243
MSAGFPQFVSAGDILTDMVRTGGAHWTSRPGGAGWNVARAVARLGAPSACAGAVGRDCFSDELWRESEAAGLDLRFLQRVERAPLLAIVHETQPPAYFFIGENSADLAFDPQRLPDGWREHVKWAHFGCISLVREPLASTLVALAAELREAGVKISFDPNYRNLMTDSYRPTLARMAELADLIKVSDEDLRHLFAGDDEASAIARLRALNPRAALLVTRGPDTATLYAGGETIDARPPRIEVADTVGAGDATIGGLLFSLMTVPARGWRAHLSFALAAGAAACRHTGAHAPTLDEVVALVAA

SEQ ID NO: 6264 - protein, 180 aa, Glycine max
MADKDEELAMPRDAKIVKSLMKSMGVEDYEPRVVHKFLDLWYRYIVDVLTDAQVYSEHADKSEIDCDDIKLAIQSKLNFSFSQPPPREVLLELAHNRNKIPLPKTIAGPVIPLPPDQDTLISPNYMFAIPNQRPAEPPIEETEDEEDTNTIPNPSQEEQIVMQQNSPQRVSFPLPKRQND

SEQ ID NO: 6265 - protein, 323 aa, Vitis vinifera
MEDKSAIAKDITELIGKTPMVYLNKIVDGCVARIAAKLEMMEPCSSVKDRIGYSMIKDAEDKGLITPGKTVLIEPTSGNTGIGLAFIAAVKGYKLVIVMPASFSLERRIILRAFGAELIITDPAKGFKEQLRRIEELLKKIPNGYVLQQFENPANPRIHYETTGPEIWEGSGGKVDALVSGIGTGGTASGAGKFLKEKNPEIKVYGVEPVESAVLSGGEHAPHKIQGIGAGFIPAVLNVSILDEVIQISSDEAIDTARALALKEGLLVGISSGAAAAAAIKIAKRAENAGKLIVVVFPSFGERYLSTALFDSLRHEAENMVFE

SEQ ID NO: 6266 - protein, 594 aa, Oryza sativa
NYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRP

SEQ ID NO: 6267 - protein, 323 aa, Vitis vinifera
MEDKCAIANDVTELIGNTPLVYLNNIADGCVARIAAKLEIMEPCSSVKDRIGYSMINDAEEKGLITPGQTVLIEATSGNTGIGLAFIAAAKGYKLILVMPSIVNLERKIVVRAFGAELYLTDIAKGIKGVFDKADEILKNTPNGYLLNQFENPANPKIHYETTGPEIWKGTGGKVDALVSGIGTGGTATGAGHFLKEKNPKIKVYGVEPCESAVLNGGTPGPHKILGIGTGIIPKVLDVKLLDEVVQISSDEAFETAKLLALKEGLLVGMSSGAAAAAAIKVAKRPENAGKLITVIFPSFGERYLSSMLFESIKKEAENMKFD

SEQ ID NO: 6268 - protein, 503 aa, Agrobacterium tumefaciens str. C58
MTTFSDLGLSQKVLSAIADAGYTTPTPIQAGAIPPALEKRDICGIAQTGTGKTASFVLPMLTLLEKGRARARMPRTLILEPTRELAAQVAENFEKYGKNHKLNVALLIGGVSFEDQDRKLERGADVLICTPGRLLDHCERGKLLMTGVEILVIDEADRMLDMGFIPDIERIAKMIPFTRQTLFFSATMPPEIQKLADRFLQNPTRIEVAKPSSTAKTVTQRIVAAHNKDYEKRAVLRDLVRAEEAELKNAIIFCNRKKDVADLFRSLDRHGFSVGALHGDMDQRSRTTMLQNFRDGQLTLLVASDVAARGLDIPDVSHVFNFDVPIHAEDYVHRIGRTGRAGRSGKAFTLVTKSDAKYLDAIEKLIAEKIEWLSGDLSSLPAPMESFESNSGRRGTKERSGRGRDRNRRDAPASPVENINQDAQSVVDTDIAAHGEDKVKAERRPEKTPRNSERNSRNLNSLHANDDNRDRRRHYRDHDDGPTPVGFGDDIPAFMLIVANAKA

SEQ ID NO: 6269 - protein, 375 aa, Pisum sativum
MGVITAHCYCFTTVGSHKPYLSPSSHNFRHSPSVSLSSSSSSSPSPLRRISCQASSAPAAESTLTAKVGNGLKDFIHIDDFDKETILKILDRAIEVKTLLKSGDRTFRPFEGKTMSMIFAKPSMRTRVSFETGFSLLGGHAIYLGPNDIQMGKREETRDVARVLSRYNDIIMARVFSHQDILDLAKYASVPVINGLTDYNHPVQIMADALTMIEHIGRFEGTKVVYVGDGNNIVHSWLLLAAVVPFHFVCACPKGFEPDAKTVEKARKAGISKIEISHDPKEAVRGADVVYSDVWASMGQKEEAAYRREAFKGFQVDQNLMDAAGSKAFFMHCLPAERGVEVTDEVVEAPYSIVFPQAENRMHAQNAIMLHVLGK

SEQ ID NO: 6270 - protein, 348 aa, Zea mays
MEALRKQASKFKEQVAKQQQAVIKQFSTTGYERSDSIVIDEVELQRHQQLEKLYTSTRSVRDFQKDIVRAAEGLVSIGNKHIEVGTKFSEDCYRYGSENNASDEALRKAASLYGGALRNIEKEYEDFNRILSSQTIDPLRAMAMGGPLEDARGLAQRYSRMRHEAEILSTEIARRKARVREAPIAEHTTKLQQSEARMIEHKASMAVLGKEAAAALAAVESQQQRVTLQRLVGAAEAEKLFHLRLAAILDDVEAEMSSEKQRRESAPPIISSHKRAEKAQYFLAEVMHNFNGTTEKELSLIVGDYVVVRQIAPNGWAEGECRGKAGWFPAAYVERRENIPPNKVFPQV

SEQ ID NO: 6271 - protein, 425 aa, Aegilops tauschii
MKPIVVHAASVDRRWLLPLAVGSALSLFLLVLLTTVPLPFFPSSSPSPALFVEHKLAPTPPASRAAGSLPRIAYVISGSARDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRRAGPDAPTPGGWCAGTRDNGSDPCSVVGNTSFLQPGRGAVRLQRLVTSLLSEEKFHPRQCK

SEQ ID NO: 6272 - protein, 252 aa, Brassica napus
  misc_feature (190)..(190): Xaa can be any naturally occurring amino acid
  misc_feature (213)..(213): Xaa can be any naturally occurring amino acid
  misc_feature (227)..(227): Xaa can be any naturally occurring amino acid
  misc_feature (243)..(243): Xaa can be any naturally occurring amino acid
ATSGIVEEQVLVRKIIDLHDKYMAYVTDCFQNHTLFHKALKEAFEIFCNKKVAGSSSAEMLATFCDNLFKKAANDKSNDDSTIESTIDNVVKLLDYISDKDLFAEFYRKKLARRLLFGRFSDDHERSILTKLKGQFGGQFTSKMEGMVTDMQLGKDQQTGFEEYLKNTNTGKPKGVDFTVTVLTTGFWPXSYKTSDLNLPLEMVNCIESFKGXYEIKTKHRRLMWIXSGKCNLTGRFDAKPIXELIVSTYQA

SEQ ID NO: 6273 - protein, 337 aa, Nostoc sp. PCC 7120
MIRVAINGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDANLTLVMGNDLVKVMAWYDNEWGYSQRVLDLAELVAEKWV

SEQ ID NO: 6274 - protein, 702 aa, Oryza sativa Japonica Group
MAQHTAAAAGGDEEVAEAEAAAAAAAGSTLRHRHAGKGAEEHEAAGGGGGGAMAAPTTRTRRPWSGVIVMKLNLTTGIIPSLNVSAGLLGFFFVRLWTSAVERIGLLKQPFTRQENTVIQTCVVSAYGIAFSGKRLRRFRLYSDFYCTTFVGLGLLVAASVLKENQNVIMYEQKFVPIDIFLYLFIPNSNDQIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTIAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 6275 - protein, 375 aa, Trametes hirsuta
MALSTKVPHLMTLADLTPGQIQRIITHSYHLKRTAQPWLAPQGRAGSGGKYSNAPHKLRMPSQSLFSKSIALLFSKRSTRTRLSAETAALLLGGQALFLGREDIQLGVNETVPDSARVIGGMCQGIFARVGDHSEIEELARYSPVPVLNALSSLWHPTQVLADILTLHEHAALFDPASASPTPSAADAFSQKYTKLGEVRPLTVAYVGDSANVLHDMLVTYPRLGHQLRVASPENDKYRAPKAVWDRVVELGCDKNIFWTADPRAAVKGADLVVTDTWISMGQEAEKAQRLKDFAGYQVTEALCREGGANPDWKFMHCLPRKQDEVDDEVFYGPRSLVFQESDNRKWTIMALFDLLFGKWSLLARNGEGADAGSE

SEQ ID NO: 6276 - protein, 577 aa, Saccharomyces cerevisiae
MADITDKTAEQLENLNIQDDQKQAATGSESQSVENSSASLYVGDLEPSVSEAHLYDIFSPIGSVSSIRVCRDAITKTSLGYAYVNFNDHEAGRKAIEQLNYTPIKGRLCRIMWSQRDPSLRKKGSGNIFIKNLHPDIDNKALYDTFSVFGDILSSKIATDENGKSKGFGFVHFEEEGAAKEAIDALNGMLLNGQEIYVAPHLSRKERDSQLEETKAHYTNLYVKNINSETTDEQFQELFAKFGPIVSASLEKDADGKLKGFGFVNYEKHEDAVKAVEALNDSELNGEKLYVGRAQKKNERMHVLKKQYEAYRLEKMAKYQGVNLFVKNLDDSVDDEKLEEEFAPYGTITSAKVMRTENGKSKGFGFVCFSTPEEATKAITEKNQQIVAGKPLYVAIAQRKDVRRSQLAQQIQARNQMRYQQATAARAAAAAGMPGQFMPPMFYGVMPPRGVPFNGPNPQQMNPMGGMPKNGMPPQFRNGPVYGVPPQGGFPRNANDNNQFYQQKQRQALGEQLYKKVSAKTSNEEAAGKITGMILDLPPQEVFPLLESDELFEQHYKEASAAYESFKKEQEQQTEQA

SEQ ID NO: 6277 - protein, 324 aa, Arabidopsis thaliana
MAKDGPNWDGLLKWSLSHSDGTRPTCQLSEEDRKWFAEAMQSQTVDVVKRLKEITQVLQTPQQVLEAHEVTPQDIEGLLDELQEHVESIDMANDLHSVGGLVPLLGYLKNSNANIRAKSADVVSTIVENNPRSQESVMEANGLESLLLRFTSDTDMHSRTQALGAISSLIRNNKPGITGFRIANGYSGLKDALETDSVRFQRKALNLLHYLLQENDSDSDIAIEFGLHHLMMHLVSSFDADVREAALRGLLELVKARKDCSTCGSSIVKGDERLRQILKDRIKAISRVKAMSLFMSQEDLSAAKEERQLLDSLWTTIFNEPSSL

SEQ ID NO: 6278 - protein, 427 aa, Anabaena variabilis ATCC 29413
MSLQTLIEQATNPPESGSAASSPFSTDSFDASVMSTYGRFPLALERGAGCRVWDTQGREYLDFVAGIATCTLGHAHPAMVEAVTRQIQKLHHVSNLYYIPEQGELAQWIIQHSCADRVFFCNSGAEANEAAIKLARKYAHTVLDIEKPIILTANASFHGRTLATITATGQAKYQKYFDPLVPGFHYVNYNDISAVEAAISELDEGDYRVAAILIEPLQGEGGVRPGDVEYFQKLRQICDDTGILLMFDEVQVGMGRSGKLWGYEYLGVEPDIFTSAKGLGGGIPIGAMMSKKFCDVFQPGEHASTFGGNPFACGVALAVCQTLERENILQNVEDRGEQLRAGLRALAAKYPHHLTEVRGWGLINGLELAADIQLTAADVVKAAINEGLLLVPAGPKVVRFVPPLIVTEAEINTALKLLEKALATVTA

SEQ ID NO: 6279 - protein, 268 aa, Glycine max
MAVDLCSENCVAASSSSSSVSPRISFSHDFSQSDVIPVEQLPFRSNSSGLNPTIDFDFCVSESFELESSSADELFSHGRILPTEVKRKNNAVPPMKQLAPKSTSPLPPPYAAPNGVSTSKNLKKEINPKESKCLNDEVYEKQSSKSSFWIFKRSSSCGSGPRRSFCPLPLLSRSNSTGSSTPSVKRSHPLSKEGTVNNNIKQKHSSTRLMPNGYLHHHHHQKPPLNYKSTHHGSYGNSVRVNPVLNVPPANLFGLASIFSNNRDKSKK

SEQ ID NO: 6280 - protein, 305 aa, Mesorhizobium sp. BNC1
MEEMTIPTFESLLALNAQSVEDLLRHLLDERVREGEILRPSHLLAAMRHGVLNGGKRLRPFLVLESAALFEAQGMASLRVAAALECVHCYSLIHDDLPAMDDDDLRRGQPTVHRAFDEATAILAGDSLLTYAFDIIADAETDLRPEIRADLVVKLATAAGMGGMAGGQALDLLAEKVPPDEVGIVQLQAMKTGALFRFACEAGAIVADASSADRERMSSFGAAIGLAFQLADDLLDLTASADAVGKATGKDAAAGKATLAALHGEEWVRAQLVGLVAQAEGLLEPYGERAAVLRHAARFVAQRNR

SEQ ID NO: 6281 - protein, 340 aa, Picea sitchensis
MDGSGPSTSVAAAAAPRTASRRPKSSKFTQQDIPACRPVLTPAWVISAFMLIGVIFIPIGVFCLLASQSVVEIVDRYETECIPEEYWSNKLAYIQSVSASKNCTRTLRVPKHMKAPIYVYYQLDNFYQNHRRYVKSRSDKEFQQGLKTKDKYRKDCVPEGYSNGLRIVPCGLIAWSLFNDTYKFSFELVELNVNKKNISWKSDREHKFGKDIYPYNFQNGTLIGGARLDPLIPLSKQEDLIVWMRTAALPTFRKLYGRIEVDLQANDFITVEIQNNYNVYSFGGKKSLVLSTTSWLGGKNDFMGKIYIVVGALCIFLAMVFFILHIKFRHPRHLYFSSNR

SEQ ID NO: 6282 - protein, 349 aa, Physcomitrella patens subsp. patens
MRSQRRTVTYMPRPGDGSPRAVTLLPGDGIGPLVTGAVVQVMKAMHAPVYFEEYEVSGKMDKVPTEVMDSIRRNKVCLKGGLATPVGGGVSSLNVQLRKELDLFASLVHCFNLPGLKTRHDNVNIVVIRENTEGEYSGLEHEVVPGVVESLKVITKFCSERIAKYAFEYAYLNNRKTVTAVHKANIMKLADGLFLESCREVAKNYPGIKYNEVIVDNCCMQLVSKPQQFDVMVTPNLYGTLVANTAAGIAGGTGVMPGGNVGADHAIFEQGASAGNVGNERLVAGKTANPTALLLSSAMMLRHLQFPSFADRLEQAMMAVIAEGTYRTKDLGGTSTTQDVVDAVIDKLQ

SEQ ID NO: 6283 - protein, 132 aa, Vitis vinifera
MALGSGAKETILHGSASRVVEPAASLTRVLPSPPLKKSSTTLLMFKLYRSMVGPDGWCIHYEKSTRTCSIYSDRPYFCRVEPNVFQTLYGIGKKRFNKEACSSVKIPSRQFMALIHKSWIILFMQYGAQILV

SEQ ID NO: 6284 - protein, 472 aa, Gluconobacter oxydans 621H
MAHRQHQISTPDATQARRVSSRLPASLMASVASGLLLGACSWIPGSHLVGISETSAPAGGSIGTVVADEPQAALVGHDVLARGGNAADAATATALALGVTLPSRASFGGGGACLVSRPGEVAQSITFQTRAGTSKGADRPAATPADFRGLYLMQLHYGTVDFNDLIAPALNLASTGITVSRTLAADLAAVRPALLADDGARAIFGRGDASTLVAGDSLAQPRLAGFLERIRVAGVGDLYNGALADVYVTAAQKAGGGLNDDDMRQTLPLQTEALTTRQGGVDASFLAPPADGGLGAAVRYTTGVSAQGTVAAWRASGNTSLAAAQAALNSGRSGGGSLPALPASTSFVVTDHSGMAVACVLSDNNLFGTGRIAGSTGVVLGASPARTPQPLLSAAVLRDQRNLRAVIAASGQNEAADAVGDAARAATHETPIPHEGAGRINAILCHGNDSCRGSTDPRAAGLAAGTTNDSRN

SEQ ID NO: 6285 - protein, 179 aa, Glycine max
MASSKIIFIFLLFLAHLHQHTFVKGDSSLIKRTCKNTKYYNLCFSSLKSDPSSPNADPKGLAVIMIGIGMTNATSTSSYLSSKLLSPSNNTTLKRVLKECADKYSYAGDALQDSVQDLANEAYDYAYMHITAAKDYPNACHNAFKRYPGLAYPRDLASREDGLKHICDVAMGIIDNLDW

SEQ ID NO: 6286 - protein, 405 aa, Magnetococcus sp. MC-1
MNPEMARLNPYPFEKLAVLFEGITPNGALSPLNISIGEPKHPTPAFVTQRMMEALQDGDMAKYPTTRGERALRESMAAWLTRRFELQAGSVDPDRHVLSANGTREAIFSVALAVVDRAKGGVVLTPNPFYQIYEGACFMAGVEPVHIDATEETHLRPPFTQLDAELLARTQMVYLCSPSNPTGAVHPLEELQELIRLADTYDFVICADECYSEIWYDAPPPGLLQACAAMGRHDFARCLVFHSLSKRSNMPGARTGFIAGDAQLLDHYFKLRTYTGCATPPFIQKAAIAAWDDEQHVEENRRAYRAKLEESMAILSPVLPVTRPEASFYLWLKVPGGGALFARTLYEKYNVVVLPGGYLGRQGAHGNPADGYIRIALVATLEQNREAMHRIAQCAQEMIGQSQAV

SEQ ID NO: 6287 - protein, 146 aa, Salmonella enterica subsp. arizonae serovar 62:z4,z23:--
MVLAYRIAHFCSVWRKKNVLNNLWAAPVLVLYRVITECLFGYEIQAAATIGRRFTIHHGYAVVINKHVIAGDDFTIRHGVTIGNRGTNSLACPVIGDGVELGANVILLGDITIGNHVTVGAGSVVLDSIPDHALVVGEKARVKVST

SEQ ID NO: 6288 - protein, 945 aa, Echinochloa frumentacea
MAASVSRAVCGLQGSCLNGRRSRDAPSGRRSVAAPRVWPSKAGVLLLGSGSGRSQHCAPANATADAVPIATKKRVFLFGKGKSEGNRGMKELLGGKGANLAEMSSIGLSVPPGFTVSTEACEQYQAAGCTLPQGLWDEVLDGLACVEEYMGAGLGEPQRPLLLSVRSGAAVSMPGMMDTVLNLGLNDEVAAGPAAKSGDRFAYDSYRRFLDMFGNVVLDIPHALFEEKLEHMKEAKGLKDDTDLTASDLKELVEQYKDVYVEAKGEPFPSDPKKQLELSVLAVFNSWDSPRAKKYRSINQITGLRGTAVNVQCMVFGNMGNTSGTGVLFTRNPSTGQKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHPQFENPSAYKDQVIATGLPASPGAAVGQIVFTAEDAEAWHAQGKAAILVRTETSPEDVGGMHAAAGILTARGGMTSHAAVVARGWGKCCVSGCASVRVNDAEKVVAIGDKVLQEGDWLSLNGSTGEVVLGKQPLSPPALSGDLGIFMSWVDEVRKLKVLANADTPEDALAARNNGAEGIGLCRTEHMFFASDERIKAVRQMIMAPTLELRQKALDRLLPYQRSDFEGIFRAMDGLPVTIRLLDPPLHEFLPEGNVDEIVRELCAETGSNEEEALARIEKLSEVNPMLGFRGCRLGISYPELTEMQARAIFEAAITMTKPGCSSFSRDNVPLVGTPQELGHQVAVIREIANTVFTAMGKTISYKIGTMIEIPRAALVADEIAEQAEFFSFGTNDLAQMTFGYSRDDVGKFLPIYLSQGILQHDPFEVLDQRGVGELVKFATERGRKTRPNLEVGICGEHGGEPLSVAFFAKTGLDYVSCSPFRVPIARLAAAQVLV

SEQ ID NO: 6289 - protein, 302 aa, Arabidopsis thaliana
MSQTSYYRSPFGDTTYTKVFVGGLAWETPTDEMRRYFEQFGEILEAVIITDKNTGKSKGYGFVTFRESDSATRAVADPNPVIDGRKANCNIASFGRPRPSPPRGRGQTGSPSQYQSGGPSTYTGMAAPLPPAAAPQLMYPSYGYTYNPDQFGYHQTSTMMMMMMIIYLPQALYNTQLQQAQYYQQQQQLYGGGATSPSSSGATIMPSPYYYGYSLQAPRVPYQHHHHLPQPYNPQQHHHQRFSSPSFLVYPSNSSFAPPLQGVLSSSTESEAVPQQVPAAEGEATTTAPEITTSNTKEPISS

SEQ ID NO: 6290 - protein, 307 aa, Anabaena variabilis ATCC 29413
MTKQLVLMDHDGGVDDYLATMLLLTMEHIQLLGVVVTPADCYVQPAVSATRKIIDLMGFSHIPVAESTVRGINPFPRLYRRDSFIVDHLPILNQNELIHTPLVEETGQDFMIRVLREALEPVTLMVTGPLTTVAVALDKAPDIEAKIDKIVWMGGALNVPGNVEKSLEAGQDGSAEWNVYWDAVSAVRVWQSEINIIMCPLDLTNNVPVTSELVYKVGRQRHYPVSDLAGQCYALVIPQDYYFWDVLATAYLGQPEFYQLREWETEIITSGLSQGRTKVVAGGRRILAMDKVDKDAFYAYILQQWAR

SEQ ID NO: 6291 - protein, 250 aa, Nicotiana tabacum
MVLIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGFQGVVMEIIITFALVYTVYATAADPKKGSLGTIAPIAIGFIVGANILAAGPFSGGSMNPARSFGPAVVAGDFSQNWIYWAGPLIGGGLAGFIYGDVFIGCHTPLPTSEDYA

SEQ ID NO: 6292 - protein, 572 aa, Gibberella zeae PH-1
MHSIALYSLLCLALALCSNALPGPVARIQRKGPCSGNTPSTRNQWCGYDIHSDYYSVIPDTGVTREYWLEISEIVFTPDGIPRFAQAINGTVPGPTIFADWGDNVVVHLTSNLKTSTNGSSFHFHGTHQNYTNPQDGVVAITQCPTAPGSSITYRWRATQYGTSWYHSHFGLQTYDGVYGGLIIRGPASANYDEDVGTIMLSDWSHRTVNEILPEVQRKGPYPMDNILINGTNTYNKEGEKNQTGERFRLDFEEGKTYRLRLVNTGIDTLYKFSIDHHTLKVIAVDFVSIEPYETDHVNIAIGERMDILVTANQASKTSSFWLRALPQLDCTKNANPQNALGIVSYSSNSSTPTTKGRKYVDHCEDEPYESIVPIVPHTVGPPDMEVVENANRSWNSDGIIKWSLNSTTMIAEWDHPSLLKLGHNVSFTESNAVIHVPKKDAWVYLAIETELDISHPIHLHGFDYHILAQGVGPYGSNVTLKTDNPPRRDTALLPAKGHLVIAFLTNNPGVWLLHCHIGWHAAEGFSMQFVVREEEIPDLVSDQEYEDMEKGCKAWHDFSHKMEMEQDDSGI

SEQ ID NO: 6293 - protein, 341 aa, Streptococcus suis 89/1591
MTKQIGIARAHTNIALIKYWGKRDKELFLPMNSSLSLTLDAFYTDTKVVFDPELTADEFYLNGMLQKEKEILKISRFLDLFCEYIGERAFARVESLNFVPTAAGLASSASAFAALALATATALDLDLSPATLSTLARRGSGSSTRSLFGGFVEWDMGTGSEDSMAHPIDDADWDIGMVVLAVNTGPKKIASREGMDHTVATSPFYSAWVDTAKQDLADIKAAIAGRDFEKLGQITEHNGMKMHATTLSANPPFTYWSADSLVAQEAVRQVREATGLSAYMTMDAGPNVKVLCRASQMDELVAELAKVFPREKIITSKPGPAAYVLSEDEWQTSQAAFEKGL

SEQ ID NO: 6294 - protein, 390 aa, Streptococcus suis 89/1591
MNTEQLKQAFLDVFGQEADATFFSPGRINLIGEHTDYNGGHVFPAAITLGTYGAARKRDDQLLRFYSANFEELGIIEVDLNNLVFDKADNWTNYAKGVLKFLQEAGHAIDTGMEVFVYGNIPNGSGLSSSASLELLIGIIAEELYGLELTRLDLVKIGKQTENHFIGVNSGIMDQFAIGMGADNRAIYLDTNTLEYDLVPLDLGDHVIVIMNTNKRRELADSKYNERRAECEKAVEELNAVLNIQTLGELDEWTFDQYSYLIKDENRIKRARHAVLENQRTLQARKALEEGDLATFGRLVNASHVSLEHDYEVTGLELDTLAHTAWEQEGVLGARMTGAGFGGCGIAIVHKDKVEAFTENVGKTYTEVVGYEPSFYVAEIAGGSRVLSRK

SEQ ID NO: 6295 - protein, 511 aa, Ipomoea batatas
MMEAVTIKVPYRNLKQEVELVGADELHQRRLQIDSQSSPPRVSNGDSTDSSHHQSPVQSSLLTLILSCTVAAGVQFGWALQLSLLTPYIQVQPCVGIWSDKCSSKYGRRRPFILIGSLMISISGPARALLADLSGPDQRNTANAVFCSWMAVGNILGFSAGASGNWHRWFPFLMSRACCEPCGNLKAAFLIAVVILALCTLVTLHFAKEVPLTPNLSPRLADSSPLLDSPNPDFELAQAKDDMQPINFVSDNKSENGYMDNNPIHEDQKGVNDQADSFNDSPAAVLVNLLTSLRHLPPAMHSVLIVMALTWLSWFPFFLFDTDWMGREVYHGDPNGDVSEVKAYNQGVREGTTVISFVSLNESSEGVQHVIGASKATKVASLVVFALLGIPLAITYSVPFSVTAELTADAGGGQDDYLTWCGSMGRLIWRREHTSICPGLYIRTRGWYHRNTQTAKSLEKLIQINRLPFLITRDSAHTTDERRKLAIHNARQDCDGSVGTHNELPYKRVNL

SEQ ID NO: 6296 - protein, 340 aa, delta proteobacterium MLMS-1
MAGGLTVLGAGSWGTALAGVLAGKGLPVYLCCRDPQHAARMAAERENSAYLPGFKLAPGIQPTTDLGVVAACRAVVMAVPSHGFRSVFKRVIPHLAPDTAIISATKGIENDSLLTMTAVMAEELAAADPSPACHLGCLAGPSFAREVAEGLPTAVTVAAASREEALFFQELFFTQRFRVYIGTDLIGQELGGALKNIIAIAAGISDGLGYGTNSRAALITRGLAEITRLGVAMGANPLTFSGLAGLGDLVLTCTGDLSRNRSVGLKLGQGMSLAEILAEMRMVAEGVKTTRSARALAHRQGVEMPILEEVYLVLYEDKPCRQAVYDLLAREGKEELEFGG

SEQ ID NO: 6297 - protein, 368 aa, Xylella fastidiosa Temecula1
MSKRDYYQVLGVPRTASEDDLKKAYRRCAMKYHPDRNPGDAAAEAAFKECKEAYEVLADTKKRKLYDTHGHAAFEHGVGSGNTPDMNDIFGDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 6298 - protein, 225 aa, Agrobacterium tumefaciens str. C58
MSLPIRIAPSILAANFAKLGQEVADVTEAGADWIHLDVMDGHFVPNISFGPDVIKALRPHSMAFFDCHLMIEPVDPYLEAFAKAGCDSITVHAEAGPHLHRSLQTIRGLGRKAGVTLNPATPLSVIENVLDDVDLILIMSVNPGFGGQKFIPAMLDKIRAAKAMIGDRPIDLEVDGGVTAETAGAIIAAGANALVAGSAVFKGDGVADYRKTVAQLRMAAEAGRT

SEQ ID NO: 6299 - protein, 431 aa, marine gamma proteobacterium HTCC2143
MRIAVIGAGAAGLVTARELSRGGHDVSVFEQSDRVGGVWIFEPIPEDDAMGLKPSKAVFSSIYDSLRTNLPRDLMAFQDYTFDSMGGGEDEWQRYPHHSKVLTYLENFAESFDITSMIRFQRTVSRVEKLDADWVVTSEHVQSGEIERQRFDGVAVCSGHYSKPRVPVIAGVDTFSGRLMHSHNYRSPAEFANKRVVLLGTAASGVDIAREIATVSDQVYWCGNTFSQVSYDEQSGLHRYPTPLAFDGAAIRFQNAPALENVDYFIYCTGYQYQYPFLQTNLVNVVDNWVSPLYRDIVAPTDTTLAFIGLPFQVIPFPLFEYQAKWWVNMLSGTKSLPSVKAMMMEISGKIAAQNEAGIKTHHRHKLAEKQFDYFDSLAADCGEPPVADWIKALAIETLRSHVENPGKFRETALVGQGPTVVRVIEKQKEE

SEQ ID NO: 6300 - protein, 263 aa, Mesorhizobium sp. BNC1
MALDGKTAVVTGGAGGIGYAVAERFLREGMRVVIADIDGEKGTRSLKSLEKLGEAWFAKADVGRSLDVHNLIAFTIDALGDIDVLVNNAGIAHGADFLDLREEDFDRVLRVNLKGAFLVGQAAARFMVEKVQNGGPAGAIINMSSVNAVFAIADQVPYSISKGGVNQLTKVMALALAPHGIRVNAIGPGSIMTDMLTSVNDDPDARERILSRTPLGRIGDPQEIASIAAFLASDEASYITGQTIYADGGRLPLNYTVSVRSED

SEQ ID NO: 6301 - protein, 285 aa, Vitis vinifera
MYDPNSALAASGGRMGGRSFSSGSSSSSRSYRTAPSGGLSYSAPYFGPSPFSGGGVYVGPAVGVGVGAGSSFFLILMGFAAFMLVSGFLSDRSEGVLTATDKTTVLKLQIGLLGMARELQRDLNLIAETADTSTTEGLSYILTETTLALLRHPDYCISGYSSVDVKRSIEEGEKRFNRLSLEERGKFDEETLVNVNNIKKQSTTSHRVSGFRNEYIVITILVAAEGVHKLPTINGSGDLKEALQKLGSIPSSRTLAVEVLWTPQNENDTLSERELLEDYPLLRPL

SEQ ID NO: 6302 - protein, 341 aa, Mesorhizobium sp. BNC1
MSERLEDIAARMVADGKGILAADESSGTIKKRFDSIGLESTADNRRDYREMLFRADEAMRNSISGVILYDETLRQQAKDGTPLVEIISRSGAVPGIKVDAGAKPLAGFPGETITEGLDGLRERLKEYYELGARFAKWRGVIAVSDDLPTWGSVKQNAQALARYAALCQEAGIVPIVEPEVLMDGTPATHSIDRCYEVTEWVLKTVFTELFDARVALEGMVLKPNMVIDGKNARKASREEVAEKTVRCLKATVPAAVPGIAFLSGGQSDEEATAHLSLMNASHSMPWKLTFSYGRALQAAALKAWGGKSENVAAGQRAFAHRARMNALAARGDWKQELEVAA

SEQ ID NO: 6303 - protein, 398 aa, Mesorhizobium sp. BNC1
MAGFKTLDDLKDVAGKRVLLRVDLNVPVKDGEVTDTTRIERVAPTITELSDKGAKVILLAHFGRPKGKPDAEASLQPIAHAVEAVLDRRVHFASSCIGEPAKKAVDEMTGGDILLLENTRFHAGEEKNDPEFTKALAANGDIYVNDAFSAAHRAHASTEGLAHLLPAYAGRTIQAELEALQRGLGDPKRPVVAIVGGAKVSTKIDLLTNLVKKVDCLVIGGGMANTFLAARGTSVGKSLCEHDLRETAKQIMIDAAEAGCAIILPVDAVVARKFEAGAETETVDIDAVPEDAMILDVGPKSVEKVKEWLDRADTLVWNGPLGAFELSPFDKATMEVAKYAARRTRESLLVSVAGGGDTVAALNQADVSDDFSYVSTAGGAFLEWMEGKDLPGVAALQK

SEQ ID NO: 6304 - protein, 193 aa, Debaryomyces hansenii CBS767
MSSPKRRIEKDVMDLMMSDHDVALIDDSIQLFHVIFHGPSDTPYAGGTWKIRVELPDQYPIKSPSIGFINKIYHPNIDETSGSVCLDVINQTWSPMFGLLNIFENFLPHLLRYANPSDPLNTEASTLMTKDEKKYNDTVKEYVTRYAKNVSNEDEDNDDINDTDDDDGELSDVGSLSSDDEDHHNGVAGEFEL

SEQ ID NO: 6305 - protein, 616 aa, Mesorhizobium sp. BNC1
MDPTIYLITLVGTALVLIAAFSSLIAFRFGAPLLLIFLGIGLAAGTDGFGGIDFDNAPIAFFIGSLALAVILFDSGFGTSFASFRSASAPAIVLATVGVIATTGLIAVASHYVAGFAWLESFLLGAAVASTDAAAVFFLLRVGNISVRDRVRSTLEVESGSNDPMAIFLTLSLVSLVASGEVLEPGALAGEIVLGFLQQMVIGLVVGLLGGYLIVRLVLRLRLEQGLLPIFVLALSLLVFALTGAIGGSGFLAVYVAGMVAGNARMRSTGMLKRFQDGVTWLAQIIMFLVLGLFATPSQFADILLPALFIGLFLIFVARPVAVALCLAPFRFTKAETAFISWVGLRGAVSILLALLPILQEVENGRAIFNIVFIVVLVSLVLQGWSIGPVARRLGMILPPRIGPVDKVELELPGSAHHELLAYRVVAGSPVERGERIPRWARPSLVVRDGRSMAYQYAGRLMAGDRVYIFVPDRYPRLLDRLFASPTDVDPEDADFFGAFAVDPKRPMADIEAAYALGLSEEDQALLISDFVRMRLGGRAEYGDRVPLGSVELIVRDVDENGHITSIGLSVDPPLRPPQVPVFISAGEALSRLWGFFQRRRKPGRSATKAEEGIQE

SEQ ID NO: 6306 - protein, 299 aa, Gluconobacter oxydans 621H
MITPALTSVFVRDLCLFGYHGVLPEETRIGQRFVVDIEIRADLSGAIAGDDYEQAVCYGTLCDIASAIVTGPPLQLIETVAGRIAEAVLAKLERVEWVRVEVRKPSAPVPYAVSGTAVSVEQVRVHEVAFSLGSNLGEREAVLAAAVDRLSLVDGLEIGKVSSLYDSAPWGGVEQPTFVNICATGRTTLEPHALLRVCKAIEADLGRVPGVRWGARAVDIDILYYGEREIRDRVLTLPHACLFERAFVLEPLAEIDPDHVIGGRRVRDALAVLPRSPGDVTRRAPDGTGRWGIKEPEPA

SEQ ID NO: 6307 - protein, 474 aa, marine gamma proteobacterium HTCC2143
MRVYDKFYINGQWVDPVVAKSMDVINPATEEVCATISIGSSADVDKAAIAARAAFNTFSQTSKQERIDLLSSICETYQKYYNDIADAISEEMGAPTKLAVNAQAAMGIAHMSTALEILKSYVFEETAGSSLVFKEPIGVCGLITPWNWPVNQISCKVAPALAVGCTVILKPSEVAPLSGYLFSKVLHEAGVPAGVYNMINGDGPGVGTALSCHPEVDMMSFTGSTRAGALVAQNAAPTVKRVTQELGGKSPNIVLADVDLEAAVTRSIMSMYTNTGQSCNAPSRMLVPADKMDEAAALAAKVTASVVVGDPKAEATTMGPVVSEVQFNKIQSLIQQGIDEGATLVCGGVGRPDGIDKGFFVKPTVFAGVNNNMTVAREEIFGPVLTILPYDSIEEAIEIANDTPYGLAGYIQGDDMEQVRAVASKIRAGNINVNGQSGDLNTPFGGYKQSGNGREWGAHGFTDFLEIKAVSGAS

SEQ ID NO: 6308 - protein, 337 aa, Mesorhizobium sp. BNC1
MTVKVAVNGFGRIGRNIVRAIYESGRKDIDVVAVNDLGPVESNAHLLRYDSVHGRFPGEVKVEGDSISIGADSFKVLAERDPSKLPWKDLGVDIVLECTGLFTSKDKASAHLAAGAKRVLVSAPADGADITVVYGVNHDKITKDHVVLSNASCTTNCLAPVAKVLNDAFGIEKGFMTTVHSYTGDQPTLDTMHKDLYRARAAALSMIPTSTGAAKAVGLVLPELNGKLDGVSIRVPTPNVSVIDFKFVPKRKVTVQEVNEALVAAATEGPLKGVLAYTKEPLVSSDFNHDPASSTFALDQTKVIDGDLVRVMSWYDNEWGFSNRMADVTAVIANTLR

SEQ ID NO: 6309 - protein, 431 aa, Acinetobacter sp. ADP1
MSEVVYTKEEKRKRVMGIVGASSGNLVEWFDFYIYAVFAMYFQHALTAPNMSSTAQGVYVWGVFAASFFMRPIGSWLFGRIADKHGRKQSMVISISLMAVSSFLFAFLPTYDQVGMIAPFLLLMVRLLQGLSVGGEYGAVATYMSEIALKGHRGFYASFQYVTLSGGQLLASLLGVILLAFMSEQQLMEGGWRIPFVIGGIAAIISLLARSKLEETLSHEDSEKKESGSLRELFKKHWGTFLLVVGYTSAGSLTFYVLTVYSKTYLTNIGIDGKVVGYMMTFALFIYMIAQPLFGAISDRIGRRASMLLFSGLSIVFIYPVMVIGMRHFSYSPVIVTLLLIFLMMILSFYTSISGLIKAEMFPPHVRALGVGFSYAVGNAIFGGSAPAVALQFKQAGIENEFFIYVIVMLVICFFCSFKLPKEPEYLHHDK

SEQ ID NO: 6310 - protein, 135 aa, Triticum aestivum
AGRVADSHITSLLLLIHFLRIPLVPPSSAPAKMSTVTRANLDQRLAAANRCSREAAMAGAKAAAVATVAAAVPTLASVRMLPWARAHLNPTGQALIISTVAGMAYFIVADKTILSMARRHSFDDAPEHLKNTSFH

SEQ ID NO: 6311 - protein, 404 aa, Saccharomyces cerevisiae YJM789
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRS

SEQ ID NO: 6312 - protein, 480 aa, Salmonella enterica subsp. arizonae serovar 62:z4,z23:--
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRYAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFADRYGRV

SEQ ID NO: 6313 - protein, 290 aa, Photobacterium sp. SKA34
MIKKCLFPAAGYGTRFLPATKSMPKEMMPVVNKPLIEYGVDEAIQAGMNRICIVTGRGKNTLMDHFDKNYELEHQISGTNKEELLVDIRDIIDSAYFTYIRQREMKGLGHAILTGRELVGNEPFAVVLADDLCVTDEEQQGVLAQMAELYKQFRCSIVAVEEVPEEDTHKYGVISGQMLRDDLFRVDNMVEKPEPGTAPSNLAIIGRYILTPDIFDIIEQTEPGKGGEIQITDALMQQAQTGCVLAYKFKGKRFDCGSVEGYIDATNYCFEHVYKKGKHKELAKQQTGKK

SEQ ID NO: 6314 - protein, 279 aa, Ustilago maydis 521
MASYLASIYGTEQDKVNCSFYYKIGACRHGDRCSRKHIRPPYSCTLLLSNVYRNPRHHEQDCTITDTELQAQFDAFYEDMFTELAKYGQLVEMHVCDNVGDHLIGNVYARYKYEADAQRAVDALNDRWYDAKPLFAELSPVTDFQEACCRQNETNECNRGGFCNFMHLRYASRPIRKELNHQLAVELRRRKEEGRDTAKGVKKRLGWKERLALEQGDTLADVEGDDGNREENGKAKRDWRSGKSGGDWRSQPRSTEVDQVDHQGHDSTPSITAADPEER

SEQ ID NO: 6315 - protein, 418 aa, Physcomitrella patens subsp. patens
MASMMETDSEATANGAEPPAPAAAPLSQASRVNDRLAESLRLEHQLVKVPFEHLKKAMRVNSRLVEKEVNAVYAGVADAIDKDMSKEETLHRLSALASRLQGLKRKLDESNKGELVEVQRCRARLDHLSVLQGQNGKENELEWNNTRVQRILVDYMLRNSYYDTALQLANLNNIQELVDADIFLEARKVIEALRNRDCTEALAWCSENKSKLKKSKSKLEFKLRLQEFMELVRAERMMDAIMYSRKHLAVWGSTNMKELQQVMATLAFKSNTDCAAYKILFDTQQWYNLTQQFKQEFCKLYGMTHEPLLNIHLQAGLSALKTPFCYEEGCTKEDPLSQETIRKLADPLPFAKHIHSKLVCYITKEPMNENNPPLVLPNGYVYSTKAMVQMAMENQGKITCPRTSVVCNFSELAKAYIS

SEQ ID NO: 6316 - protein, 317 aa, Photorhabdus luminescens subsp. laumondii TTO1
MLAELITSYRKSAAIYAFVDTGLSIHFRNGAYVDIDELSRQCGIDYSRLDRLCDFLIEIGILVNHGHKVTLSEECSALADPESMESLIVKWELSPDCWNAWSMYPRSLLENDGKPAFEITHGKSFFEHLASNKLLKSNFDSSMSKGSDKIIEKLLDIYDFGQYNRILDIGGGEGSLLVKMSEKVKGKHYAVLDRYDEIPVLENIDFINGDFLKVIPSGYDLYILKDVIHDWSDNNAILILENCRKAMDNGSAVLLISYMKKPQSKMVIYLDILMDVLFSGKERYLTEFERLANQAGLVIQDVKDIDESSSIIQLGIK

SEQ ID NO: 6317 - protein, 518 aa, Physcomitrella patens subsp. patens
MKTIVTAFSGILSLLLAYLLWAAADNWVLHRERKGPVQWPILGVTLEALKNYQTLNDWVVYYFLRDGLTFSCKMMHLDLTFTADPVNVKHILKTNFANYDKGKFFHENFEIFLGDGIFNVDGEIWRTQRKTASFEFASRKLRDFSTVVFRDYSVKLASILARAATAQQSMDMQDLFMRFTLDSIFKVTFDYDVGTLQPGLPNIPFAQAFEITNEITSSRLINPIWKLNRALKIGSERVLLQSAKDVDEFIYGVIEAKKAEMANSKTDLLSSDLFSRFMRLEEDDSDIQFTDKNFRDTLLNFIIAGRDTTAVSLSWFVYRMAQNPEMTARLQQELRDFDTVRNWKQQPEGDEGLRRRVLGFAELLTFDNLVKLQYLHACILETLRLHPAVPLDPKHAINDDILPDGTQIKKGSLIYYTPYAMGRMPALWGPDAMEFKPQRWFVDGVVQTEQPFKFTAFQAGPRICLGKDSAMLQLRMVLALLYRFFTFQIVEGTDIRYRQMATLLLANGLPAKIIKQKN

SEQ ID NO: 6318 - protein, 317 aa, Photorhabdus luminescens subsp. laumondii TTO1
MLIDLITSYRKTAAIYTFVDAGLSIHFKNGDYVDINKLASQYGIDYSRLNRLCDFLIEIGVLVSSDHGVALSEECSALADPNSVEFLTVKYEINSEHWDSWLMYPKSLLENNGKSAFEMVHGKSFFEHLDSNKGLKSDFDALMSKYTNKIIKELLVIYDFDKHNRILDLGGGDGELLIRISEQVKGKDYTVLDRYNEVPISEGINFIKGDFFKPIPTGYDLYILKNVLHNWPDNDAISILKNCREAMDNNATLLIITLMKKPQSLVVKSVDILMDMLFSAKQRYLSEFEDIANQAGLVIRHYKDLDEIFSLIELKVK

SEQ ID NO: 6319 - protein, 372 aa, Photobacterium sp. SKA34
MTITSFIPPHRTLMGPGPSDIYPQVLQALSRPTVGHLDPLFIGMMDELKQLLQYAFQTQNAFTIAVSAPGSAGMEACFVNLVEAGDKVLVCRNGVFGERMRENVERCGGVAIVVDNEWGTAVDPDLVEQVLQNDPDIKIVAFVHAETSTGALSDAKTLAEIARKHDCLTIVDAVTSLGGVPLLVDEWQLDAVYSGSQKCLSCTPGLSPLTFSQKAIDKIQQRKTKVQSWFLDQSLVLGYWSGEGKRSYHHTAPVNSLYALHEALVLLQNEGLKNAWQRHRNAHEELKAGLEKLDIKFVVEENSRLPQLNAVYIPEGVEDAEVRNELLQRYNLEIGAGLGALAGKAWRIGLMGYGARSENVALCLKALETTLK

SEQ ID NO: 6320 - protein, 454 aa, Anabaena variabilis ATCC 29413
MFLPVLLSTAVDGQTGKASYMTQATSTPTQTSNATLSALKCKECGAEYELKATHVCEYCFGPLEVKYDYNALRLSVTREKIQAGPNSIWRYRPFLPVTTDNVIDVGTGMTPLVRSHRLARRLGLNKLYIKNDAVNMPTLSFKDRVVSVALSRARELGFTTVSCASTGNLANSTAAIAAHAGLDCCVFIPADLEAGKILGSLIYSPTLMAVKGNYDQVNRLCSEVANTHGWGFVNINLRPYYSEGSKTLGFEVAEQLGWELPDHVVAPLASGSLFTKIYKGFQEFVEVGLVEGKKVRFSGAQAEGCSPIAQAFKEDRDFIKPVKPNTIAKSIAIGNPADGVYAVDIAKKTGGNIESVNDAEIIEGIKLLAETEGIFTETAGGTTVAVLKKLVEAGKIDPDETTVVYITGNGLKTQEAVQGYVGEPLTIDAKLDSFERALERSRTLDRLEWQQVLV

SEQ ID NO: 6321 - protein, 385 aa, Thermus aquaticus
MRGLSRRVQAMKPDAPVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 6322 - protein, 425 aa, Triticum turgidum
MKPIVVHAAAVDRRWLLPLAVGSALSLFLLVLLTTVPLPFFPSSSPSPALFVEHKLAPTPPASRAAGSLPRIAYVISGSARDAAALRRVLLALYHPRHLYVLHLDAEAPESDRRGLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWTALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRRAGPDAPTPGGWCAGTGDNGSDPCSVVGNTSFLQPGRGAVRLQRLVTSLLSEEKFHPRQCK

SEQ ID NO: 6323 - protein, 604 aa, marine gamma proteobacterium HTCC2143
MKPTNINDPEYFHKVVDCQLACPAHTPVPEYIRLIAAERYTDAYMVNWASNVFPGVLGRTCDRPCEPACRRGRVDEDEQPVAICRLKRVAADNKNDAEVIARMPKIPATKNDKRIALIGGGPASLTVARDLMPLGYIVDLYDDQPAGGGFMRSQIPSFRLPETVLNDEVNYILDMGVISRFDTYVDSLKDILDKNYDAVFVGTGAPRGRDLIIPGRDEGTDNIHIGIDWLSSVAFEHIEKIGKKVIVLGGGNTAMDCCRSSLRLGSDDVKVIVRSPRSEMKASPWEIDDAEREGIPMFENHVPLEFVIKEGKLAGMRFDRVRAEYDANGKRSLISLGEEPVMVECDDVCIAIGQDNSFPWIERDLGLEFGKWDMPVVDKETFQSTNPKVFFGGDAAFGPENVITAVAHGHQAAVSIDLFLNGKNVQHRLAPGATLVSQKMGIHEWSYDSGVVDDVRYAVPHTEVKLALSDRKMEVELGFDPLTGFAEAQRCLNCDAQTVFTEAKCIECDACVDICPTDCITFTHSGTEAELRTRLSAPANNLDQDLYISTDKLPTGRIMVKDENVCLHCGLCAERCPTAAWDMQKFMYEVSKAGSDSVQLGAEQ

SEQ ID NO: 6324 - protein, 139 aa, Neorickettsia sennetsu str. Miyayama
MKRTLSILKPDVISRNITGKVNAYIEAAGLQIIAMKQLHLTRIQAEAFYVVHKDRFFFNDLVNFMTSAPVIVQVLSGDDAVHRYRKLMGDTDPKKAAKGTIRGDFAESIDANCVHGSDSEENAKNEIAFFFSRCEIFDR

SEQ ID NO: 6325 - protein, 170 aa, Ustilago maydis 521
MDPSKINTELCPVYAPFFGAMGCTAAIVFTCLGASYGTSKSGVGISAMGVLRPDLLIKCVIPVIMAGIIAIYGLVVSVLISGDIKTPMSLYAGFIQLGAGLSVGLAGLAAGFAIGIVGDAGVRGTAQQPRLFIGMILILIFAEVLGLYGLIVALILNTRSQDDPLGCLLK

SEQ ID NO: 6326 - protein, 425 aa, Triticum turgidum
MKPIVVHAAAVDRRWLLPLAVGSALSLFLLVLLTTVPFPFFPSSSPSPALFVEHKLAPTPPASRAAGSLPRIAYVISGSAKDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFYADEPVLDRIDAELLSRHAGPDAPTPGGWCAGTGDNGSDPCSVVGNTSFLQPGRGAVRLQRLVTSLLSDEKFHPRQCK

SEQ ID NO: 6327 - protein, 566 aa, Methanococcus maripaludis S2
MVPDVFIEVSLVIFIAFFISLVMRMLKQPLIIGYILTGILVSPYFLNIVRFEESISTLGHYGVTILLFMVGISLNPGYFKEIGKISLITGLGQILFTFSIGFLISVFLGYSLIESMYISIALTFSSTIIIMKLISDKGDIDKLYGKISIGFLIVQDIVAMAILVLISAFNVQSGAGELLFLIISKIVLILTAIYIFTKYALSNFISYASKNQEFLFLFSLMWCFTLASLFHLLGFSSEIGALIAGIVLAIFPERYEIASKVRPLRDFFLILFFVVLGVQMTFETSGNFIIPAIILSIFVLFGNPIIVMILMGAFGYTKKTGFLAGLTVAQISEFSLIIASLGLRNGHISQEIVSMITLIGIMTIAGSSYFITYSERIYALLSNYLSIFEKKTKISEKDFKNKNTGEIILFGADRTGKNILNVIENSKERFLIIDYNPKIIKNLSKRGYNSVYGDASNLELLNELNFKESKMLISTISDIETDILLIKTILKSNKNAIIIVIAHKIEDAIKLYEEGASYVIMPHFLGSIHASLMIQKYGLNIEEFLKEKSNHIESLKKSQELFRHTK

SEQ ID NO: 6328 - protein, 437 aa, Saccharomyces cerevisiae YJM789
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDINFKEPNSDPSHWLSPAQLAEYYHSLLKKYPIISMEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 6329 - protein, 421 aa, Synechococcus sp. CC9605
MTPERLGLLWGVTVSSGAAARFLAAKSEFPGVVLLLLSGLLIGRSGLGWVEPLDLGSGLGTVVGLLVSLVLFDGGLNLRLPGDTIKATVQRIAALRLLISLGGGLLAAHWLAGLSWSLAAVFSAIVLATGPTVVTPLVRQIRLAPPLGEVLEAEGLVLEPIGAVLALLLLELVLGNLHGWREVMLGLLYRLGGGVLIGASVGWLLSELLRRLKPDQLKGLPLQLSLGLLFLMYGVSEWMLPESALPASVAAGIVVGRRPGPHTAELDSLIQELAQLAITMLFPLLAADVSWAELSPLGWGGILCVLSLMLVVRPIGVGLATIGLPYKLEQRLFLGWLAPRGIVTAAVASLFAIRLEQAGILGAGRLQGLVFLTILMTVGLQGLTAQPLARALGLVEADDDEPASAEAAAQSRQVLTDSGQQ

SEQ ID NO: 6330 - protein, 282 aa, Picea sitchensis
MAKEGGKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSSEIIGTFVLVYTVFSATDPKRNARDSHVPVLAPLPIGFAVFMVHLATIPITGTGINPARSFGAAVIYGHQKIWDEHWIFWVGPFLGAAGAAAYHQYILRAGAIKALGSFRSNPHV

SEQ ID NO: 6331 - protein, 520 aa, Debaryomyces hansenii CBS767
MLRNSASNIVKATYTRRLYSTYDSSSKVLSSLKNKDLIRTQGYINGQWVASSDNSTFEVNNPALASGAGTKIADVSSMTTKDYVRAINSAQDAFSDFKKTTGRYRSDLLMNLYRLMQENQDDLAKLIVLENGKPYADAFGEVAYASSFFQWFAEEAPRVYGDIIPSALADSKILVMRQPIGVCGILTPWNFPAAMITRKLGAAAATGCTTVIKPASETPLSALALAYLAEQAGFPKGSVNVLPSSDAAGVGKLMCENPTIKKVSFTGSTNVGKLLMSQSSSTLKKLSMELGGNSPFIVFNDADIDKAVDGAIGSKFRSSGQTCICTNRLFVHESIYDEFASKLTKKLSETVKLGNGLADGTTHGPLIHGKSMNKVRSHIEDATSKGAKVLLGGNKREDLGVNFHELTVLGGVTQEMDIFNEETFGPVAPLIKFKSDEEVISLANDTDVGLAGYFYSSNINRVFKVAEELQVGMIGANTGAISESALPFGGVKESGFGREGSKYGIDDYTVVKSVVLGGLD

SEQ ID NO: 6332 - protein, 456 aa, Photobacterium sp. SKA34
MDKATTHLDSLTVAKFGGTSVADYSAMSRSAAIVTANPETKIVLISACSGVTNILVELANGVSDSTTRQQRIQTLTQTHQDVLEQLQHPENIQDAIYGLLDNIATLAEHAASATSAQLTDQIVSHGELLSTHLFSQILVELNAPAVRVDIRPIMRTDDQFGKAIPQPDTIKQLATEQLLPLLDNNIVVSQGFIGSNSQGVTTTLGRGGSDYSAALIAEAVNASTLEIWTDVPGLYTTDPRITSAAKPIKEISFSEASEMANFGAKILHPSTLVPAVRQQIPVFVGSSKAPAQGGTWIRQSVEDAPLFRALALRANQTMVTLTSLNMFHAYGFLAEVFRILAEHKISVDLITTSEVSVSLTLDQTDTGGGAPTLPLQVVEELSQLCVVDVEQGLSLVALIGNQMSDTKGSAKDIFGALEDHNLRMICYGASPHNLCFLINEDEAKDVVRTLHASLLE

SEQ ID NO: 6333 - protein, 285 aa, Picea sitchensis
MEDVSVGASKYSERQSLGISAQTQRESKDYNEPGPAPLFEPEELRSWSFWRAGIAEFMATFLFLYVTILTVMGVKRSPSMCQSVGIQGIAWSFGGMIFALVYCTAGISGGHINPAVTFGLFLARKVSLPRTVFYMICQCLGAMCGAGVVKGMQKGMYEVEGGGANLVAHGYSKGDGLGAEIVGTFVLVYTVFSATDAKRSARDSHVPVLAPLPIGFAVFLVHLATIPITGTGINPARSLGVAIIYDRSHAWDDQWIFWVGPLVGAALAAIYHQLIIRAIPFKSRS

SEQ ID NO: 6334 - protein, 426 aa, Photobacterium sp. SKA34
MSVYSTLCFLAAAAMLIAFVNSKIGKMQTTIAITAGSLILSLLIIIAGHNGWFHLEDVAASQISKINFEDFLLKGILGFLLFAGGLGIKLPHLEDQKWEITVLALGATLFSTFFIGFSLWGICQLIGIQLDLIYCLLFGALISPTDPIAVLAIVKKMNAPRRISTQIEGESLFNDGFGLVIFVTMFTIAFGDTAPTVIGVTQLFLQEAIGGIAYGFVLGLIFHYLISSTNDHSMELLLTIGIPTAGYALAEVLHVSGPLAMVVSGIMIGNWTRYIGFSKESEEHLDHFWELVDEFLNGVLFLLIGMTMLDFSFHQEDWILMIIVVPLVLLSRYISVKLPYVSFNRYRQYNPMSVKILTWGGLRGGLALAMAMAIPAGVMVIPEKGIDVREIILVMTYSVVVFSILIQGLTITPLIEKAKLWELKNK

SEQ ID NO: 6335 - protein, 281 aa, Synechococcus sp. CC9605
MNLFADLLASTQAAQGQVTATGPRIQKRRGVEIKSAREVKIMRKASHIVATVLREVMGMVEPGQTTGDIDAYAEKRIREMGATPSFKGYHGFPASICASINNEVVHGIPSPKRVIRQGDLLKVDTGAYFEGYHGDSCITICVGNAPQEAQTLSRVAKEALMAGLSQVKAGNTLLDIAGAVEDHVKANGFSVVEDYTGHGVGRNLHEEPSVFNFRTDELPNVTLRPGMTLAIEPILNAGSKACRTLRDQWTVVTRDGSLSAQWEHTVLVTSDGCEILTDRGD

SEQ ID NO: 6336 - protein, 332 aa, Acinetobacter sp. ADP1
MSTDQEFKAPANLGIAVYSNNAEAIGNTPLVRINRIIKTGATVLGKVESRNPAFSVKCRIGAALIADAEKRGVLKSGMHIVEPTSGNTGIALAFVAAAKGYPITLTMPASMSLERRKVLKAFGANLVLTEPAKGMKGAVEEAVRLATEQPDIYFLPQQFENPANPKIHEQTTGPEIWDATNGQVDILVAGVGTGGTISGISHYFEKVQNKPIYSVAVEPAESPIITQTKRGEEITPAPHKIQGIGANFIPKNLDLDIVDEVMPITSDEALEWARKCATQEGILGGISCGAALAAAAKIAERPENEGKTIVVILPDSGERYLSSVLFEGMFEE

SEQ ID NO: 6337 - protein, 468 aa, Salmonella enterica subsp. arizonae serovar 62:z4,z23:--
MSKQQIGVVGMAVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRTDKDGIFHTEWLE

SEQ ID NO: 6338 - protein, 158 aa, Ustilago maydis 521
MLVPPPNYGMVEENFYRSGQPDQLNFPFLEKLGLKSVIWLAPEEPEPGFLDFCVDQNIELHHLGVLYSTNAWDPITEEVVLQALHLLVQPATYPVLVMCNLGRHRTGTVVGCFRKLQRWNLSAILEEYRRFVGGQKYRILNEQFIELFDEELVFGASY

SEQ ID NO: 6339 - protein, 388 aa, Salmonella enterica subsp. arizonae serovar 62:z4,z23:--
MKITISGTGYVGLSNGLLIAQHHDVVALDIVPSRVELLNDRISPIVDKEIQQFLKDDNIRFRATLDKFDAYQNADYVIIATPTDYDPKTNYFNTSSVESVIQDVVSINPAAVMIIKSTVPVGFTAAMRRQFATENIIFSPEFLREGKALYDNLYPSRIVIGEQSDRAREFAALLQEGAIKQGIPTLFTDSSEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADAILSRKPKVVGIFRLIMKSDSDNFRASSIQGIMKRIKAKGVEVIIYEPVMKEDTFFNTRLERDLRCFKQQADVIISNRMATELSDVAEKVYTRDLFGSD

SEQ ID NO: 6340 - protein, 297 aa, Triticum aestivum
AHNPLCRDILRPNNNMDLTSLTAVWWAVALLFITVLVTKISRARFTTVDLHRTTGQLPPLVNGVALLKLLPTLFNKGLPAMMNDLYVKYGSVFMVSSFGVKVTLLIGPEVTAHFFQGLESEISHGNLFEFTVPMFGEAVGYGRDTATRTEQMRFHIEALRPSRLRSHVYPMLQEVEGYFAKWGDEGIVDLKLEFEKLLMLISSRCLLGKEVRENMFDEVYTLFHEIEDNGVTLISFLFPYLPSPANRQRDRARIRLTQILSDVVNSGKNSGRVEEGTLQKLIDSKTARGALKSISAA

SEQ ID NO: 6341 - protein, 251 aa, Physcomitrella patens subsp. patens
MVKLAFGESDEASSPDALKGALAEFISLFLFVFIGVGSVMSYEKIHVGDLEAGGLLMIAIAHGLAIAILVAATANISGGHVNPAVSLGLALAGKITVIRLVLYWVAQLLGAVAGAWVLKMVTTGEDVARHAIGVGMSPMSAVLMEIVLTFTLVFVVFATAVDPKKGTVGVIAPLAIGFTVLAQIFVGAPFSGASMNPGRSFGPAVIAMDFTNHWVYWVGPFIGAALAAVIYDGVFISPSPPAGHQAIPSDF

SEQ ID NO: 6342 - protein, 467 aa, Pseudomonas aeruginosa PAO1
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 6343 - protein, 434 aa, Helicobacter pylori 26695
MPLKSLKNRLNQHFDLSPRYGSVKKIMPNIVYADGFNPSVGDVVKIEKSDGSECVGMVVVAEKEQFGFTPFNFIEGARAGDKVLFLKEGLNFPVGRNLLGRVLNPLGQVIDNKGALDYERLAPVITTPIAPLKRGLIDEIFSVGVKSIDGLLTCGKGQKLGIFAGSGVGKSTLMGMITRGCLAPIKVIALIGERGREIPEFIEKNLKGDLSSCVLVVATSDDSPLMRKYGAFCAMSVAEYFKNQGLDVLFIMDSVTRFAMAQREIGLALGEPPTSKGYPPSALSLLPQLMERAGKEENKGSITAFFSVLVEGDDLSDPIADQTRSILDGHIVLSRELTDYGIYPPINILNSASRVAKDIISESQNLCARKFRRLYALLKENEMLIRIGSYQMGNDKELDEAIKKKALMEQFLAQDENALQPFETSFQQLEEILR

SEQ ID NO: 6344 - protein, 246 aa, Escherichia coli O157:H7 EDL933
MLDQVCQLARNAGDAIMQVYDGAKPMDVVSKADNSPVTAADIAAHTVIMDGLRTLTPDIPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 6345 - protein, 504 aa, Zoysia tenuifolia
MASPAAVPQRQLFIDGEWRAPALGRRIPVVNPSTEAHIGEVPAGTAEDIDAAVKAARAALKRNRGRDWARAPGAVRATYLRAIAAKVTERKPELAKLEALDCGKPYDEAIWDMDDVAGCFEFFAGLAEDLDKKQNSPVALPENFKCHLRREPIGVVGLITPWNYPLLMATWKVAPVLAAGCTAVLKPSELASVTCLELGDICKEVGLPKGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHTKIAKEFIERMVAWAKNIKVSDPLEEGCRLGPVVSEGQYEKIKKFVANAKSEGATILTGGVRPKHLEKGYYIEPTIITDVSTSMEIWREEVFGPVLCVKEFSTEDEAIELANDTHYGLAGAVLSADRERCQRVAEEIDAGAIWVNCSQPCFCQAPWGGNKRSGFGRELGEGGLDIYLNVKQITEYTSDEPWGWYKPPSKI

SEQ ID NO: 6346 - protein, 503 aa, Zoysia tenuifolia
ASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 6347 - protein, 438 aa, delta proteobacterium MLMS-1
MTLPAPLFILRGFLSLKNIKKILEDICMARINDNYLKLKAGYLFPEINRRLKAFSEANPEARILRLGIGDVTRPLAPAVLEAFRRAVDELGTTATFMGYGPEQGYEWLRQSVIDHAYTPRGVKLAPSEIFISDGSKCDCANILDIFDLGNKVAIGDPVYPVYNDTNVMVGRTGEADAHGHYQGIVYIPFTAENNFSPEPPAEKVDLIYLCFPNNPTGAVASKAELKKWVDYARQNEAVILFDAAYEAFITDPQIPHSIYEIEGAEQCAIEFRSFSKTAGFTGVRCALTVVPQALTGRDAAGEPVALNPLWNRRQSTKFNGVSYPVQRAAEAVYSPEGWRQNQEIIDFYLENAHLIRQGLEASGVKCFGGTNAPYIWLQTPAGMSSWDFFDKLLNNCHVVGTPGSGFGPGGEGYFRLSAFGQRETVEEAVARIRRQLSS

SEQ ID NO: 6348 - protein, 504 aa, Zoysia tenuifolia
MASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 6349 - protein, 269 aa, Moraxella sp.
MQAWVIGNWKQNPATSHDVNALLDDLCAAISTTKQMSHDNSARCQIMVAPSLIHLAAVNGRLKDTSILCAAQDVSGHSASVGAYTGECSAQQIVDAGATWTILGHSERRQYHQESNDALLQKMIHALSQDLGVVFCIGESQEQYDTKQTLTVIDNQLVVIKEFITQQPELIDALPTRLIIAYEPVWAIGTGKVPTVAEVSATHKHIKQTLAGFADSLSNMTVLYGGSVNADNANSFAADPMIDGALVGGASLKADSFLTIATAFSQASI

SEQ ID NO: 6350 - protein, 504 aa, Zoysia tenuifolia
MASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVIFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 6351 - protein, 351 aa, Brassica napus
PRVRPRVRKVSGGVVGIEDFEVLKVVGQGAFGKVYQVRKKESSEIYAMKVMRKDKIMEKNHAEYMKAERDILTKIDHPFIVQLKYSFQTKYRLYLVLDFINGGHLFFQLYHQGLFREDLARVYTAEIVSAVSHLHENGIMHRDLKPENILMDTDGHVMLTDFGLAKEFEENKRSNSMCGTTEYMAPEIVRGKGHDKAADWWSVGILLYEMLTGKPPFLGSKGKIQQKIVKDKIKLPQFLSNEAHALLKGLLQKEPERRLGSGPSGAEEIKGHKWFKGMNWKKLEAREVKPSFKPEVSGRQCIANFDKCWTDMSVLDSPASSPSSDPKANPFTNFTYVRPPHSFLNQTTSTS

SEQ ID NO: 6352 - protein, 235 aa, Zea mays
  misc_feature (207)..(208): Xaa can be any naturally occurring amino acid
MMGGFVSRILLLVFGYAYPAYECYKTVELNKPEIEQLIFWCQYWILVALMTVMERFGDLTISWLPFYSEAKLLFFIYLWYPRTKGTTYIYGTFFKPYISQHENEIDRNLLELRARASDVVVVYVQKVAAVGQNTFFDVLKYVASQSPSQKSKQQRPQEPQQSQPQPQVQQQQPQRQAQPVMHRAASIAARQAAMAQQAQETKPISPXXQRQHQAKGGPAASTNPAAAAAPQQNPM

SEQ ID NO: 6353 - protein, 172 aa, Prochlorococcus marinus str. MIT 9515
MKLIRFLKYFLCISFAFLIISSPVFAGANVATKGEGDEVPSYVRSNITGFDFHGEDLHLSSIAGAVARDADFSDVDLHGTTLTLSDLKGSNLNGIDLTDTLADRVNFQKTDLRNSILINMIASGSSFAGAQIEGADFSYAILDSEDQRNLCKIAEGVNPTTGVSTRDSLECS

SEQ ID NO: 6354 - protein, 500 aa, Arabidopsis thaliana
MSIFLCFLLLLPLSLILFKKLLPSKGKLPPGPIGLPIIGNLHQLGKLLYKSFHKISQEYGPVVLLRLGVVPVIVVSSKEGAEEVLKTHDLETCTRPKTAATGLFTYNFKDIGFAPFGDDWREMRKITTLELFSVKKLKSFRYIREEESELLVKKISKSVDETQNSSVDLRKVLFSFTASIICRLAFGQNFHQCDFVDMEKVEELVLESEANLGTFAFADFFPGGWLIDRISGQHSRVNKAFYKLTNFYKHVIDDHLKTGQPQDHSDIVSVMLDMINKPTKADSFKVTYDHLKGVMSDIFLAGVNGGANTMIWTLTELSRHPRVMKKLQEEIRAMLGPNKERITEEDLEKVEYLKLVMVETFRLHPPAPLLLPRLTMSDIKIQGYNIPKNTMIQINTYAIGRDPKYWKQPGEFIPERFLDSPIDYKGQHFELLPFGAGRRICPGMATGITMVELGLLNLLYFFDWSLPNGMTIEDIDMEEDEGFAIAKKVPLVLIQTSHRW

SEQ ID NO: 6355 - protein, 309 aa, Agrobacterium tumefaciens str. C58
MQDIQGIVDSIYDSMLPRLGEGKVADYIPELAKVDPNQFGIAITTVDGTTYTAGNALVPFSIQSISKVFMLTLALGKAGETVWNRVGREPSGSSFNSIVQLEHEHGIPRNPFVNAGAIVVTDIVLSGHQPREAIGELLRFVRYLADDDTISIDDTVAKSEQATGFRNFALANFMRSFGNLHHPVEHTLGVYFHQCALSMTCAQLSRAGLFLANRGRNPLSGHTVVSDRRARRINALMLTCGHYDGSGDFAYHVGLPGKSGVGGGIMAVAPGNASIAVWSPGLNKVGNSALGSQALELLATKTGWSVFGA

SEQ ID NO: 6356 - protein, 398 aa, Ustilago maydis 521
MKEVTRKMMTDVAVFAISQVAFYYAFKYVMSSLDPNRQKRQNSKKVADAKLGKLGLRGKELQLNEYEEQISAELILPEDIPVDFASIGGLDGIISSLQESVIAPLCYPELFANASGLLGAPKGVLLYGPPGTGKTMLAKALAKESGATFINMHVSTLTNKWFGESNKLVAALFSLARKLQPSIIFIDEIDSFLRERATGDHEVTGMMKAEFMTLWDGLTSSTDRIMVLGATNRPNDIDSAILRRLPKRYAVSLPSAAQREKILSLMLSATTLDPSFKMAELVKRTEGYSGSDLKELCRNAAMRPVREFLRSKQGRESVAERRRLATAGAALNGKANIDGTPNGTLTPSEGDLVAAASPAAKIESRPLRNSDFFVVDSAATPVNGSRGAPMAVDEEPLD

SEQ ID NO: 6357 - protein, 435 aa, Candida albicans SC5314
MEARFFRIFKGGSLTTTTAAASFTATATAGATTAKTLSGSTVLRKSYKRTYSSSVLSSPELFFFHQFNNNKRYCHTTTTTNTKTIMSEQIPKTQKAVVFDTNGGQLVYKDYPVPTPKPNELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 6358 - protein, 174 aa, Oryza sativa
  misc_feature (104)..(104): Xaa can be any naturally occurring amino acid
  misc_feature (118)..(118): Xaa can be any naturally occurring amino acid
  misc_feature (128)..(128): Xaa can be any naturally occurring amino acid
  misc_feature (137)..(137): Xaa can be any naturally occurring amino acid
  misc_feature (148)..(148): Xaa can be any naturally occurring amino acid
MPLSYSAAAAAAPSPLAARSRGLLRRPPRSAPVVVRCKKIDQLRAVNGIPPYAPVSNRSLLSPVTLPIIRDANIKNDTRLRIFSGTANPSLFQEIASYLGLELXGKINIKRFADGEYXVPLRKSVRGXDGFLGEPTXPPGKEILWNLXIWMGARRKSSGNKFTASFPYFWFCRS

SEQ ID NO: 6359 - protein, 173 aa, Mesorhizobium sp. BNC1
MFRRYADTLTSEGFIRIVIHAVGRMKAGPERELADRYLDRAAKAGPAIGMELAGVSEIPESRARSTLERKREEGRKLLDFAQGGALILLDERGKNLSSRELGDRFASFRDSGFRQIVMAIGGPDGHDDAVRAAADLSISFGAQTWPHQLVRVMLAEQLYRLITILSGHPYHRD

SEQ ID NO: 6360 - protein, 333 aa, Vibrio sp. Ex25
MTIKVGINGFGRIGRLALRAAFDWPELEFVQINDVAGDAATLGHLLEFDSVQGRWHHEVQVEGNELVINGKRIATTQQRDIDAVNWSGCDVVIEATGVHRKTSYLDQYLDQGVKRVVVSAPVKEEGIANIVVGVNDHIFDPEKHRIVTAASCTTNCIAPVVKVIHEKLGIEQSSFTTIHDLTNTQTILDAPHKDLRRARACGMSLIPTTTGSATAIVEIFPDLKGKINGHAVRVPLANASLTDIIFDVKRDTTAEEVNALLKEASEGELKGILGFEERPLVSIDYKGDQRSTIIDAQSTMVVGSRMVKIYAWYDNEMGYATRTAELVRNVGLA

SEQ ID NO: 6361 - protein, 614 aa, Vitis vinifera
MEQYEILEQIGKGAFGSALLVRHKHEKKKYVLKKIRLARQTDRTRRSAHQEMELISKMRNPFIVEYKDSWVEKGCYVCIIIGYCEGGDMAEAIKKANGVLFSEEKLCKWLVQLLMALEYLHMNHILHRDVKCSNIFLTKDQNIRLGDFGLAKMLSSDDLASSIVGTPSYMCPELLADIPYGSKSDIWSLGCCIYEMTSHKPAFKAFDMQALINKINKSIVAPLPTKYSGAFRGLVKSMLRKNPELRPSAAELLRHPHLQAYVLKIHLKSNSPRYNTLPICWSEPNHSKKFRFPEPEDAPISTYREKRQSFCNDRNLNPSISGAEQDFLSSAQRKHSTPVCLNQRLVEISFGSTHEETTIIRSVASKSTNITKTPRLTPAKASATPKRWTEPSKDRELFRASQTPVKKSAPAARRASLPLPRRSTVKESACRSKIGLLHHINSPDVSVNAPRIDRIAEFPLASYDSPFFPVPKTSSTSAQGSSNSIIGDHSITKDKCTIQVCERALARLSFTNAWPVDGEDAGNCSDQNATAGASSQASSDLRRRRFDTSSHRQRAEALEGLLEFSARLMHEERYEELGVLLKPFGPGKVSPRETAIWLTKSFKENTGKQEDQCP

SEQ ID NO: 6362 - protein, 283 aa, Vitis vinifera
MATLSLLSPPKSHSLSSLHHRNALSLRTSSTLTPRTRPLLSIRAFSAPALTQDDLKKLAADKAVDYVKSGMVLGLGTGSTAAFVVAKLGHLLKTGQLSDIVGVPTSKRTEEQALSLGIPLSVLDHHPSIDLAIDGADEVDPDLNLVKGRGGALLREKMVEAASDKFVVVVDDTKLVNGLGGSGLAMPVEVVQFCWKYNLVRLQELFKEEGCEAKLRLNPDGKPYVTDNSNYIVDLYFKTPIKDSIAAGKEISSFEGVVEHGLFLDMATAVIIAGKDGVTVKTK

SEQ ID NO: 6363 - protein, 183 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSEEEDDSGDEAILGNPDP

SEQ ID NO: 6364 - protein, 412 aa, Ralstonia metallidurans CH34
MRERGPVRHLAHMGLPILPSGGCAHLMDGGSRLTIRPTPGAGAFCTILSRIVRQWTRQGRTIAFKPPARWHRQWAANGPRGGRFTGDIKMAKAVRFYETGGPEVLKFENVEVGDPGPGQARVRHTYIAVNFIDIYFRTGHYPLELPNGLGSDAVGVVEAVGPGVTDIRVGDRVGYLLGPQGAYSDVRVMPADVLIPLPDGIADRTAATLMMKGMTAQYLFRQVYPLKGGETILYHAAAGGVGLIACQWARALGVTMIGTVSSDEKAEIAKANGCTHTIVTSRENIAERVKALTDGKGVPVVFDSIGKSTLEASLDSLQVRGTLVSNGTTSGPVEIDSRVIARKGSLWVTRPAMIHYATPRSHMLAMAAEVFDMVMAGKIHNEPRQTFALAEAALAHQALESRQTSGATVLVP

SEQ ID NO: 6365 - protein, 869 aa, Saccharomyces cerevisiae YJM789
MTESAIDDQRFNLTKELQRHSCRDQGKITQKDDAIGFISYSSFQSSFNTDQKSADNGSTVRRSIRSIFRRAAELPRVHMGPLTYSHGINELVDKKLRKDCDLSTLCRVLQRGIRMIRMTRRRRKFYEFKLINNNGQIIWKDGSKYLELDSVKDIRIGDMASTYQEEVDPKRLRSDSKLWITIIYKVSNKLKALHVVALNELDFNTFLSCICGLVKLRRELMESILLPDNSQFARIHWQITVSEKEEDEKKDTLSFADVKKLCDKFHIYVSTGQLLEFFQSADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRDLSVNEPFPSSFSSSYESANEQELRMKDDSTNSSSATNSSSMQRIKRIGLKKHVDIINDVSNISGIHGIKFRNFSLPESKTIAHCFSLNEHKVEYMIKDKHLKLSLDKHNRRYLMRVYPHVLRYKSSNFNPIPFWKAGVQMVATNWQTNDIGQQLNLAMFQILDHQPDGSFKSGYVLKPRKLLPVVTKAKMIPLIYEHFENGNDPVTVKIRILSTQLLPRLNDTSPSRNNTNSFVKVEFHTDDEPTTPISIDKGTRISATEASTKSSQGNGFNPIWDAEVSITLKDTDLTFIKFMVISEETPIASVCLKLNYLRMGYRHIPLFNMEGEQYIFCTLFIHTQIL

SEQ ID NO: 6366 - protein, 146 aa, Glycine max
  misc_feature (54)..(54): Xaa can be any naturally occurring amino acid
MASSLSFVSSSHLTLRTPSLTLRKLSPPRTSVSFSVKAQSVALSQDDLKKLAAXKAVEAIKPGMVLGLGTGSTAAFAVDQIGKLLSSGELHDIVGIPTSKRTEEQARSLGIPLVALDTHPRIDLAIDGADEVDPNLDLVKGRGGAL

SEQ ID NO: 6367 - protein, 250 aa, Rhodobacter sphaeroides 2.4.1
MDYLTAVGTDAISDRMLGFLRDAGLGTSRVARIPDRTVGLYLIELTDGERSFAYWRGQSAARLLARDPAVLAAGFAGASMIYLSGITLAILEPADRSQLLAALSAARAAGSAVAFDPNLRPRLWPDAATMCAAIMEAARHADIVLPSHEDEAAFFGDEDAAATAARYAAAGAALVVVKDGAGPMVTLTPEGQQSHAPETVSQVVDTTAAGDSFNAGFLAAHIAGAPLAEAVRAGARLAARVIGQRGALVT

SEQ ID NO: 6368 - protein, 268 aa, Populus trichocarpa
MGFWLVLLFTLLTCTNLSKSDPSDEACLTHLSQSLKDPANLLQNWTRSNFASPCSGFTSYLPGATCNNGRIYKLSLTSLSLQGSLSPYLANCTNLQSLDLSSNQITGPIPADLQSLVNLAVLNLSSNRLEGEIPPQLAMCAYLNVIDLHDNFLSGQIPQQLGLLVRLSAFDVSNNKLSGPIPASLGNRSGNLPRFNATSFEGNKDLYGYPLPPMKAKGLSVLAIVGIGLGSGFASLVLSFTGVCIWLKVTEQKMALEEGKISSLMPDY

SEQ ID NO: 6369 - protein, 858 aa, Ustilago maydis 521
MNREWLVELGLDSNPTLSHEWATESTRSSLSSPCPFSYRGHAEQLQQVGLASLCHHRLLHPDATLASANVLAIMNAPGSMRRPGGTRGTKLKPPKKIGLDVSIEDMWLRLVHAISQIQNHNISKLSYEEHYRYAYNLVLYQQGDMLYHGVKKQVQQHLDKLCREKIVPAFPPGGAASVSAGIILPESLLNRSQASSSSISRINPDPSTSSSSKGKARAIDSDPSSFADADTDATPAVSAASAAAASVSMSATQAGDHADAVARTQAGERLMTAIRDTWLDHRSCMSKLSEVLKYVDRVYVENHKVPSINRLGLEMFRDCVIRSSKYPIQIYLYSTLLTHIQIEREGSAISRSLLKSNIDMLSDLTQPKSGAPTSQDASVYSSDFEPALLQTSAAFYSAEADRWLDAGDAARYLAHVARRLQEEADRVAVYLKPETHKPLQHLLETNFLGKHLSTIINMPGSGLVAMLDEERNEDLARLYTLFSKVSGGDTTLRLALKSYIGAKGKLINDAVTSQTPAQAASTNPSQGQDDASGSGCKGRVKEKAGGDVDASTPQAATAIRWVEEVLEFKNKFDSILQVALANDTGCETAINEAFESFINTNKRAPEFISLFIDENLKKGLKGKTEVEVEEMLRKTISVFRFLHEKDTFERYYKQHLAKRLLQGRSVSDDAERGMMAKLKIESGHGYVAKLQGMLNDMKTSEETVEEFNRSVKNSARGMRFGVSVNVLTSTNWPISAQPPSCTMPEMLMEARRRFEEFYQSKHNGRVLTWHANLGNADIRVAFNSRTHEINVSTFALVVLLLFEEVPDPQQDSERQGGREGGQVLFQLGLYMSTGAIQDPASGSASGNEQGEARDKCET

SEQ ID NO: 6370 - protein, 238 aa, Photobacterium sp. SKA34
MIKKASLVLLSLLAGVSLNAQAADWGYGKSNEHWAESYPICGLGKNQSPINITSALQTNLAPLQIEYDGKITDITNNGHTVEALVSGDNKLIVDGDTYTLRQIHFHTPSENLINGKQYPLEAHFVNVDDKGNIAVIAVMFENGLRENNALSSLLKNIPTKGNTIDFTDDLSPNNLLPREREYYQFNGSLTTPPCTEGVRWFVLETPQFSSKDQTEKLHKIMSNNNRPVQPINARIIVK

SEQ ID NO: 6371 - protein, 578 aa, Ralstonia metallidurans CH34
MGLPCVRYAPAGKTTKGIVTTTDSTHPTDSARDGSRLRDLVAGCSIAGLLLPEAVAYAGIANLPPQAGLIGLLVGLVVYGLAGTSRFAVVSATSSSAAVLAAITLSMSGADPAQRLLLAAGLVILSGFFLMLAGLAKLGGITEFIAKPVLRGFTFGLAITIILKQLASVVGVHPAHNDLPRFTYEMLGQLSAWNVNALIVALVALALLFGMSRWKNVPGPLVVIVLGIAASHGVDLHHFGIGQVGTIDLADLSFSIPDLSRSQWLRLGELAFALVLILYAESYSSIRSFALKHGDSTSADRDLLALGFANLGSGLLHGMPVGAGYSATSANEAAGATSRLAGWCAAVVVAVIVALLLPQLALTPEPVLAAIVAYAVSHTLRLSVFRPYWSWQRDRLLVVAACVAVLLLGVLDGLLAGIVVSLLLTLRNFSEPRVSQLGRLGTSHNYVDVSKHPEATIPPGLLIARPEAPLFFANVERILLRVRHLAEAEQGAVHTVIISLEETPDLDGSTIEALRTFAAGVASRGRRLLLVRLKPPALDVLTRSADDTLPLGALHELSVDEAVQSLALESIGADAPAT

SEQ ID NO: 6372 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQRLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILYGGARPQHLRRGFFIEPTIITDVSTSMQIWREEVFDPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 6373 - protein, 428 aa, Salmonella enterica subsp. arizonae serovar 62:z4,z23:--
MMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWVFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGLIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAGIGLIYLACVTKSFRNPVPQYEDVA

SEQ ID NO: 6374 - protein, 479 aa, Rhodopirellula baltica SH 1
MSTATATGRVTQVIGSTFDAEFPEGQLPKIYNALTIQSEHKGVTIDLTGEVQQHLGGGRVRAIALGSTEGMMRGMNVVDTGKPVSVPVGKATLGRVFNVLGQPIDKRGDVQADDYWPIHRQAPPVNELSTNTELFETGIKVVDLLTPFVRGGKAGLFGGAGLGKTVILTELIARIASSHGGYSVFAGVGERTREGTDLWLEMQETEIGSTGRNVIEQTCMVFGQMNEPPGSRLRVALSALTMAEYFRDTTGADTLLFVDNIFRFSQAGSEVSALLGRMPSAVGYQPTLATEMGALQERITSTKQGAITSVQAVYVPADDPTDPAPATAFGQLDAFIYLERSISEKGIYPAIDPLASNSRILDPQYVGDRHYTIARRVQTILQRYRELQDIIAILGVDELSEEDKTIVHRARRIERFLSQPFLVAEVFIGKPGEITSLEDTIRSFEGICDGKYDHLPEQAFMYVGAIEQAEEQAKKMESK

SEQ ID NO: 6375 - protein, 465 aa, Synechococcus sp. RS9916
MVLALATVAQNLDSASFDLIVLGAGSGGLAAAKRAARHGARVAIVEGDRVGGTCVIRGCVPKKLLVYGSQVQEQLADAASYGVTVTAAQQDASVLLNNVRNEVDRLNALHISFLEKAGVTLVRGWGRFLDDHRIAVRRDGDGEREEVLQGSRILIAVGGQPSRPSIPGADLAWVSDQMFLQESYPQRVVIVGAGFIACEFACILRGLGVDVTQLVRRDHLLRGFDRELADAVQEGMVEKGIDLRFGTAPTAIEGSPGDLVVCTDGGERLPCGGVLLATGRRPFLDGLDLASAGVQVEGHRVPVDADQATNVPHIHAVGDVTDRICLTPVAVDEGRAFADAAFGGIHRQVNHDLVASAVFSQPELATVGLSEEAAVERLGADQVVVHRARFRSMAQALPKRGPRCLLKLVVDNTSDRVLGCHMVGEHAAEIIQMAAIAIGMGATKADFDRTMALHPSVAEEFVTMG

SEQ ID NO: 6376 - protein, 176 aa, Escherichia coli O157:H7 EDL933
MSLLNVPAGKDLPEDIYVVIEIPANADPIKYEIDKESGALFVDRFMSTAMFYPCNYGYINHTLSLDGDPVDVLVPTPYPLQPGSVIRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 6377 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQHLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILCGGARPQHLRRGFFIEPTIITDVSTSMQIWREEVFGPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 6378 - protein, 339 aa, Escherichia coli
MVIFVTGGAGYIGSHTILELLNNGHDVVSIDNFVNSSIESLKRVEQITNKKIISYQGDIRDKNLLDEIFSRHHIDAVIHFASLKSVGESKLKPLEYYSNNVGGTLVLLECMKRYNINKMIFSSSATVYGSNSIPPHTEDRRIGETTNPYGTSKFIIEIILSDYCDSDNNKSVIALRYFNPIGAHKSGMIGENPNGIPNNLVPYISKVAQNQLPVLNIYGNDYPTKDGTGVRDYIHVCDLAKGHVKALEYMFLNDVNYEAFNLGTGQGYSVLEIVKMFEIVTKKSIPVAICNRREGDVAESWASADLAHKKLSWKAEKNLKEMIEDVWRWQTNNPNGYKK

SEQ ID NO: 6379 - protein, 462 aa, Wigglesworthia glossinidia endosymbiont of Glossina brevipalpis
MDTGKIVQIIGPVIDVKFEISFIPKINFALEIKIKNKKLIMEVMQQIGDGIVRCILMGSSDGLKRGLKVFNLNKGIEVPVGKPTLGRIMNVLGDPIDRKGKILSSEYRPIHNKSPSYNEISSSDELLETGIKIIDLICPFAKGGKIGLFGGAGVGKTVNMMELIRNIAIEHSGYSVFSGVGERTREGNDFYNEMISSNVIDKVSLVYGQMNEPPGNRLRVALTGLTLAEKFRDEGNDVLFFVDNIYRYTLAGTEVSALLGRIPSAVGYQPTLSEEMGILQERITSTKSGSITSVQAIYVPADDLTDPSPATTFVHLDATVVLSRQIASLGIYPAIDPLDSTSRQLDPLIVGEDHYLVARKIQSILQRYKDLKDIIAILGIDELSEEDKILVSRARKIQRFLSQPFFVAEIFTGFSGKYVTLKDTIDGFNSIINGEYDYIPEQAFYMTGNISDVLDKYKKFYS

SEQ ID NO: 6380 - protein, 296 aa, Streptomyces roseochromogenes subsp. oscitans
MRGILLAGGTGSRLWPVTRAVSKQLIPVFDKPMIYYPLTTLMMAGIREILVITRPEDQRQFRHLLGDGSQLGLRLEYAVQEQPEGIAQAFVLGAEFIGDQSVALVLGDNIFHGGGLGTRLREYSDPVGGRIFAYVVADPTAYAVVEFDEAGMAVSIEEKPADPKSRYAVPGLYFYDNRVVEVARGLVPSERGELEITAVNETYLRWGQLRVTALDRGTAWLDTGTFTSLVQASEYVRVVEERQGLKIGCVEEVAWRCGLIENDQLRELSRPLLKSGYGQYLLDLLAERELKELKVS

SEQ ID NO: 6381 - protein, 482 aa, Escherichia coli
MSDVPLIAVVMAGGTGSRLWPLSREHYPKQFLQLSGENTLLQSTLLRLSPLSCETPLVITNEQHRFVVAEQLRQINQLSDNIILEPCGRNTAPAIALSAFTALKRNEQQDPILLVLAADHVINKTDVFCNAIKNSISIVEQGNILTFGIIPDYAETGYGYIEKGSIVKESQRGVGNTFYHVEQFVEKPNRSRAEEYISSGKYLWNSGMFMFKASVYLEELKKYRPDIYDICEKTISSSYHDLDFIRLSKDVFQNCPSESIDFAVMEKTKRCIVYPVDIGWNDVGSWQSLWDVSDKTPTGDVCKGDILTYNTKNNYIHSESALVAAVGVEDIVIVQTKDAILVSKKSEVQDVKKIVQMLKMQERSEYLSHREEFRPWGKFDAIEQGDRYKVKKIVVKPGEGLSLRMHHHRSEHWIVLSGTAKVTLNNKTFLVTANESVYIPLGATYSLENPGIIPLNLIEVSSGDYLGEDDIVRQKERYKIDD

SEQ ID NO: 6382 - protein, 502 aa, Zoysia tenuifolia
SPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVIFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 6383 - protein, 357 aa, Xylella fastidiosa Temecula1
MSKKILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRYPKQFDVIVTENMFGDILSDQASMLTGSIGMLPSASLDANNKGMYEPCHGSAPDIAGQGVANPLATILSVAMLLRYGMGYIKTADAIEYAVGVVLDSGLRTADIWSEGMTKVGTVAMGDAVVAAL

SEQ ID NO: 6384 - protein, 541 aa, Oryza sativa
MAILLLVALFYRIKKQAAAMAAKRKQQPKLPPGLATMPVVSNMHQMLMNKPVFRWIHRLLDEMDTEILCLRFGRVHVIAVASPEMAREVLRKKDAMLASRPSSFVSRTFSFGYKNTIMSPAGDQWRKMRQVLTSEILSPAMERRMLGRRVEEADHLVNYVYSHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVIAGRRGCPAVSLGTSITMMLFARLLQGFSWSIPPGGDRIELQDRRRRSSRAPPPSRSSSSLGEVAIVPRPPLRRRCRPPEHRRRRQAEGLRRFDLVADAVRCSSAVALVIGKFAASCSTSWCPPFVPKRRRSPASLRA

SEQ ID NO: 6385 - protein, 209 aa, Zea mays
MSLILRFRQHLSTRLSQTSRSPLASLLNGRRSFGQPAGKQDEEEEEEIDQRKLPTDYDAATFDPTEHRSPPTDRVFRLVDEISSLTLSEISELGAIILKKRGITETPTVAVMKPGAVAAGGIAQGGGGGGASEEAKVEKTVFEIKLEGFEASGKIKIIKEVRSFTDLGLKEAKELVEKTPSVLKAGVSKEEGEKIVDKLKALGAKVVLE

SEQ ID NO: 6386 - protein, 429 aa, Crocosphaera watsonii WH 8501
MIHDIFMPALSSTMTEGKIVSWTKSPGDKVSKGETVVVVESDKADMDVESFYDGYLATILVEAGQEAPVGDAIALIAETEAEIAQAQQKSPSSPQKSPEPSPPQKEELATATAPVSTATATVTAPPSTNGKSNRIVASPRAKKLAKQLGIALNTVEGSGPYGRIVAEDIEKAAGKTPTPPAIATQTPVTTPTPKVAVTPTPTPVTAGETVPLNTLQKAVVQNMMATLQVPTFHVGYTITTDELDKLYKQLKPKGVTMTALLAKAVAVTLEKHPVVNANYGEQSIRYPQSINIAIAVAMPDGGLITPVLQNADKIDIYSLSRTWKDLVDRARSKQLQPEEYSSGTFTLSNLGMFGVDRFDAILPPGQGSILAIGASSPQVVATADALLGVKRQMAVNITCDHRVIYGSDAAAFLQEFANLLENNVQSLTM

SEQ ID NO: 6387 - protein, 76 aa, Glycine max
LIVSAWLAAAKSLDTQFTALRKEEELEKEMERAAAVKIPVVAETESGNGSLATGSPLNPSSGDSSSSPSEASTPRN

SEQ ID NO: 6388 - protein, 366 aa, Populus trichocarpa
MATTNKDATIPSDEKTGSASGAENNSKDSSSKSSETSSTSGEQRRAPPPQSPGLGGAAAAAAGFPPSPFDFSAMTGLLNDPSIKELAEQIAKDPSFNQMAEQLQKTFQGATAEDAIPNFDTQQYYSTMQQVMQNPQFMTMAEHLGTALMQDPSMSQMLESFTNPSQKDQIEERMTRIREDPSLKPILEEIESGGPAAMMRYWNDKDVLQKLGEAMGLAVSEEAGTSVETSGHEEAEEAGNEDESVVHHCASVGDVEGLKNALASGADKDEEDSEGRTALHFSCGYGEVKCAQILLEAGATVDALDKNKNTALHYAAGYGRKECVALLLENGAAVTLQNMDGKTPIDVAKLNNQQEVLKLLEKDAFL

SEQ ID NO: 6389 - protein, 180 aa, Populus trichocarpa
MGDFSIQITPELVNRFANDGEKLKKKTKKTKPKTQREPPLPKPKVNEKQLHDDSETRKRIASPGWPVQTPMYLPITQPVQPANAELDEIRSVIRESERVLEKLLKQEDNMVQKVTERAKDLRDKEFKLPYQKTMPCLADYDDCKACYKEHANDILKCAPFTKSYYECVRRAKQQQNSADK

SEQ ID NO: 6390 - protein, 139 aa, Zea mays
  misc_feature (122)..(122): Xaa can be any naturally occurring amino acid
LSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLRXPDFATIINSVTAKKVAA

SEQ ID NO: 6391 - protein, 475 aa, Saccharomyces cerevisiae YJM789
MASAVYFCDHNGKPLLSRRYRDDIPLSAIDKFPILLSDLEEQSNLIPPCLNHNGLEYLFIQHNDLYVVAIVTSLSANAAAIFTFLHKLVEVLSDYLKTVEEESIRDNFVIIYELLDEVMDYGIPQITETKMLKQYITQKSFKLVKSAKKKRNATRPPVALTNSVSWRPEGITHKKNEAFLDIVESINMLMTQKGQVLRSEIIGDVKVNSKLSGMPDLKLGINDKGIFSKYLDDDTNIPSASVTTSDNNTETDKKPSITSSSATNKKKVNIELEDLKFHQCVRLSKFENEKIITFIPPDGKFDLMNYRLSTTIKPLIWCDVNVQVHSNSRIEIHCKAKAQIKRKSTATNVEILIPVPDDADTPTFKYSHGSLKYVPEKSAILWKIRSFPGGKEYSMSAELGLPSISNNEDGNRTIPKSNAEILKGPVQIKFQIPYFTTSGIQVRYLKINEPKLQYKSYPWVRYITQSGDDYTIRLT

SEQ ID NO: 6392 - protein, 470 aa, Rhizobium leguminosarum bv. viciae 3841
MDMRPDPFVPPAPLPRTVPPSRLEIIRIILRNPLELWGEPSYTLPWIRTNFFGQRTLIVNDPGLIKHVLVDNANNYRMSDVRQLVLRPILRDGLLTAEGPVWKRSRKAVAPIFTPRHAQGFAGQMLRQSEDYARKYEGAGEAGAIFDISTDMTELTFAILADTLFSGEIVTSSGHFADDVNELLHRMGRVDPMDLMRAPSWVPRVTRIGGQKVLEKFRAIVRNTMDMRLAKMKADRSSAPEDFLTLLLEQAGPDGLTKEEIEDNILTFIGAGHETTARALAWTLYCVSNSPHIREGMEEEIDAVLATGAKPVEWLDMMPQTRAAFEEALRLYPPAPSINRAAISDDFWTSPKGERVELEAGVTVLVMPWTLHRHELHWDRPRAYMPERFLPENRASIGRFQFLPFGAGPRVCIGATFALQEAVIALAVLMHRYRFDSTDQTNPWPVQKLTTQPKNGLPMRVTPRIISTKA

SEQ ID NO: 6393 - protein, 247 aa, Populus trichocarpa
MAGIAFGRFDDSFSLGYFKAYLAEFISTLLFVFAGVGSAMAYNKLTGDAALDPAGLVAIAVCHGFALFVAVSVGANISGGHVNPAVTFGLALGGQITILTGIFYWIAQLLGSIVACYLLKVATGGLAVPIHSVAAGVGAIEGVVMEIIITFALVYTVYATAADPKKGSLGTIAPIAIGFIVGANILAAGPFSGGSMNPARSFGPAVASGDFHDNWIYWAGPLVGGGIAGLIYGNVFITDHTPLSGDF

SEQ ID NO: 6394 - protein, 483 aa, Debaryomyces hansenii CBS767
MTISETKQADREWHGPCSQLMQNSFIFQAKIAEQVPRVISGKGIRITVENPKTGKVTEVIDGMTGAAVGALGWGDPEVVEIINRAARNTFYSYPAVLGNEYSEELAKYYISNSPAGAFAAALWTGSGSESNENAMKIIRQYHVEKGNFNKTKFISRKTSYHGFTLGALSISSNARAFRFQEILLPQDQCLKMEACYPYRNKADDETLEQYSARLLLGLEIMILKENPKTIGAVIVETLPGTSLGTSPPTPGYLLGIRKLCTKYDILFMLDEVMCGTGRANPHGGLNCWENYLAPGEGPDIQSVGKALGSGYVTIAGVLVSPKVRDVFINGSGSILGSHTYSGHAFNCFVALEIQKRVKKLKLTENIFKMGNYMGGLLTEELADAVIVGDIRGLGGFWSLELVKNTQTKEYFPFSLDIAHRLQDKCFDNGLNVMGTQGCANGFGDIILLAPAFIVTKDDVDTIVHIVVMSIRDLEHELMEEGNL

SEQ ID NO: 6395 - protein, 1379 aa, Oryza sativa
MGCRALGPARFYWAVPGPIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHLGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTSSERRDRHDDSSRKRHRSLSRSRSPPRRSLERDREHNRNRDTDRSHGNDAGRERDRVREKSASRGRDDHYDRSRDREKDRRKGRLKVHYSHPLRLYNCILPVWSGLKCAKEKWMLRLETVSFCVLHGSSTDTCVMSVRFLFLFFSILLHQHWCFAYLLINMGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEIK

SEQ ID NO: 6396 - protein, 320 aa, Oryza sativa Indica Group
MSGRRDDSAKMAKLKELLHRSENRICADCSAPDPKWASANIGVFICLKCSGVHRSLGTHISKVLSVTLDQWSDNEIDNVIEVGGNSHANAIYEAFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 6397 - protein, 360 aa, Glycine max
  misc_feature (66)..(66): Xaa can be any naturally occurring amino acid
  misc_feature (347)..(347): Xaa can be any naturally occurring amino acid
GTAFPTRPIRPRTSFPSLSLRHAPPCQSHTPSSSASSPLPPPPFPPTTTSLPPPSSSRAPPTAASXSLRASFSPETLVSDNNGAPSPPPPSDPSSIEVDSVTEAELKENGFRSTRRTKLVCTVGPATCGFEQLEALAVGGMNVARINMCHGTREWHKEVIDRVRRLNHEKGFAVAIMMDTEGSEIHMGDLGGASSAKADDGEIWTFSVRAFDSALPQRTINVNYEGFAEDVKVGDELLVDGGMVRFEVIQKIGPDVKCRCTDPGLMLPRANLTFWRNGRLVRDRNAMLPTISSKDWLDIDFGISEGVDFIAISFVKSAEGITHLKSYIAARSRDSDISGIAKIESIXDYLKNLEGDRSKR

SEQ ID NO: 6398 - protein, 332 aa, Escherichia coli O157:H7 EDL933
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 6399 - protein, 992 aa, Spiroplasma citri
MEKIRLLTLEKKGILKKFLYQNEEVKLGDEIALIENENGESIITAPMDGIIVKPIKEGTKIKPNTVIAHLLTTEDEIEKYYFKRLEDKKFTRLNKKGIKFSTTKNGQYGTKWKDVEEDDYSGISIASEDTLHPTFTPPLLNQHQAYNNENIINSSAVLINDQQPYDNSILSQNFSQNSGEPLFEENTINNIPYFSTNIEQNQPINFQQQNNISSQEQLFEEPTKIKQEEHKRWDETKLSFGPKKARRLSFKNLKIDDNDIINNREKIPSIDTIKNPMNQERKSEAKSTMVNIPNLNSNMFQENNFESQTNSLNQPPLLPNQNIVTNAVSIGQAELIEQNQVKEYAKYLVNTTKQQDEAPINAAAFLGGQNENTSFRNLVNQRREQLHNNNDFHELSLESDNSKNSMDFLAEDGRPKILRNIVQGRMNDLIKRNVSPEVQTGYSSSDSNYNDNVNTFKTSEKKLSDEIYISADGYTIDPNESKEAKEKKPGYFSPLKSYRDRLYEKLNDNGQREKILKTRNQRELIKKRMEQIAKGNVEVDSVLGEISNYQRPSFEEIESQYEMLDNEYYDNNNSQQKKPNDDIIKPSSLNEKQQSSKQLIQPENHDESNHGSRTTLSLQQGVNDNNVMIELAILKERLANQEQNNRQNELLREIQSLRQVNNNTDGTSIEKMMQYMLMQQMLKTMNESDPVLKEMLKEFKFNNKQGNELKTEHNCETHNLQVKKFNSEETTIPNTYGNLVQPLNNNLNIINTNSQIEPQGLETREEIKLTRYPAIQSMIMSQAHVPPLTINSEIDMSSIIDQQRKLKNANADHGVRFSTMSFLVKAVSLVLSEYPKLNSYYDSKTNQIVIKNSQHIGLATETSEGLVIPVIKFAERMSLKQIAINIQETIERLRQGELYDYELKGSTITIANYGMVGAVNATPTIFYPNSAVIGVGRIVRKPIVIKGDKLVIRSIMNLALTIDQRIIDAAEAGIFLTRVKEILESPELITLS

SEQ ID NO: 6400 - protein, 422 aa, Galdieria sulphuraria
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 6401 - protein, 547 aa, Synechococcus sp. RS9916
MLLNRISTQTIKGDAFGGLTAAVVALPMALAFGVAATGDPGPGLWGAVIIGLVAAFFGGTPTLISEPTGPMTVVFTSVIISLTATAPDKETGLAMAFTVVMLAGLFQILFGVFRLGRYVTQMPYTVISGFMSGIGAILVILQLPAFLGQEAQGGVKGTIVRIPELLSKVDGPELALAVVTVAILWFTPGVVKRFCPPQLLALVVGTLLYILLPKELDLAVIGEFSAQLPSPQMPRFDGGQLSLMLVDGAVLGMLGCIDALLTSVVADSLTRTEHDSNKELVGQGLANIASGIFGGLPGAGATMGTVVNIQAGGRSALSGIIRAVILMVVVLVAAPLASMIPLAVLAGIALKVGIDIIDWDFLRRAHHLSVKAALITYGVIALTVLVDLIAAVGIGVFVANVLTIDRMSALQSKRVKTISTTDDDVELSVDEQQLVDHASGRVLLFQLAGPMIFGVAKAISREHNAIGECEAVIFDLHEVSHLGVTASLALENAIKEALEVGRQVYLVLLPGVTRRRLEKLRLLELIPEECITTDRCDALRRAVAGLN

SEQ ID NO: 6402 - protein, 722 aa, Vitis vinifera
  misc_feature (69)..(69): Xaa can be any naturally occurring amino acid
  misc_feature (97)..(97): Xaa can be any naturally occurring amino acid
MVLGERLGDKSDSRFCGVETEFQEDMPQLLSFNLSSSAAFDFVVAPVSLGDMTFERLGTLSRLKGLDHXFSWKLRSSNEEVISQSREEPLLLLTLLXISHLLEFLRGKLSSWIDLDSEDKILRLDSEITLKQEIAWASHLSLQACLLPTPRGASCANYARCVNQILQGLNNMQLWLRIPLEKTDDDAMDGTHDDLTFLFFAIQNGGQTDSWELWNSFRLLCEHHSQLFIALDVLSSLPSANSLGRWFGEPVRAAIIHTNSFLTNARGHPCLSKRHQKLLTAFFNHSIQMVLSGKPVHSLPKGSLELGSNDADGIQRHPLRSYLDYVGYLYQRMDPLPEQERFEPLMDNLEAQTYETFEKDTMKYIQYQRAVCKALLDRVPDEKASIVTTVLMVVGAGRGPLVRASLQAAEETGRKLKVYAVEKNPNAVVTLHSLVKLEGWENIVTIVSCDMRQWDAPEKADILVSELLGSFGDNELSPECLDGAQRFLKQDGISIPSSLKKFVLMSTDTTSVWSDDGFMHIVQGLNAHLFMNGAFGIYLTIVYVVKLHKDLVHFETAYVVKLHNVARLAPCKPVFTFTHPNYSTEKSNQRYKKLQFETLSDTGSAMVHGTMCKKFIYLQNMCFGNLFVSLYVRVGFAGYFDATLYKDVHLGIEPSTATPNMFSWFAIFFPLRTPVCIQPGSTLEVHFWRCCGATKVWYEWCVTSPTPSPIHNSNGRSYWVGL

SEQ ID NO: 6403 - protein, 401 aa, Streptococcus equi subsp. zooepidemicus
MKISVAGSGYVGLSLSILLAQHNDVTVVDIIDEKVRLINQGISPIKDADIEEYLKNAPLNLTATLDGASAYSNADLIIIATPTNYDSERNYFDTRHVEEVIEQVLDLNASATIIIKSTIPLGFIKHVREKYQTDRIIFSPEFLRESKALYDNLYPSRIIVSYEKDDSPRVIQAAKAFAGLLKEGAKSKDTPVLFMGSQEAEAVKLFANTFLAMRVSYFNELDTYSESKGLDAQRVIEGVCHDQRIGNHYNNPSFGYGGYCLPKDSKQLLANYRGIPQSLMSAIVESNKIRKSYLAEQILDRASSQKQAGVPLTIGFYRLIMKSNSDNFRESAIKDIIDIINDYGVNIVIYEPMLGEDIGYRVVKDLEQFKNESTIIVSNRFEDDLGDVIDKVYTRDVFGRD

SEQ ID NO: 6404 - protein, 300 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLAKQLIEDYDCTHASTIAVMRVPHEEVSNYGVIAPQGKAVKGLYSVETFVEKPSPDEAPSDLAIIGRYLLTPEIFAILENQAPGAGNEVQLADAIDKLNKTQRVFAREFKGERYDVGDKFGFMKTSLDYALKHPQVKDDLTDYIIKLSKQLNKDVKK

SEQ ID NO: 6405 - protein, 432 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKIRRSLTCCWLLTSSKLPMTTSRRCAMSSLMRYRTVSRFRPSPLRLPIMTATAPLFCLRT

SEQ ID NO: 6406 - protein, 251 aa, Anabaena variabilis ATCC 29413
MFSNREGQRVPQVTFRTRQNNEWVNVTTDDLFAGKTVAVFSLPGAFTPTCSSTHLPGYNELAKVFKENGVDEIVCISVNDAFVMNEWAKTQEAENITLIPDGNGEFTEGMGMLVDKADLGFGKRSWRYSMLVKDGVIEKMFIEPDVPGDPFEVSDAQTMLKYINPQAAKPKLVSLFTKVGCPFCARAKAALQENGIEYEEITLGKGITTRSLRAVTGATTVPQVFIDGVLIGGSEALAEYLSAIKQEKVGV

SEQ ID NO: 6407 - protein, 359 aa, Aeropyrum pernix
MRIEQDFSQSLGVERLKAARLHEYNKPLRIEDVDYPRLEGRFDVIVRIAGAGVCHTDLHLVQGMWHELLQPKLPYTLGHENVGYIEEVAEGVEGLEKGDPVILHPAVTDGTCLACRAGEDMHCENLEFPGLNIDGGFAEFMRTSHRSVIKLPKDISREKLVEMAPLADAGITAYRAVKKAARTLYPGAYVAIVGVGGLGHIAVQLLKVMTPATVIALDVKEEKLKLAERLGADHVVDARRDPVKQVMELTRGRGVNVAMDFVGSQATVDYTPYLLGRMGRLIIVGYGGELRFPTIRVISSEVSFEGSLVGNYVELHELVTLALQGKVRVEVDIHKLDEINDVLERLEKGEVLGRAVLIP

SEQ ID NO: 6408 - protein, 343 aa, Neisseria meningitidis MC58
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGPLKGVLGYNTLPLVSMDFNHTTEASHFDATLTKVVDGNMVKVFAWYDNEWGFSCQMLNTARRMFGLEVRPLK

SEQ ID NO: 6409 - protein, 658 aa, Neisseria meningitidis MC58
MNEFSLAPIVIVLLVSVITVILCRKFNIPSMLGYLLVGFLAGPGMLSLIPKSHATDYLGEIGIVFLMFSIGLEFSLPKLRAMRRLVFGLGGLQVGITMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVVTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKEEIISFENWSLQGI

SEQ ID NO: 6410 - protein, 193 aa, Yersinia pestis KIM
MGRWWRYKWITFHPSLTIRPYLHHSPTLGKRVMIDRSSVIIGNVILGDDVSVWPLVAIRGDVNQVIIGARSNIQDGSVLHVTHQSEHNPEGYPLIIGEDVTIGHKAMLHGCTIGNRVLVGMGSILLDGTIIEDDVMIGAGSLITPGKRLVSGYLYVGSPAKQIRPLTPLELEGLLYSAGNYVRWKDDYLAESK

SEQ ID NO: 6411 - protein, 216 aa, Pteris vittata
GHYGRGKLAMTKGSTLFLRRFRHLYHCGNGLLSSSSSAYKLSHDVCTSPLLHRSSLWARLQHSLASDPDQADERGPFSEKVLRLRDEIASLSDEELAAMSAGLRKVLGLPEPPPMGAMPMGGMAADWQEGGGDAGPAPAEEKAPEKTSFSVKIEKFEAASKIKVIKEVRAASDLGLKEAKEFVEKVPAVLKSGLTKEEASQLIDKLKAVGATAVME

SEQ ID NO: 6412 - protein, 192 aa, Triticum aestivum
MKPAVEGDERAAEIARIKAAAAAAKKAADEVVDVDDEVDEEEAVDGDDDDDDDDEVDDDGEEDEDEGVEGEEKGSAAQQVVDISDEDDDDDDDEEEEDEVDEEEEPEEELGTEYLVQPLGRAEDEEHSSDFEPEENGDGAEDEEIEDDDAEDGEDSVKPQSSSKRKRSGGEDEDDDDGDDDGDDDEKPPSKR

SEQ ID NO: 6413 - protein, 102 aa, Populus trichocarpa
MAEKTDVNAKWDACLDLSVRRFVYSSLAGAFGGLLLFRSPVSRWASVAFGAGVGIGSAYTDCSRIFQGSPAKMECPKKTSSVHKELTPLNTPSVPASQDGQD

SEQ ID NO: 6414 - protein, 1422 aa, Vibrio sp. Ex25
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTVFESMPKAGGWLRYGIPEYRLPKDILDKEIELMCRNGMQVETNKKLSVDFTLSQLSEDYDAVCLAVGASQAVEMKYPGSELDGCYLGVDYLKDYVTEQNYVTGKKVAVIGGGNTAIDCARTARRAGADTTLIYRRTRDEMPAEDYEIVEAEHEGVKFHFLTNPAENIADENGRVKAIRLERMALGEPDASGRRSPKPTGEFFTEAFDTVIAAVSQKPDLSFLENDELSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGASCSGLTLMGNSNCVQCGACVQACPTGAMVDSRDRSQGRTEQLKAVDTICTYCGVGCKLTMFVDERQNKIRYVKGADSPVNQGMLCVKGRFGFDFISSEERLTTPLIRKDGWLQPASWDEAIQLVASKLSTIKQDFGNNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHADLYLAHRPGTDVMLLNGVMQQIIKNGWYDQEYIEERVDGFDTLLQEVMSPAYNLDKVELVTGIKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGSIEIDAFVTKRMQKGVVFIPFHFVESPVNRLTTTATDPHAKIPEFKVAAVKIEISETAAQPEPVEEAVHHL

SEQ ID NO: 6415 - protein, 545 aa, Haemophilus influenzae
MQVKRLYVKLSRRQLLMRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQADVAALKNPRLNEVGTVICNPPYGERLGTTPALIALYSVFGQRLKKEFCGWNVSVFSSESTLLDCLRMRASRQFKAKNGPLDCVQKNYQVSERKSDAITDEKELEFNRTSEVAPDFANRLQKNIKKISKWAKQQELDAYRLYDADLPEYNLAVDRYADYIVVQEYAAPKNIDENKARQRLLDAVTATLQVTGVETNKLILKVRQKQKGTNQYEKLANKGEYFYVNEYGTQLWVNLTDYLDTGLFLDHRLTRKMIGELAKGKDFLNLFAYTGSATVHAALGGAKSTTTVDMSNTYLNWAEQNLILNDIEGKQHKLIQADCLQWLEKCDRQFDLIFADPPTFSNSKRMEESWDVQRDHVKLMRNLKRVLSNNGTIVFSNNKRGFKMNLVALEELGLSAIEISHKTLPLDFERNKQIHNCWMIQHI

SEQ ID NO: 6416 - protein, 324 aa, Rhizobium leguminosarum bv. viciae 3841
MTDQIIWLNAPGDVTQFHVEEHHPSEAPGNGELKIRHQAIGTNFLDVYHRKGIYPMPSYPAVIGAEAAGIVEDVGPGVSLFQKGDRVAYGGPPVGAYRSTRNIAAERAIKLPDAVSAKTAASSLLKGMTAYMLLKKTYNVRAGTQVLIHAAAGGLGSILVRWARSLDATVIGTVGSAEKAELAASYGADHLIVGRGADIVADVKRLTNGLGVDVAYDGIGGDTLLKSIRSVRPFGMAVTIGQAAGAIPPVPVEELRPGKALCHPSIMAWCADIGQYREAALAAVGAMETGIVSQIGAEYRLADVAKAHEEMESGRSAGSILLIP

SEQ ID NO: 6417 - protein, 396 aa, Physcomitrella patens subsp. patens
MGWWEWIMGLFVIVWDSLCQRISSVTLQPGLPTLSLSHLTCIITSCSPGIALETARHLAKSGAHVVFAVADVDAVRELIARWEDESTGYTNPPLNCEVMKMDCLVLDSVRKFSVDWEARKLPLNVLINISSSSYMDDTKNLSRDGYEHHMQVNHLAPALLSLLMLPSLLRGSPSRVVMVNSVVHHIGHLDADDLNLSGNKKRWNTLTAHANSKLAQLLFSNLLQRRLPKETGIDIICMHPGQVVNETATGWRGIIQKIQFNLFSPLEGARSLLFCVTDKQVQDYARALRSISYPLAPYFGSDCRPCAVARQVHDMHKANLVWQETLRLVGIPVEVVEEAVNESDPVDVTGDVKYMDVFPEVSNDEGLDFLLGSSNDNDDSFGGLDAQFLQTDFGHS

SEQ ID NO: 6418 - protein, 131 aa, Triticum aestivum
  misc_feature (13)..(13): Xaa can be any naturally occurring amino acid
  misc_feature (25)..(25): Xaa can be any naturally occurring amino acid
  misc_feature (107)..(107): Xaa can be any naturally occurring amino acid
  misc_feature (121)..(121): Xaa can be any naturally occurring amino acid
WIGQKVQIVGDDXLVTNPTRVAKAXINEKTCNALLLKVNQIGSVTESIEAVRMSKRAGWGVMASHRSGETEDTFIPLLAVGPSTGQIKTGAPCRSERLAKYTQLLRXIEEELGDAAVYAGXAKFRAPVEPY

SEQ ID NO: 6419 - protein, 84 aa, Arabidopsis thaliana
SKMYDAGSLKAGYAIFASGIKVGFPPLVFGLCVGILGNRCALSHAQNSPLFVKIFVIQIFGRALGLFGVIVGIFLFAQAPWPPK

SEQ ID NO: 6420 - protein, 376 aa, Wigglesworthia glossinidia endosymbiont of Glossina brevipalpis
MENILLNKALLILEDGTKFYGNSIGAKGTSIGEVIFNTSITGYQEIITDPSYFNQIVAFTYPHIGNIGIEINNNESSKIQVKAVILYQTHNIISDFRNKLSFSRFLLLNNIIGISGIDTRKLTRLIRKSGTQYGYVSSEGTNINFKEIKSKIKIFLEKKNLDLVKLVTTKRKIIYKKKYIEKNFFYNIVAYDFGIKFSIIKNLINLGCRITLVPATTKSKYVISLNPDGILLSNGPGNPEIYKYAIRNIQCLLETKIPIFGICLGHQLLAIANGAKILKMKFGHHGSNHPVKDLETNKIIITSQNHDFAIDKSTLSKNIIITHISMFDQTLQGIKLINKPVFSFQGHPESSPGPKDALFLFKNFINLVKDYRLNKK

SEQ ID NO: 6421 - protein, 300 aa, Prochlorococcus marinus str. MIT 9515
MTEVIDNISDFDKYLKETKKIVEEALDLSLGPENPEILRESMRYSLLAGGKRIRPILCLASCSLAGGEPSLAVPTAVAIEMIHTMSLIHDDLPAMDNDDLRRGRPTNHKVYGDAIAILAGDALLTRAFEMVSLRSPGVDPNRLLNVIGELSLVAGAPGLVGGQVVDLECEGKEVDLETLEYIHLHKTGALLKACVRTGAMIAGANDELLKALTTYAEGIGLAFQIIDDILDLTSSSEKLGKTAGKDLLADKTTYPKLLGMEESKKRAFDLVDKAKKAIEPWGLDAQYLISLADFITNRDR

SEQ ID NO: 6422 - protein, 528 aa, Borrelia burgdorferi B31
MKYTLIKKVLIYLRTYIMNTQAILVLDFGSQYSQLIARRIREIGVYTKVIPYYTPLKEIKNMNISGIILSGSPASVYSKEAPTLNMEIFNLKIPILGICYGMQIIVKLFGGLVSKDSKQEYGSSEIFLRDEKSLLFSELPNKFQIIMSHGDSIEKIPDNFKQLAFTKNCIASISNETQKIYGLQFHPEVTHSEFGDQIIKNFVFKICQAQINWSLEGNLETIVKKIKLKVGSKKVILGLSGGTDSLVCALLIKKAINENLICVFVNTGLLRKNEDKKILELKHQYDLNIKYIDASTKFLNRLKNISDPEEKRKIIGKEFVDVFEKITLEDQNIEYLAQGTIYSDVIESKSKDSSSSKIKSHHNVGGLPDKMSLKLLEPLNEFFKDEIIQIGINLGIKKESLYRHPFPGPGLAIRIIGEVTQEKINILQEADNILTEELFINDLYYQIRQAFVVLLPVKSVGVMGDQRTYEYTAVIRCVNTQDFMTAEWTELPYSFLKKVSSRIINEVRGINRVCYDISSKPPSTIEWE

SEQ ID NO: 6423 - protein, 716 aa, Mycobacterium sp. MCS
MSTENTIAWDEDADGIVTLTLDDPTGSANVMNDHYRESMHNAVNRLEAEKDSVTGVVLASAKKTFFAGGDLKGLIKLGPEDAAEAFDLAESTKADLRRLETLGIPVVAAINGAALGGGLEIALATHHRIAADVRGVVIGLPEVTLGLLPGGGGVARTVRMFGVQKAFAEILSTGARFSPPKALDIGLVDQLVQSVDELIPAAKKWIKENPEAGVQPWDAKGYKLPGGTPASPGLAAILPSFPATLKKQLKGAPVPAPRAILDAAVEGAQVDFDTASRIESRYFVKLVTGQTAKNMIQAFFLDQQSISGGASRPEGIGTTPITKIGVLGAGMMGAGIAYVSAKAGYDVVLKDVTIEAAQKGKAYSEKIEAKAVSRGQTTEEKSAALLSKITPTADAADLAGVDFVIEAVFEDQELKHKVFGEIEDIVEPNAILGSNTSTLPITGLAAGVKRQEDFIGIHFFSPVDKMPLVEIIKGEKTSDEALARVFDYTQAIKKTPIVVNDSRGFFTSRVIRTFVNEAMAMLGEGIAPTTIEQAGGQAGYPAPPLQLLDELNLELLQKISIASEAAAKDEGTTYVAHPGELVVEKMIELGRPSRLKGAGFYSYVDGKRAGLWPGLKETFNSGSTEIPLQDAIDRLLFSEALETQKCFDEGVLKTSADANVGSILGIGYPAWTGGSAQYIVGYEGPHGIGKAAFVARAKELAARYGDRFNPPASLES

SEQ ID NO: 6424 - protein, 491 aa, Brucella suis 1330
MTSQTIPVDPFDCIVFGGTGDLAERKLIPALYQRQRAGQLSDPTRIIGASRSQMTDDKYRTFAGNAIKEHVKPEEVDQAEVEIFLKRLHYVAVDAKSDEGWDALKTLIGKKPEKIRAFYLAVSPTLFGDIATRLKAHGLITRDTRIVVEKPIGRDLDSAKALNDTLGSVFREDQIFRIDHYLGKETVQNLMALRFANALYEPLWNSAHIDHVQITVAEAVGLEGRAGYYDKAGALRDMVQNHILQLLCLVAMEPPSSIEADAVHDEKVKVLRSLQPISTHNVEELTVRGQYRAGASAGGPVKGYLEDLESDTSNTETFVALKAEIANWRWAGVPFYLRTGKRLATRVSEIVVTFKPIPHSIFGESAGKVIANQLVIRLQPDEGVKQWLMIKDPGPGGMRLRHMPLDMSFAESFEDRNPDAYERLIMDVVRGNQTLFMRRDEVEAAWRWIDPILQAWEFNSQPVQGYTAGTWGPSSSIALIERDGRTWHESL

SEQ ID NO: 6425 - protein, 610 aa, Leptospira interrogans serovar Lai str. 56601
MIRSIFDSEKNCQILLLVNSVVEFETRFRMISSKRTAFPGITAFPGKLYGKVLKTGKRRNTILTGTYVHESEKEAEVEKFSVALEESLHSLRILITSLETSGPDQKEIQEILETQAMICSDPSLATSVRKRILELGENAILAVQNVTHEISEKFKAMENEFFRERVDHFQDVSNRLIEFIAGKKEEEDSFLSGLKEDLILVARELTPSQMILMDKTRIRGIATDLGGKTGHMAILARNYGIPTIVGLKDFSSHVKDNEFIFLDAESGNAIRFPTLEEVKYYGFSSSYPTEENETKKIRAITKDGIRVRIKCNLETELDCEQAIKSGAEGVGLFRSESLFLKYQDSNVSGEEQFLAYKAIAEGMQDKPVIIRTFDIGADKFSTGELEENPFLGNRGIRYSLSNPEWYSEQLTAILRASAFGNVSILLPMITGPVEITRTRKLLEECKRKLSAKKERYNKKIKIGAMIETPAAVAALDLIAREADFFSIGTNDLLQYIMAVDRNNIHVSSLYNPYHISFLRALIRIVEVSRDYDKPLSLCGELASDTDFTIFLVGIGIRELSVSIPFLSPIRKIIRSISLHQAGILVKKILELSEQENYESIEAFLFSKHLS

SEQ ID NO: 6426 - protein, 384 aa, Phaseolus vulgaris
MGLVCSKRRRFRDADAEENAQDAEIERRIELETTAEKHIQKLLLLGAGESGKSTIFKQIKLLFQTGFDDAELKTYIPVIHANVYQTIKVLHDGSKELAQNDADPSKYVISNENQDIGEKLSEIGGRLDYPRLTKELAQEIETLWEDAAIQETYARANELQVPDCTHYFMENLERLSDANYVPTKEDVLYARVRTTGVVEIQFSPVGENKRSGEVYRLFDVGGQRNERRKWIHLFEGVTAVIFCAAISEYDQTLYEDENKNRMMETKELFEWVLKQPCFEKTSFMLFLNKFDIFEKKILKVPLNVCEWFKEYQPVSTGKQEIEHAYEFVKKKFEELYFQSIAPDHVDRVFKIYRTTALDQKLVKKTFKLVDETLRRRNLFEAGLL

SEQ ID NO: 6427 - protein, 706 aa, delta proteobacterium MLMS-1
MSYLVLARKWRPRTFAEVVGQRPVVRTLQNALRLQRVAHAMLFAGVRGVGKTTLARLMAKALNCQEPEPASRPCNQCKSCQEINAGAAVDLHEIDGASNRGIQEIRELKENIRFLPVSASYKIVIIDEVHMLTTEAFNALLKTLEEPPAHVYFMFATTELHKIPITILSRCQRYELTRVAYDELLAFFRQVAAREEVTISEAALAMISREADGSVRDGLSLLDQVFSFADGGIDDDDVRQLLGLVDRRVFAQLARALLAGELGRALEIFDRGQRAGMNLKRFAADLLDYFRNLVVCRATAGARQLLELGEQELVELEEIAAAHSPETLLYCFNLLLKGIEEMQYASRPKLVLEMTMVRAVEAGQIVPTAEALGRLDQLLAGLPAEEQIAVAATPRPTARGEGKAAPGGGDTAVEAYQKPEEAAVTAGIGEPEPALAVSDHGAPHLAAIEPAHVPMYASPSRLPQDAVPRDRLPRGSRDQLPLAGVATDPGEPEPELSGADTGQAPAAAGGPEPPPAAPASPKSPATSATPTEPPPEPTPEPTPKPTPKPPPESPAGQQTGDEAPAAGVDKAAAVKGRSREGRDLRRQWDDFVRYVRQRKIWMASVLEMVAGIREENGELRLRYDDPADCKLLEETENSRLLTEFAQDFFQRELKVRLRIRGGDSKEVAANELPREERRALAGDPLVQAVTEIFNGEVVGIRTGGKK

SEQ ID NO: 6428 - protein, 196 aa, Zea mays
FFISFKGIRHQRLNSLIVFFCSFVSIKLAVRPEDPKMISRPRYAVMNTAKGPITIEIYKDASADVVDRFINLCKSNHFKGMPFRHIIKNFVIQGGDFDFDGASQEWITKAKASGKNDLSPKHEAFMIGTAKNPNNKGFDLFITTAPIPDLNDKLVVFGRVIKGEDIVQEIEEVDTDEHYQPKAAIGIIDIVLKQEP

SEQ ID NO: 6429 - protein, 507 aa, Prochlorococcus marinus str. MIT 9515
MLKTISNPLRLGLRQERVISPQCLIIFGASGDLTHRKLIPALFELYLQRRIPSEFAIVGCARRTWTDQEFKEKMKAKLGDQITGNEKEWELFSNYLFYEPVDLQQSEHVVRLSKRLNEIDKSQATHGNKTFYLSVSPNFYGSGCKALKSAGLLEDPKKSRIVIEKPFGRDYSSAKKLNKIVQSCADESQIYRIDHYLGKETVQNILVMRFANTIFEPIWNRNYISSIQITSSETVGVEDRAGYYESSGALRDMLQNHLTQMLAVTAMEPPGKFEPEAIRNEKAKVLQASKLADENQPWNCCIRGQYAKGGNSLKRLKGYRDENGVDLNSTTETYIATKVFIDNWRWQGVPFYLRTGKRLPKRLGEIVLTFKDVPVHLFESTIINPSPNQLILRIQPNEGATFKFEVKSPGSGMKSRPVEMEFSYDESFGEPSDEGYVRLLADAMLSDPTLFTRSDEVEAAWKLYTPLIELMENAPWKLPIHKYESMTWGPPESDQLLSKDNIFWRRP

SEQ ID NO: 6430 - protein, 384 aa, Phaseolus vulgaris
MGLLCSRNRRYNDADAEENAQTAEIERRIELETKAEKHIQKLLLLGAGESGKSTIFKQIKLLFQTGFDEAELKSYLPVIHANVYQTIKLLHDGSKEFAQNDADFSKYVISNVNKEIGEKLSEIGGRLDYPHLTKELAQEIENLWKDPAIQETYARGSELQIPDCTDYFMDNLQRLSDANYVPTKEDVLYARVRTTGVVEIQFSPVGENKKSGEVYRLFDVGGQRNERRKWIHLFEGVSAVIFCAAISEYDQTLFEDENRNRMMETKELFEWVLKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLFEAGLL

SEQ ID NO: 6431 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGHR

SEQ ID NO: 6432 - protein, 271 aa, Brucella suis 1330
MQDKVVLVGCGNMGFAMLRGWLDSGILKAGDVHVVEPAEALRERAALAHVHVYADAADLPADLQPRMVLVAVKPQMMANVLPAYKRFAPASTFVSVAAGIPVALFESHLGKDVAVIRCMPNTPAAIGKGMLVTFKNANVSDANEAFVTSLLKTSGKVASVDEEGLMDAVTAVSGSGPAYIFHFIEALTDAGVNLGLPRETAALLAMQTVMGAGALADASTDSPSKLREQVTSPNGTTAAALDVLMGGDRLKELVAEAVKAAHKRSVELGKS

SEQ ID NO: 6433 - protein, 78 aa, Neisseria meningitidis MC58
MSNIEQQVKKIVAEQLGVNEADVKNESSFQDDLGADSLDTVELVMALEEAFGCEIPDEDAEKITTVQLAIDYINAHNG

SEQ ID NO: 6434 - protein, 282 aa, Crocosphaera watsonii WH 8501
MQSKGVKNNQEGTALGLTISRKFINLMGGDIAMNSEVGRGTIIKFNIEVEEIKATEIKTEIKPRRKVIGLQPNQPQYRILVVDDRYSNRELVVKLLTPLGFEIRTASNGKEAIQVWQQWEPHLIWMDMKMPIMDGYEATKVIKTTMKGQATAIIALTASVFEEEKAVVLSTGCDSFIRKPFREAEIFDAMEKQIGVQFIYETDENNEQKKTKIDVHKVINSQTIANLSDAWVKDFKQAVVNVDSVTIDSLLEKIKDNNPDLARAIYHLTENFEHETLLDLLE

SEQ ID NO: 6435 - protein, 213 aa, Agrobacterium tumefaciens str. C58
MTIAKIEDAIEAISRGEMVIVVDDEDRENEGDIIAASDSITPQQIAFMMNHARGLVCVAMPGERLDALDIPLMVSRNTESLKTAFTVSVDYIPGTTTGISAADRAKTVRALVSEGSRPEDFARPGHIFPLRANPEGVLGRTGHTEAAVDLCRLAGKFPSGTICEVANDDGTMARLPQLEIFAERHGLLVVTIKDLVSYLKGEVVEEMVQKQVA

SEQ ID NO: 6436 - protein, 490 aa, Neorickettsia sennetsu str. Miyayama
MPLILCILDGWGVLPQDEYNAIYQARTPHYCTLLEKFPHSLLSASSLEVGLPEGQMGNSEVGHMTIGSGRIIYHDLVRINRELEKIDKNPQLNVFANKLKGKRCHLVGLLSDGGVHSHVAHINKISNYLTSRGVAVCIHAFLDGRDTAPKAAKRYITEENTRRIATLAGRYYGMDRDKNWDRTVEAYRVIVKPSKQQRIFEKADEAIEYYYSQGISDEFIPPSVIGDYEGAQDGDGLFIANFRPDRARQITSELIGKTSFCKDKIKFSEMMTMSQYFEESLPSLILRQQIKNTLSEIISGAGMHQLKIAETEKYAHVSYFFNGGKEAAFAREERILINSPRVKTYDLEPKMAALEVTDALIKAIKSKRFDFIVVNYANADMVGHTGNLSATIEAIETLDNCLGKLYKEACELNGYEMIVTSDHGNAECMYDHSTKLSNTAHTTNPVPFIVASQRVKHVNNGGLYNIAGTVLKLLGIEKPTELANDLICFE

SEQ ID NO: 6437 - protein, 175 aa, Triticum aestivum
  misc_feature (33)..(33): Xaa can be any naturally occurring amino acid
  misc_feature (116)..(116): Xaa can be any naturally occurring amino acid
MAPTVMASSATSVAPFQGLKSTAGLPVSRRSNXASLGSVSNGGRIRCMQVWPIEGIKKCETLSYLPPLSTEALLKQVDYLIRSKWVPCLEFSKVGFIFREHNASPGYYDGRYWTMXKLPMSGCTDATHVINEVEDVKKEYPDAYVRIIGFDNMRQVQCVRFIDFKPPGCEESGKA

SEQ ID NO: 6438 - protein, 366 aa, Triticum aestivum
MAPTAAEQHTRKAVGLAARDASGHLSPLAITRRSTGDDDVVIKILYCGICHSDLHSIKNEWKNARYPMIPGHEIAGEVTEVGKNVTKFKAGDRVGVGCMVNSCQSCESCNKGFENHCPGIIPTYNTVDLDGTITYGGYSSMVVVHERFVVRFPDAMPLDKGAPLLCAGITVYSPMKYHGLNAPGMHLGVLGLGGLGHVAVKFGKAFGMKVTVISSSPGKKQEALERLGADAFVVSKNADEMKAAMSTMDGIINTVSANIPMAPLLGLLKPNGKMIMVGLPEKPMEISPFALVAMNKTLAGSCIGGMKDTQEMLDLAAKHDVTADIEVIGAEYVNTAMERLAKADVRYRFVIDIGNTLDKAAATASE

SEQ ID NO: 6439 - protein, 263 aa, Vibrio sp. Ex25
MELDIFVVDAFTDTQFKGNSAAVVPLQEWLEPDLMQNIAAENNLSETAFVKAIGTNQYEVRWFSPLTEIDFCGHATLAASMVLFDQLGVTGSIEFHTLKVGTLTVIKNALGKIEMTFPTRAPHPVNAIPTQLIEGLNCEVTHVLLSPQAYFVIVEDEQTVFDVQYRSDQLKQLAPYDVVVTSKSSQYDFVSRYFWPANGGDEDPVTGSVHAGLAPYWAQELGKASLVAYQASARGGVLYCEVKEDCVNVSGDGVLYMKGKIYV

SEQ ID NO: 6440 - protein, 530 aa, Arabidopsis thaliana
MAVSSAFVVTPKLEKLLANHHNPTYSSSPAPLDVIGIRALPMNNRNKRGLIQRARCEISPSNKAASISALEQLKTSAIDRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDVTQHIFEVSAGLDSLVLGEGQILAQVKQVVKVGQGVNGFGRNISGLFKHAITVGKRVRTETNIAAGAVSVSSAAVELALMKLPESSHASSARMLVVGAGKMGKLVIKHLVAKGCTKMVVVNRSEEKVAAVRNEMPPGVEIIYKPLDEMLSCAAEADVVFTSTASETPLFLKEQVETLPPVRDARLFVDISVPRNVGSCVAEIDGTRVFNVDDLKEVVAANKEDRVRKAMDAQAIITDESKHFEAWRDSLETVPTIKKLRGYTERIIAAEIEKSLPKMGIDMNKKMRKTVDDLIRGIVNKLLHGPMQHLRCDGNDSRTLSETLDNMQALNRMYGLDAEILEEKIRAKVEKK

SEQ ID NO: 6441 - protein, 353 aa, Neorickettsia sennetsu str. Miyayama
MSLSPERQAAFALCAFKAGIPVIFCSFSKVVVAAPRESCDVEGFFRNYGKVGVSLLLSAERIGFHSGSSNNQSVRLSLKVVEELRLGLELLIRLAETIPASEEEELLVVLAKMAELLPEVLVSTLEFQERTDMLNFAFSNGLQVMDLDAISRGLVQQHITRVSEAKIRIRENVDSYMVCYRSILKEHYAIIIGDPLSSKEPLVRVHSSCYTGDLLGSLSCDCRDQLHDTVKKIAEDPAGGIILYLSQEGRGIGLPNKIRAYNLQEDKGLDTVEANLCLGFKDDERDFRVVRLILKDLGVQKVRLITNNPEKIRQLSSAGVDVASRVPILMRSNPYNHKYLQTKSEKLGHIFIA

SEQ ID NO: 6442 - protein, 650 aa, Oryza sativa Japonica Group
MRANSSAIYLLLAFLSHGTCSYMATTASGWDDHDFFRHCPPSRCSKDGPEIRFPHRLESSNTSSACRASCARLACSGQDTILHHPILGPCKVTSIDYKEAVINIIHLLPFPCPLQKLMVDKRIPAKIVSCSKEFTPSGTSPVPYELDHLQNAAENIFGPISCLSGTGQYFSYLVHAQLYMYLLPLDCRIVSRGSIPIPGSDSCSGPTFKEKAEKFINFAETTVSWGSFQDGVLDNCMACERQKQLCAFSSRRNQTFCTSHGNHHGTNYPNCTNMIPQLSILMQCANFPFSVNSATSSVAAFVVFSFIMATALYLSLKSRYDEEVHLKVEMFLRTYGTSKPTRYSFSDVKKITRRFKEQLGQGGFGSVYKGRLPNGVPVAVKMIEHSTGNGEEFINEVATIGQIHHINIARLLGFCSEGTRHILIYEFMPNESLEKCIFLHDPNTSQELLAPKKMLDVALGIARGMEYLHQGCNQRILHFDIKPNNILLDYNFNPKISDFGLAKLCARDQSIVTLTKARGTMGYIAPELYSRNFGEISYKSDVYSFGMLVLEMVSGRRNSDPSIENQNEVYFPEWIYEKVITEQDFVLSMGNDRRSRLKVRQMALVALWCIQWNPRNRPTMTKVVNMLTGRLQNIEVPPKPFVSYESHVVP

SEQ ID NO: 6443 - protein, 504 aa, Arabidopsis thaliana
MASNGASPRIVDATENSLDKIKRQLASGSGRNLLQGPLFKRSETLRKWNERWVILDPTTGKMEYKTRRNEPTIKGTILFDENSTISISPVNFQGLPKYNGCCIYIGTPQKKDYFLCAETPGAAKAWVTTLHATQLVLKAHKEAVESLSGSGSATLGTVATVVAAANSTALECSREIQAAMQISLRNALKITPNKPIDGPLDDLTIMKETLRVKDEELHNLARELRSRDSMIKEIADKLSETAEAAVAAASAAHTMDEQRKIVCVEFERLTTDSQRQQEATKLKLKELEEKTFTLSKEKDQLVKERDAALQEAHMWRSELGKARERVVILEGAVVRAEEKVRVAEASGEAKSKEASQREATAWTEKQELLAYVNMLQTQLQRQQLETKQVCEEKTESTNGEASLPMTKETEKNVDKACLSISRTASIPGENVVHMSEEQVVNAQPPVGENEWNDIQATEARVSDVREISAETERDRRNSLDIPVVSPEPNVPRNDPPSESFHHQP

SEQ ID NO: 6444 - protein, 200 aa, Neorickettsia sennetsu str. Miyayama
MSTLVGKKAFDFTAKAVLKNGSFCDDFNLQRELSGKYGVLFFYPLDFTFVCPTEIIAFSNRIPAFIERNAVVVGVSVDSHFSHFAWRSLPVKDGGIGSIGYTLVSDITKSISRDYQVLLDDAVALRGTFIIDPNFVIRVAHVNDLNVGRNVDEVLRTLDALKYSDENGEVCPAGWSKGKEAIKATHESISDYLASNRDEL

SEQ ID NO: 6445 - protein, 134 aa, Populus trichocarpa
MAGRGKTLGSGASKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKSGGSSKAPADDDS

SEQ ID NO: 6446 - protein, 335 aa, Magnaporthe grisea 70-15
MAQSWEQNGGIHVDPAILAVLSDVTEIIDVTEVAETKWAKATRLQVRLSNETEESYFVKVSIGMHGREALRGEFLNTSEMHSVSPDLCPKPIGWGTFETDDNSHFYICKYYDFNEDRPPVEEFCRMMAYLHSKSVSPNGMFGFHCPTYNGDAPQDNTWCGSWEVFFSRGLRHILNLRDERGSPDPELDAMLPELFDRVIPRLLRPLETGGRKIKPCLVHGDLWCGNVSVDDDTGRPVIYDPSGFWGHHEYELGNWRPSRNKFTDYISTYYKYMEPSEPVEDLDGRNLLYSLIKDDVAELLRRYPPDCLPPVDAGDEPLNIPQSGATQDNNIISAF

SEQ ID NO: 6447 - protein, 388 aa, Neisseria gonorrhoeae FA 1090
MNLHEYQAKELLASYGLPVQGGILAHNGEEAAAAYDKLGGKFAVVKAQVHAGGRGKAGGVKVVKSREKAKEVAESLIGTNLVTYQTDANGQPVNSVLVCEDMYPVQTELYLGAVVDRSTRRVTFMASTEGGVEIEKVAAETPEKIFKVTVDPLVGLQPCQAREVAFQLGLKDKQINEFAKLMTGAYKAFVENDFALFEVNPLAVRENGALACVDGKIGIDSNALYRLPKIAELRDKSQENERELKASEFDLNYVALEGKIGCMVNGAGLAMATMDIIKLKGGQPANFLDVGGGATKDRVVEAFKLILEDKSVKGVLINIFGGIVRCDMIAEAIVAAVKEINVNVPVVVRLEGNNAELGAKILNESGLKLTSADGLNDAAEKIVAAVNA

SEQ ID NO: 6448 - protein, 157 aa, Glycine max
  misc_feature (147)..(147): Xaa can be any naturally occurring amino acid
MQFLRGVGGGGGGAGSTAWEAFRRHFSRKRAVDIRRINPKVPKEEAVAISGRLLQILADHGPLTVGNTWNHAKDAAIDGLNSKTHMKILLKWMWGRRIIKLSCTQAGNTKKVLYSPFTADDAEAAEEPSPAEEQPKKKGWKGKHPKXQTKKQPAAAA

SEQ ID NO: 6449 - protein, 487 aa, Rhizobium leguminosarum bv. viciae 3841
MKAQPKASHFIDGEYVEDTDGTVIESLYPATGEVIARLHAATPAIVERAIAAAKRAQPEWAAMSPMARGRILKRAADIMRERNRVLSELETLDTGKPIQETVVADPTSGADAFEFFGGIAPAGLNGSHIPLGQDFAYTKRVPLGVCVGIGAWNYPQQIACWKAAPALVCGNAMVFKPSENTPLGALKIAEILHEAGLPKGLFNVIQGDRDTGPLLVNHPDVAKVSLTGSVPTGRRVAAAAAGNLKHVTMELGGKSPLVVFDDADLDSAVGGAMLGNFYSTGQVCSNGTRVFVQKTIKDEFLKRLKVRTEAMLIGDPMDEATQVGPMVSWAQREKVISYIEKGKAEGATLIAGGGIPNNVSGEGYYVQPTVFADVTDDMTIAREEIFGPVMCVLDFDAEDEVIARANASEFGLSGGVFTADLTRAHRVVDRLEAGTLWINTYNLCPVEIPFGGSKQSGFGRENSLAALEHYSELKTVYVGMGPVVAPY

SEQ ID NO: 6450 - protein, 322 aa, Prochlorococcus marinus str. NATL1A
MPIANDITYLVGQTPLVKLNRLPNEFNCRAEIIAKLESFNPTASVKDRIAGAMVKSAEKEGTIKPGHTVLVEPTSGNTGIALAMVAAAKGYRLILTMPDTMSTERRSMLRAFGAELQLTPGQDGIQGAIQLAKELVASVPNAYLLQQFDNLSNPEIHEKTTAEEIWEDCEGKLDALIAGVGTGGTITGCARFLKQKNPKIKVFAVEPSSSPVLSGGNPGSHAIQGIGAGFIPNVLDMNQIDEVIRINDNEAMDIGRRLAKEEGLLSGVSSGAAVAAALKVGNQPEFANKRLIVILPSFGERYLSTTMFTSIPAKPVKGNEFL

SEQ ID NO: 6451 - protein, 415 aa, Centella asiatica
MGSLGAILKHPDDFYPLLKLKMAARHAEKQIPPEPHWAFCYSMLHKVSRSFGLVIQQLGPQLRDAVCIFYLVLRALDTVEDDTSISTEVKVPILKAFHRHIYDNNWHFSCGTKEYKILMDEFHHVSNAFLELGSGYKEAIEDITMRMGAGMAKFICKEVETIDDYDEYCHYVAGLVGLGLSKLFHASGAEDLASDSLSNSMGLFLQKTNIIRDYLEDINEIPKSRMFWPRKIWNKYVNKLEDLKYEENSVKAVQCLNDMVTNALLHVEDCLKYMSDLRDPAIFRFCAIPQIMAIGTLALCYNNLQVFRGVVKMRRGLTAKVIDRTNKMSDVYGAFYDFSCMLKTKVDNNDPNATKTLSRLEAIQKKCKESGVITPNRKSYVLENDSGYNLVLIAILFIILALVYAYLSSNLSNNR

SEQ ID NO: 6452 - protein, 334 aa, Escherichia coli O157:H7 EDL933
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYAGVPVWNGLTNEFHPTQLLADLLTMQEHLPGKPFNEMTLVYAGDARNNMGNSMLEAAALTGLDLRLVAPQACWPEAALVTECRALAQQNGGNITLTEDVAKGVEGADFIYTDVWVSMGEAKEKWAERIALLRDYQVNSKMMQLTGNPEVKFLHCLPAFHDDQTTLGKKMAEEFGLHGGMEVTDEVFESAASIVFDQAENRMHTIKAVMVATLSK

SEQ ID NO: 6453 - protein, 223 aa, Anabaena variabilis ATCC 29413
MSNIQLYFAKASTFSQRTRVALLEKGIDFTPIEIDLQNKPDGYIQISRYGKVPAIQHGDVIIYESAIINEYLEEAFPEPPLLPHDPANKAIARIWIDYANTRLVPAFNKFLRGKDHQEQEQGRKEFTEALLYLEQEGLSKGDYFLGNQFSLVDISFYPWFERLPLLEHFRKFTLPAETTHLQTWWDLVRDRSSIQAVANPVDFYLQRFAKIIGEPVAIGAGQK

SEQ ID NO: 6454 - protein, 548 aa, Erwinia carotovora subsp. atroseptica SCRI1043
MEIFFTILILTLVVSLSGVVTRILPFQVPLPLMQIALGAILAWPQFGLHVDFNPELFMVLFIPPLLFADGWKTPTREFLRHGREIIGLALVLVLITVVGIGYFIYWMVPGMPLIAAFALAAVLSPTDAVALSGIVGEGRIPKKLMGILQGEALMNDASGLVSLKFAVAIAMGTMVFTVSGATLEFVQVALGGLLAGVGVTWIFGKSLRVISRWSGDDAATQIVLLLLLPFASYLIAEHIGVSGILAAVAAGMTIGQSGVIRSAPLTMRMRANGVWSMLEFVFNGMVFIMLGLQLPDILETSVTQAELDPTVETWMLFTDIAIIYGALLLLRFSWLWVMRTYSVHIQKKRPMVFAEFSTRELWIASFAGVRGAITLAGVLSIPLLLTDGTAFPSRYQLVFIATGVILFSLLCGVLALPFLLRGVVVADKAAHAKEIRMARMAVAEVAIKSMHKMEERLAADREENIDEQVLKEVSARVIGNLRRRLINKDDPENGLLIENLERRFRLTALNSERAELYHLRATQQISNETLQKMLRDLDLMEALLIENE

SEQ ID NO: 6455 - protein, 455 aa, Physcomitrella patens subsp. patens
MLYMGTPRDYEFYIAARVMLGTLVRLQVDADVVVLASANVPPHWQKTLIEEGAKVVVVNDIQNPYRDQNEFDKRFMFTLNKIYAWSLTQYQRVVMLDVDNLFLRAPDELFQCGQFCAAFINPCIFHTGLFQYALLSNILLIFCVIQPSNETFSIMMHDISIGKENKDGADQGFLVNHFNDLLDQPLFHPPADGSRLTGLFRLPLGYQMDASFFYLKLKWRIPCGPNSVITFPSVPMLKPWYWWSWPTLPLGLLWHEKRVATIGFMVETPILIAESLLYIIIMLLALIIRQKCASSEKSSMARISCFGRGPCAEKSLYRPWSIKVIILGLVTGSFLLPAFTIPTTVHPFMGWGVFLLGSFSLLTLVINVFQLPALAVLTPWLGGIGALLTLGSPIYTNGIMRGVGIGVYTAMTTPFLWWAAKRVSGVVDVKAHWEPLMAWTSLRSEPASEILMKLC

SEQ ID NO: 6456 - protein, 455 aa, Pectobacterium carotovorum subsp. carotovorum
MQTQPSSFPLLDQWVAQQRQHLASYAPVEKKGRVMAVSGILLECSLPQARIGDLCWVARQDDSQMMAEVVGFSPDNTFLSALGALDGIAQGATVTPLYQPHCIQVSDRLLGSVLDGFGRALEAGGESAFVEPGHATGRTQPVLGDAPPPTSRPRISQPLPTGLRAVDGLLTIGQGQRVGIFAGAGCGKTTLLAELARNTPCDAIVFGLIGERGRELREFLDHELDDELRSRTVLVCSTSDRSSMERARAAFTATAIAEAYRAEGRQVLLIIDSLTRFARAQREIGLALGEPQGRGGLPPSVYTLLPRLVERAGQTEDGAITALYSVLIEQDSMNDPVADEVRSLIDGHIVLARRLAEQGHYPAIDVLASLSRTMSNVVDTEHTRNAGGVRRLMAAYKQVEMLIRLGEYQPGHDELTDSAVNAQAEITQFLRQSMREPMPYGVIQQQLAGVSRYAP

SEQ ID NO: 6457 - protein, 738 aa, Brucella suis 1330
MAYVNFKVETDADGIALVTWDMPEKSMNVFTVDAMQELNAIIDAVIADDKIKGVVITSGKETFSGGADLTMLEGMFKEFQKQKVKDPEGAVQTLFDNVGKMSGLFRKLETCGKPWVSAINGTCMGGAFEMSLACHARVASDAPGVKMALPEVKVGLFPGAGGTQRVPRLANQQDALQMMTTGSSLTAQRAKAMGLVTEIAPAKKLVETAKKLIKGGLKPVQPWDEKGFKLPGGAIYSAAGANLWPAATAILRRETSGNYPAALAILKSVYEGLLVPFDTGLKIEQRYFTEILQMTEAGMMIRSLFVSLQELNKGARRPVDEKPTRLKKIGVIGAGFMGAGIAYVTAKAGIPVVLIDRDQESADKGKAHTADLITKEMQKGHATEADKEKLLSLITATPDYAQLEGADLVIEAVFEDREVKRVATEKAEEVLKSSAVFASNTSTLPITGLAKVSKRPKNFIGIHFFSPVDKMMLVEVILGKKTSDKALAVALDYVRAIKKTPIVVNDTRGFYVNRCVLRYMSEAYNMLVEGVPAAMIENAARMAGMPVGPLALNDETAIDLSQKILKATLADLGPKAVDPRHVELVDKLVNEFDRKGRKNGKGFYDYPAKPAKKHLWPGLKDLYPQQNPDKIDVKELKERFLVTIALEAARVMEEGIVTDPREADVGSILAFGFAPYTGGTLSYIDGMGAKKFVQLAKDLQKKYGAQFKAPKLLLDMAENGETFYQRFNPYKGETKKAA

SEQ ID NO: 6458 - protein, 429 aa, Candida albicans SC5314
MGCGASVPVDDDEIDLFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDADVAGGTDFLNDFVVKYSEENKNKRRLKSTGTTDIWGKDDDSNINSDAINQALESSLNKDSEQFTRLSIAEAIHKLWKLDSGIKKCFDRSNEFQLEGSADYYFDNVFNFADTNYLSTDLDILKGRIKTTGITETDFLIKSFQFKVLDAGGQRSERKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGII

SEQ ID NO: 6459 - protein, 510 aa, Mycobacterium bovis AF2122/97
MTTQISHFIDGQRTAGQSTRSADVFDPNTGQIQAKVPMAGKSDIDAAVASAVEAQKGWAAWNPQRRARVLMRFIELVNDTIDELAELLSREHGKTLADARGDVQRGIEVIEFCLGIPHLLKGEYTEGAGPGIDVYSLRQPLGVVAGITPFNFPAMIPLWKAGPALACGNAFVLKPSERDPSVPVRLAELFIEAGLPAGVFQVVHGDKEAVDAILHHPDIKAVGFVGSSDIAQYIYAGAAATGKRAQCFGGAKNHMIVMPDADLDQAVDALIGAGYGSAGERCMAISVAVPVGDQTAERLRARLIERINNLRVGHSLDPKADYGPLVTGAALARVRDYIGQGVAAGAELVVDGRDRASDDLTFGLPEGDANLEGGFFIGPTLFDHVAAHMSIYTDEIFGPVLCMVRARDYEEALRLPSEHEYGNGVAIFTRDGDAARDFVSRGQVGMVGVNVPIPVPVAYHTFGGWKRSGFGDLNQHGPAAIQFYTKVKTVTSRWPSGIKDGAEFVIPTMS

SEQ ID NO: 6460 - protein, 294 aa, Glycine max
MATSLLSFSISPTTSAFRFKASAMATTIAAPATKVAPAVIVGGGRVGRALQDMGTGQDLLVRRGESVPLNFEGPIFVCTRNDDLESVLQSTPSSRWGDLVFFQNGMLEPWLESKGLEDANQVLAYFAVSKIGETPIDGRTDINPEGLTAAYGKWASIVAARLNAGGLSCKVLDKEVFQKQMLEKLIWICSVMLVGARHGGVSVGVVDKEFRTELSSLITELASAASSEKGLTFEEAMEERLCAYSRAVAHFPTAVKEFKWRNGWFYSLSEKATAQGKPDPCPLHSQWLKELRIV

SEQ ID NO: 6461 - protein, 327 aa, Rhizobium leguminosarum bv. viciae 3841
MPRYILVTGGAGFIGSHICKALSRAGMIPVTYDNLSTGHADSVRWGPLIRAELADAAALRRTLAEFSPDCVIHCGANAYVGESVEMPRKYYRNNVVGSLTLLEACLDQDIDRIVFSSSCATYGVPASLPIREESPQHPVNPYGRTKLIFEMALEDFAAAYGIRFAALRYFNAAGADPDGELAERHQPETHLIPRALLAAAGRLERLDIFGTDYATEDGTCVRDYIHVSDLAQAHLAAVNHLLADGGSLSVNLGSGRGTSVREILEAIHRASGREVPVRYRSRRVGDPPILFANTARAKAELGFAPAFSDIDTIIRTAGPTFGLEMRA

SEQ ID NO: 6462 - protein, 351 aa, Oryza sativa Japonica Group
MPPVNSDGAGPSSGEDGSAAAVKKRNRPKYHRFTQQELQACKPILIPQTVILVLVFVGLIFIPIGLACIAASNKVVELVDRYDTKCVPRNMLRNKVAFIQNSSIDKTCTRVFKVPKDMKKPIYIYYQLDKFYQNHRRYVKSLNDMQLRNPKKVADTQYCSPEATANGRPIVPCGLIAWSLFNDTYSFTRGHGNETLRVNKDGISWKSERNRRFGKNVYPKNFQNGTLIGGGQLNPSKPLSEQEDLIVWMRIAALPTFRKLYGRIDMDLQAGDRVEVTMQNNYNSYSFNGKKSLVLSTAGWLGGKNAFLGRAYAIVGLACFLLALLLALLYFVFPMREEHLSLHYTPARLVR

SEQ ID NO: 6463 - protein, 552 aa, Methanococcus maripaludis S2
MKINNNLNYENLKNDLFAGFTIAIVALPLAMAFAIASGVSPEKGLFTAIIAGFLISVFGGSKYQIGGPTGAFVVILYGIIASYGYEGLVIATLMAGVILIIMGLLKLGNIIKFIPYPVTMGFTSGIALIIFSTQVKDFFGLSITNVPATFLGQWITYATNIQLLNPYALLISILSLVILTKSKKVFSKIPSPIIAIIVGIVLVYAFNLPVETIESKFGQIPNSIPFPSLPELNFQKMELLFPSALSIAFLGAIESLMCAVVADGMTGYKHNSNKELIGQGIANIGSVLFGGIPATGALARTATNIKAGATSRLSGIIHSVMLFLFMLLLSPLILKIPLATLSAILVVVAWNMAEVKHFKSILFKSPKRDRIVLLVTFLLTIFVNLNTAIQIGMLLAVIVFMQRLIEVSEISNLKTVPQEEDPDSITLKDVPPCIEVYEINGPFFFGIADKFKSTLNVVAKRKPSAIILRMRNVPIIDSTGIKNLEEFIESSKIQNISLIISGADYKLRAKFEKYGLTDKIGNENICENIDLALVRAREIIKIKHPETGLCPK

SEQ ID NO: 6464 - protein, 180 aa, Neorickettsia sennetsu str. Miyayama
MFIQTEHTPNPNVLKFFPGVKILDSGTADFVTFSDASGHKLPEMLWEIQGVCGVMLGVDFVSVSKTEDAEWDVLKPQIFGVLVEYFTTGSDFVRPVTEDEEVECTDEVSKKIQEIIDTKVRPSVIEDGGNIVFKGYKDGIVYLKLQGACAGCPSASVTLKDGIENLLQYYIPEVREVQQV

SEQ ID NO: 6465 - protein, 344 aa, Arabidopsis thaliana
MVNPVIGAEIKCPFCQSGFVEEMSREINGGSSSSLREVQDPEIDFGTDRALSLWGPILLGMMSNPRRRRRFRRTEFGVDNDEVNVSDDVDGNDSVDIDRHHHRRHRHRQQGREIDLDREFESILRRRRRSSATILQLLQGIRAGIASEYESSDRDLLNQSAVVQGSTSLNQNRNNTSLSAIGDYFVGSSLDHLLEHLADNDSIRHGSLPARKEVVDNLPTVKISESLQCSICLDDFDKGSEAKEMPCKHKFHIRCIVPWLELHSSCPVCRYELPPDDETKVNPVRPRTRTLEINVSNENVEDDARNSNVSERRFSFPWPFSGLFSSSSSSSASASGSSHLGENS

SEQ ID NO: 6466 - protein, 194 aa, Brassica napus
  misc_feature (88)..(88): Xaa can be any naturally occurring amino acid
  misc_feature (105)..(105): Xaa can be any naturally occurring amino acid
MYSSDDIWNYDMYCFKKKKKKKKKKSESTQPSRMEEHGFESTTISDVMNAKGKSADGSWLWCTTDDSVYDAVKSMTQHNVGALVVVKXPGEQQSLAGIITERDYXRKIIVQGRSSKSTKVGDIMTEENKLITVTPETKVLVAMQLMTDNRIRHIPVIKDKGMIGMVSIGDVVRAVVTEHREELNRLNAFIQGGY

SEQ ID NO: 6467 - protein, 567 aa, Yarrowia lipolytica CLIB122
MLRINLRALSHVRQPLARPLGLSRSLHQHVSPKQTDFNVIQSKIDPLSADFAEKKKGFEVLANKLASIHEQVTDPAFIPEKIKTKHLAKNKILPRDRITALIDPGTSFVELSLLAGHEMYGKDKVPAGGIITGLGQVNGVTCMIVANDSTVKGGTYFPITVRKHLRAQEIAMQNKLPCLYLVDSGGANLPHQADVFPSHNHFGRIFFQQSRMSSAKVPQLSLVLGPCTAGGAYVPAMSDESIIVKGGGHIFLAGPPLVKAATGEIVSAEDLGGGEMHSSVSGVTDYLVESEQEGIERLRECVKNLNYPQNNGHVTYNQTPAPIEEPLYDPKELGGIVGDNLRISYDVREVIARIVDGSRFSEFKAKYGESLVCGFATIHNHKVGILANNGPLYSESSLKGAHFIQLCKQRDIPLVFLQNISGFMVGSEAERGGIAKNGAKLVNAVVGSGVERFTVVIGGSYGAGNYGMCGRAYDPRFLFTWPNSRTAVMGAEQLAQVMESVRSEKGHADALRERVEHESMAEFGSARLWDDGVIKPEDTRKYLALALEASRGGVRQKEDTDFGIWRM

SEQ ID NO: 6468 - protein, 375 aa, Mycobacterium bovis AF2122/97
MKTKGALIWEFNQPWSVEEIEIGDPRKDEVKIQMEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 6469 - protein, 264 aa, Oryza sativa Japonica Group
EPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRTDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 6470 - protein, 457 aa, Acinetobacter sp. ADP1
MPKEANMASQDYATQRSSLDAQALINDAPLSRYQWLIAIVCFLIVFVDGIDTAAMGFIAPALAQDWGVDRSQLGPVMSAALGGMIIGALVSGPTADRFGRKIVLSMSMLVFGGFTLACAYSTNLDSLVIFRFLTGIGLGAAMPNATTLFSEYCPARIRSLLVTCMFCGYNLGMAIGGFISSWLIPAFGWHSLFLLGGWAPLILMLLVIFFLPESYRFLIVKGKNTKKVRQILSRIAPQKVQGVTEFHVPEEKVEAGTKKGVFGMLFSAKYVKGTVLLWVTYFMGLVMIYLLTSWLPTLMRETGASLERAAFLGGLFQFGGVLSALFIGWAMDRFNPNRIIAGFYLAAGIFAVIVGQSLSNPTLLALFILCAGIAVNGAQSSMPVLSARFYPTQCRATGVAWMSGIGRFGAVFGAWIGAVLLGNNWSFTMILSMLIIPAAAAAIAIFVKSLVAHTDAT

SEQ ID NO: 6471 - protein, 477 aa, Neisseria gonorrhoeae FA 1090
MSQYDVVVIGAGPGGYVAAIRAAQLGFKTACVDAGVNKAGNAPALGGTCLNVGCIPSKALLQSSEHFHAAQHDFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 6472 - protein, 393 aa, Neisseria gonorrhoeae FA 1090
MIIDVKVPMLSESVSEGTLLEWKKKVGEAVARDEILIDIETDKVVLEVPSPQAGVLVEIVAQDGETVVADQVLARIDTAATVAAEAPAAAPAEAAPAAVPAAAQNNAAMPAAAKLAAETGVDVNVLQGSGRDGRVLKEDVQNAAAKPAAAVAPAVALPAGARPEERVPMSRLRARVAERLLASQQENAILTTFNEVNMKPIMDLRAKYKEKFEKEHGVKLGFMSFFVKAAVTALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPVRLLLDL

SEQ ID NO: 6473 - protein, 365 aa, Neorickettsia sennetsu str. Miyayama
MSYDSCLAFAGGECFFGFSYGKRDVAVGEVCFTTGMTGYQHTITDPSFSGQIILFAFPHIGNVAINSCDNESSRIFARGLVFREGPQDFLHHLRMRSFSSWLEDNNVTAIYGVDTRAITRLVRLKGNQGGIIFPVNDISIDEAILLLRETEDMNGNELATSASGNARCSPCCVGDKRKKVCVVDFGIKDGIVRNLEKYFTVVVVDGKKGFSSALESEDFAGIVLSNGPGDPSATYLQLCEDFSRVLTSNLPVLGICLGHQLLLLAFGCKTKKMLVGHRGTNHPVINLETQRVEITSQNHGFVLDESTLNSKDIIVTHRSLFDGSVEGIKIKDRKIFSVQYHPEGSPGPHDSHYIFSKFFNEISSQ

SEQ ID NO: 6474 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 6475 - protein, 344 aa, Triticum aestivum
  misc_feature (88)..(88): Xaa can be any naturally occurring amino acid
  misc_feature (104)..(104): Xaa can be any naturally occurring amino acid
DIASTTIVQKSSGLVPGPEFPGYRRPTRPYADLGIDETDIFVSDGAKCDISRLQVLFGSKVKIAVQDPSYPAYVDSSVIMGQTDLYQXDVQKYGNIEYMRCSPXNGFFPDLSKVPRTDIIFFCSPNNPTGAAASRDQLTRLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFSGRNSWDVFAEILEKANVVTTPGSGFGPGGEGFVRVSAFGHRENIIEAARRLKQLYK

SEQ ID NO: 6476 - protein, 636 aa, Magnaporthe grisea 70-15
MVSSSKEKRLAKKAAEGKEPKKTVASRSKAGSKAGSKVASATGSVNGDEPELDANGNPIVSDEPATGSDKADEVKRLADQMDKHGLSDRVTTGVLASLEQSKDVKITSASLVFHGRVLITDTTLELNFGRRYGLLGENGCGKSTILKAIAAREYPIPEHVDIYLLNEGAPPSELGALEWVVTEAENELKRLDALAEKLLEEEGPESPVLMDLYEHMDKMDPSTFSTRASLILTGLGFNKQTIHKKTKDMSGGWRMRVALGKALFVRPSLLLLDDPTAHLDLEACVWLEEYLKKWDRTLVLVSHSMDFLNGVCTNMIDMRMRQLIYYGGNYDSYMKTRSEQETNQMKAYHKQQEEIVHIKKFIASAGTYANLVRQAKSRQKILDKMEADGFIQPVHQDKVFTFRFADVEKLPPPVLSFDNVSFAYSGEAKDDLYKNLDLGFDMDSRTALVGPNGVGKSTLLRLMTGKLSPREGAVTRHTHLKMGLYSQHSAEQLDLTKSALDFVRDKYSSKSQDYQYWRQQLGRYGLTGEAQTSLIGTLSDGQKSRIVFALLAIESPNMLLLDEPTNGLDIPTIDSLADAINAFSGGVIVVSHDFRLLDKIAKQILVCENKTIKPWDGTIGEYKNYLRKKMLAAGAV

SEQ ID NO: 6477 - protein, 45 aa, Glycine max
MKVCQIKSSLLEGILVGIVLLIILKSGLCCMMGIDTPTRFETPQE

SEQ ID NO: 6478 - protein, 476 aa, Rhodopirellula baltica SH 1
MQDYRHTKIIATIGPATESPEKLAALIEAGVDVMRLNMAHGTPEWVGEIVARIRKVSKDISRHVAVMMDVKGPEIRTGAVEDAIELKAGDELVLFTEDCADQSAVESDGTPRVSVNYLGLPGAIDLDSTILVDSGLLHWHVLKKDATTVRCRVITPGVLESRRHINLPGVQVNLPAITDKDRTDLAAGVKAGIDFVALSFVRQAEDVRTLRAFLDEHGSPARIISKIEDQAGVRNMKAIIRQSDAIMVARGDLGVEIDYHRLPLVQTDLIRACQEDGKPVIIATHLLESMIQSPVPTRAEVSDVSNAIREQADAVMLSGETTTGKYPLESVGVLQNIVASIEPTVSRQLNSKIVLREPKSMMLRSACTLAQEMGDSGIVVFTRSGFLAYVLGALRPRGVPIFAFTDVEHTFRHLMLPWGVEPFFMEFSEDHDQTITNALEVLKESGWCKPGVWLGVITNALADEKIIDTLQLRQVQ

SEQ ID NO: 6479 - protein, 412 aa, Physcomitrella patens subsp. patens
MERKWLSPLLASTMISILLLLLATLNLGYRGHHPSIGTNRMDPSRAQNVQEITEEEQMAGLPPPPKLAYLISGTKGDGFRMQRTLQALYHPHNYYLLHLDLEAPEKERMDLAVYVKHEPVFQEAGNVFVVGKANLVTYKGSTMIATTLHGAAILLRKAKDWDWFINLSASDYPLITQDDLLHVFSYLPKDLNFIEHTSDIGWKEEQRVKPIIIDPGLYQKTKTDIYWMTQRRAVPSAFRLFTGSAWVVLSRSFIEYTIMGWENLPRTVLMYYANFVSSPEGYFHTVLCNSQEFRNTTVNHDLHFIAWDTPPKQHPLSLTVKFFKDMSNSGAPFARKFNKDDPVLDKIDAELLHRKKHGFSPGGWCVGPDDNPCSVRGDYSLLKPGPGARRFEDLVVRLLLPENFRSRQCVGV

SEQ ID NO: 6480 - protein, 200 aa, Rosa chinensis
MLCDASASSPMAYREEPAAPSSPASLLMNLGQTLTHIQSGVTKKRKAGRKKFRETRHPVYKGVRQRNGKWVCEMRQPGLKKSRVWLGTFTCPEMAARAYDVAALALKGESAQLNFPDEAKASPSWTSSMSLPELTSMVNLEKVEVGSSKGYVDEEELFNMPEILDSMAEGLILTPPALKKGFNWDDYDLENAVEFSLWSD

SEQ ID NO: 6481 - protein, 176 aa, Triticum aestivum
  misc_feature (9)..(9): Xaa can be any naturally occurring amino acid
MAPTVMASXSGTSVAPFQGLKSTAGLPVSRRSNGASLGSVSNGGRIRCMQVWPIEGIEKFETLSYLPPLSTEALLKQVDYLIRSKWVPCLEFSKVGFIFREHNASPGYYDGRYWTMWKLPMFGCTDATQVINEVEEVTKEYPDAYVRIIGFDNMRQVQCVIFIAFKPAGCDESGKA

SEQ ID NO: 6482 - protein, 410 aa, Rhodococcus rhodochrous
MSTTAQKLAELREKLEIAKEPAGELAIAKRAKKGIPSARERIDMLLDRGSFVEIGALMKTPGRDDAMYGDTVVVGHGTVDGRPVAVFSHDQTVFGGSVGEMFGRKVAAVLDFALKIGCPVVGINDSGGARVQDAVTSLAWYGEIGKRHEPLSALCPQISVIVGNCAGGAVYAPINTDVVVATEGSHMFVTGPDVIKAVTGESVSLEELGGARQQAEYGNVHHIAPDEKAAFEWVRQYLSYMPSNAQEKPPVINPGLEPEITPDDLELDTFMPDADNSGYDMHDILLKIFDDGEFLEVRSQTAPNIITGYARVDGHAVGVVANQPLYLSGALDAAAADKAAHFVRVCDAYDIPLVFVVDTPGFLPGVEQEKIGIIKRGGRFLFSYVEASVPKVTVVVRKAYGGGYAVMGSK

SEQ ID NO: 6483 - protein, 472 aa, Brassica napus
MVLGAAARVAIVGCRRLVCSSSHASPLLVSSQCRQMSMDAQSVSEKLRSSGLLRTQGLIGGKWIDSYDKTTIKVNNPATGEIVADVACMGVKETNDAIASSYEAFQSWSTRTAGERSRVLRRWFDLLVAHKEELGQLITLEQGKPLKEAIGEVAYGASFIEYYAEEAKRVYGDIIPPNASDRRLLVLKQPVGVVGAITPWNFPLAMITRKGGPALASGCTVVVKPSELTPLTALAAAELALQAGVPPGALNVVMGNAPEIGDALLASPQVRKITFTGSTAVGKKLMAAAAPTVKKVSLELGGNAPSIIFDDADLDVAVKGALAAKFRNSGQTCVCANRVLVQDGIYDKFAEAFSEAVQKLEVGDGFKEGATQGPLINDAAIQKVESFVQDAVSKGAKVLLGGKRHSLGMTFYEPTVIRDVTSNMIMSRGGFRAPVAPLIRFKTEEDAIRIANDTIAGLAAYIFTNSVQRSWR

SEQ ID NO: 6484 - protein, 301 aa, Bacillus sp. SG-1
MVSPFDEQEGIQEVVSGYIGGDKKNPSYKEVVSGVTGHREAVQITFDPDIFPFEKLLELYWQQIDPTDAEGQFSDKGIAYTTAIYYHSEEQRRKAEKSKEELAGSGRFNKSIVTEILPAQPFYPAEEYHQDFYKKNNFRYELYQRGSGRRDFLKKYWPKDTSHLREKLTPLQYYVTQENGTEPPFENEYWDNKRDGIYVDIVSGEPLFTSKDQYDSGCGWPSFTKPVMSASVKEKYDLSHRSTRVEVRSREADSHLGHVFEDGPGKNGLRYCINSAALRFIPVENFEKEGYGDFKILFPGK

SEQ ID NO: 6485 - protein, 528 aa, delta proteobacterium MLMS-1
MDNSQENRRLEDFGACTLLNGAELPSCSIVIFGASGDLTARKLVPALQNLFRQRCLPPRCYIVGCGRSTMDHQEFRQSLAEFQQGTREDDWRADWPEFATRIFYQPLRYDQPEDYQALAALLSKLDREQNVDPNRVFYLAVPPALYPTIGARLGAAGLSAAGPEEHSTGRDAPLATAPDHTPWARIVVEKPFGHDLPSAVSLDKVLHGSFREKQIFRIDHYLAKETVQNILMLRFANTIFEPLWNRSYIDYVGIVSAEKLGVEHRAGFYESAGVLRDMFQNHMMQLLALTAMEPPSRFEATQVQDEKVKIFRALKPLDPTSLAANLVLGQYGPGQSDGQPVPGYRQEPEVANASTTPTFAAMRLWLDNWRWRGVPFYLVSGKRLPAKETRIVIQFKEVPHSMFNRELAAGLDANRLVLGIHPQEKISLNFQAKNPGTKECLQPVTMDFNYERRADGQSRLDAYEMVLLDCILGDHMLFWRQDGIELSWAFLDPILRACEECHDPAGLLHLYPAGSPGPEAARPWLEFL

SEQ ID NO: 6486 - protein, 453 aa, Arabidopsis thaliana; identical to SEQ ID NO: 1137

SEQ ID NO: 6487 - protein, 365 aa, Leptospira interrogans serovar Lai str. 56601
MSLNCGIVGLPNVGKSTIFNALTKAGAQMENYPFCTIEPNKGIVEVPDLRLNRLAEIAKPQKVVPAIIEFVDIAGLVKGASQGEGLGNKFLSHIREVDAICHVVRAFEDENVTHVHGKVNPVEDAAIVNMELIFADLDSADKQFQRVSKNAKNGNKEAQEHASVLEKILTLLKAGKPARLAELKDEEKKIAKSFQLITLKPVMYVANIADKDAAKKDTPLLNQIRQMAKEENAELVILCGRFEEEISGLDRNEQLEFLKEIGETESGLDRMIKTAYKLLGLITFFTAGEMEVRAWTTPFNSTGPKAASVIHSDFEKGFIRAEVMSYEDLDRAGTQTKVKEEGKLRIEGKEYIVQDGDVIYFRINA

SEQ ID NO: 6488 - protein, 364 aa, Chlamydia muridarum Nigg
MSIEVRIPNIAESISEVTVSALLVASGDFVQENQGILEIESDKVNQLIYAPCSGRVEWSVSVGDTVAVGSVVGTICKLENQDTPSIHEQMPFSLVEQESDAQIISFPSSVRQDPPAEGKTFVPLKEIERDSSDKKESRESMSAIRKTISRRLVQALHDSAMLTTFNEVCMGPIIALRKEKQEAFVSKYGVKLGFMSFFVKAVVDSLKKYPRVNAYINGNEIVYRHYYDISIAVGTDRGLVVPVIRNCDRLSCGEIEVQLADLASRARDGKLAIHELEGGSFTITNGGVYGSLLSTPIINPPQVGILGMHKIEKRPVVKDDSIIIADMMYVAMSYDHRIIDGKEAVGFLVNVKELLEQPELLLTI

SEQ ID NO: 6489 - protein, 193 aa, Arabidopsis thaliana
MSISVMANSHLNQPYASASPTPQEKGRTCRYAGQAVRALPIRVITVGKKRSEGVRLLVDEYKIKLKPYCSFEDSLVRSNPRNAQDVRAQVEDEEVAMMKLIGSDDWVVVLDERGRDIDSEQMAELLGDAGNSGASRISFCIGGAYGHGTQVRKRANVTIRLSSMVLNHQIALVVLMEQLYRSWTILKGQNYHH

SEQ ID NO: 6490 - protein, 427 aa, Vibrio vulnificus CMCP6
MSFASQGFAPEVVKALEECGYEKLTPIQQKAIPVARRGHDIFATAQTGTGKTAAFSLPLIQQLLESGKSASRKTARALIFAPTRELAEQIADNIKAYTKYTNLSVAAIFGGRKMSSQERMLENGVDILVATPGRLEEHIESGNVSVANIEFLVFDEADRILDMGFINAVRKIMLDVETNPQIMMFSATTSSQLNELSKDILRKPKRIAVERENTTAHTVAHVLYPVDQERKTELLSELIGRKNWQQVLVFVNYKETANDIVKELKLDGIKANVCHGDKAQSARRRALEEFKEGKVRVMVATDVAARGLDIEDLPHVVNYDMPFLAEDYVHRIGRTGRAGKQGHAVSFVNREEELTVVQVENLIQQRIRRIELAGYEPKSREAYIDKLNSKPSFKNRQGRRNNANEPTDQAAAERRLAMMKRIKARRN

SEQ ID NO: 6491 - protein, 189 aa, Gossypium anomalum
HVGLNGNGKPFVACHDCNFPICKTCFDYELKEGRKACLRCGNPYDENLLDDAEKASGDRSTMAAHMDKSQDAGIHARHISSVSALDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 6492 - protein, 169 aa, Zea mays
GFFGEVLRVGAPLLLSFISAGHFPVFAPVAAGGGGQAYNINFVSAAGGIAAPLGAGKQLLFPDVFGLLGGRNDPGGLGKVVGLSGVRKMVADGKVAGGVIPQGGGCVSPPAPGVPPPSFIDGGVPPSFFLGVFPDGGPGPPIPGWGGSCLPGIFLCLFFHFVVFFGYVG

SEQ ID NO: 6493 - protein, 189 aa, Gossypium somalense
HVGLNGNGKPFVACHDCSFPICKTCFDYELKEGRKASLLCGNPYDENLLDDAEKASGDRSTMAAHMDKSQDAGTHARHISSVSTLDSEMTEENGNPIWKNRVESWKEKKNKKKKTSIEVEIKAQVPPGQLMEDKPAADTFQSLSTVVPIPKSRLAPYRTVIIMRLIILGLFFRYRVTNPVNSAFALWLT

SEQ ID NO: 6494 - protein, 245 aa, Neisseria gonorrhoeae FA 1090
MALQDRTGQKVPSVVFRTRVGDTWKDVSTDDLFKGKKVVVFSLPGAFTPTCSSSHLPRYNELFGAFKENGVDAICCVSVNDTFVMNAWAAEEESDNIYMIPDGNGEFTEGMGMLVGKEDLGFGKRSWRYSMLVNDGVVEKMFIEPEEPGDPFKVSDADTMLKFVAPDWKAQESVAIFTKPGCQFCAKVKQALQDKGLSYEEIVLGKDATVTSVRAITGKMTAPQVFIGGKYIGGSEDLEAYLAKN

SEQ ID NO: 6495 - protein, 795 aa, Arabidopsis thaliana
MGDFSIQISSKLINQLAEGNDQPKRRAKKTKPKVSPQSKQKTNQDEEKKPNPVAELPMQPPFFFPIPPQGAASTELESIKSVVKESEKVLEKLELQEKNIVREVTERAKDLREKEFKIPEPKPMPCSSDHEAWMKCYKENIGSPLKCSGFVKSFQDCARRSRQQVNPEENNTLNRVNLGEQIFLSIFNVMTRMMLGAIVEEEERTILGNELKKLILLFQISKEAQKYSYGFRAEEEDFLQYLLRVIDDDEKAPLSMTHIKSLLMDMVLGGFDTSVKEPHIPRLLYLQAIMKETLPLSYTTIVISSVFWYIWVYVKSKRLFPPLPPGPRGLPIVGNLPFLHPELHTYFHSLAQKHGPVFKLWLGAKLTIVITSSEATRDILRTNDVIFANDDVPVAGSLSTYGGVDIVWSPYGPEWPMLRKICINKMLSNATLDSNSFSALRRQETRRTVRYLADRARAGLAVNVGEQIFVTILNVVTQMLWGETVADDEEREKVGAEFLELITEIIDVVGKPNVSDFFPVLSRFDLQGLAKRVRRSAQRMDRMFDRIISQRMGMDKGSKGNGGDFLMVLLNAKDEDENMSMNHVKALLMDMVLGGTDTSLNTIEFAMAELINKLEIMKRAQQELDKVVGKNNIVEEKHITKLPYILSIMKETLRLHPALPLLIPRCPSETTVIGGYTIPNDSKVFINVWAIHRNPNVWENPLEFNPDRFLDKGYDFSGNDYSYFPFGSGRRICAGMAMAEKVVLYNLATLLHSFDWRIGEGEKVELEEKFGILLKLKNPLVATPVLRLSDPNLFL

SEQ ID NO: 6496 - protein, 118 aa, Glycine max
MPEEDLVDIKFRLYDGSDIGPFRYSSAATVDMLKQRIVSDWPKGKTVVPKSANEVKLISSGKILENNKTVGQCKVPFGETPGGVIIMLVVVQPSLAKTKADKKVDDSPKKVVCSCSIL

SEQ ID NO: 6497 - protein, 323 aa, Francisella tularensis subsp. tularensis SCHU S4
MAYDNVKFPHGSFFLVTGGAGFIGSNLCEVLLSKGYRVRCLDDLSNGHYHNVEPFLTNSNYEFIKGDIRDLDTCMKACEGIDYVLHQAAWGSVPRSIEMPLVYEDINVKGALNMLEAARQNNVKKFVYASSSSVYGDEPNLPKKEGREGNVLSPYAFTKKANEEWARLYTKLYGLDTYGLRYFNVFGRRQDPNGAYAAVIPKFIKQLLNDEAPTINGDGKQSRDFTYIENVIEANLKACLADSKYAGESFNIAYGGREYLIDLYYNLCDALGKKIEPNFGPDRAGDIKHSNADISKARNMLGYNPEYDFELGIKHAVEWYLIN

SEQ ID NO: 6498 - protein, 185 aa, Neorickettsia sennetsu str. Miyayama
MGYLSFTMTLLKLKGTFPSTADTYFIAENAFLIGNVTVGTRSSIWYGCNIRGDVNYINIGSYTNIQDCTMIHVSHGEKGHTEIGNYVTVGHQCLLHACTLMDETFVGMGSIIMDGAIMESGSMVAAGSLVTSNKRIKSGELWLGRPAKFVRILTAEEISHIRESAIRYAALAEEYIRDLSNKTTF

SEQ ID NO: 6499 - protein, 436 aa, Francisella tularensis subsp. tularensis SCHU S4
MSLYEDIVAKREKVSLVGLGYVGLPIAIAFAKKIDVLGFDICETKVQHYKDGFDPTKEVGDEAVRNTTMKFSCDETSLKECKFHIVAVPTPVKADKTPDLTPIIKASETVGRNLVKGAYVVFESTVYPGVTEDVCVPILEKESGLRSGEDFKVGYSPERINPGDKVHRLETIIKVVSGMDEESLDTIAKVYELVVDAGVYRASSIKVAEAAKVIENSQRDVNIAFVNELSIIFNQMGIDTLEVLAAAATKWNFLNFKPGLVGGHCIGVDPYYLTYKAAELGYHSQVILSGRRINDSMGKFVVENLVKKLISADIPVKRARVAIFGFTFKEDCPDTRNTRVIDMVKELNEYGIEPYIIDPVADKEEAKHEYGLEFDDLSKMVNLDAIIIAVSHEQFKDITKQQFDRLYAHNSRKIIFDIKGSLDKSEFEKDYIYWRL

SEQ ID NO: 6500 - protein, 189 aa, Gossypium longicalyx
HVGLNGNGKPFVACHDCNFPICKTCFDYELKEGRKACLRCGNPYDENLLDDVEKASGDRSTMAAHMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 6501 - protein, 483 aa, Acinetobacter sp. ADP1
MQHVQLLIDGQSVDAANQATFERISPIDGHVASVAAAATLEDVDRALESASRAFQIWSKVSPTERRLRLLKAADLMDQNTEKFIEIGMRETGSTATWYGFNVHLAANMLREAAAMTTQIDGSLIPSDVPGNLAMGIRVPCGVVVGIAPWNAPVILPTRALAMPLACGNTVVLKASEACPATHRLIGAILNEAGLGEGVVNVITHAPQDAPQVVERLIEHPAVKRINFTGSTKVGKIIAETAAKHLKPVLLELGGKAPVVILNDADLDEAVNAVAFGAFFNQGQICMSTERVLVQDGIADRFIEKLIQKTASLKAGNPTQQGSMLGVLESRRAAERIQHLLEDAQQKGANLPLGIQIQDTLMQPTLVLDIQPEMLLYREESFGPVCTVQRFASIEDGVRLANDSEFGLSSAVFSQNFGLAMDVAKQIDSGICHINGATVHDEAQMPFGGTKSSGYGRFGSKASIAEFTELRWITVQTQPRHYPI

SEQ ID NO: 6502 - protein, 189 aa, Gossypium bickii
  misc_feature (108)..(109): Xaa can be any naturally occurring amino acid
  misc_feature (111)..(111): Xaa can be any naturally occurring amino acid
HVGSNGNGKPFVACHDCNFPICKTCFDYEFKEGRKACLRCGNPYDENLLDDAEKSSGDRSTMAAHMDKSQDAGIHARHISSVSTLDSEMTEDNGNPIWKNRVESWKEXXIXNNKTSIKVEIEAQVPHEQIMEDKPAADAFQPLSTVIPIPKSKLAPYRTVIIMRLIILGFFFHYRVTNPVDSAFALWLT

SEQ ID NO: 6503 - protein, 267 aa, Physcomitrella patens subsp. patens
MSDDEIHTVRVSNVSPKATEHDIQDFFSFSGEIQYIKLIKDGALSQTAFVTFTDAQALETALLLSGATVVDQAVTITPADESEKLANSVEDVPLDANTAEPTPAKKSAEEFIKNILAKGSTLGNNTVSKAKAFDEKHQLTANATQLAANAKANVVKIDDKIGITKKLSAGTAAINQQVKVVDEKYQVAEKTRAAVQATEQKLNAAGSAIAKNRYVLTGTSWVVGAYAKVAKAAEEVSNKTLEKVATLGAGEHKSPARPSAERGSFHS

SEQ ID NO: 6504 - protein, 484 aa, Rhodopirellula baltica SH 1
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 6505 - protein, 415 aa, Bacillus sp. SG-1
MAEIKVPELAESITEGTIAQWLKQPGDYVEKGEYIVELETDKVNVEVISEEAGTIQELKAEEGDTVEVGQVIAIVGEGGQQPASSDSKSEEKAEAPKEEAKQEESSPAPAETEGKKERVIASPAARKLAREKGIDLSQVSTDPLGRVRKQDVEAYENKPQSAPSKPAASESKPAAAPKKDDGKPVVREKMSRRRQTIAKRLVEVQQNAAMLTTFNEIDMSAVMELRKRKKDKFFETHDVRLGFMSFFTKAVVAALKKYPYVNAEIDGDEVVLKKYFDVGVAVSTDDGLVVPVVRDCDRKNFAEIEGEIMELATKARNNKLALSDLQGGSFTITNGGVFGSLLSTPIMNGPQVGILGMHTIQLRPVAIDKDTMENRPMMYIALSYDHRIIDGKEAVGFLVTIKNLLENPEDLLLEG

SEQ ID NO: 6506 - protein, 1239 aa, Ustilago maydis 521
MSSSQRPVVQPIPPFKGAPLQATDVQNRRPTAAEAYVALANRKAGANVVSTRATGCENHRPSQHQPTSHHASQRQQPAPAADRRVQQSQPSERPKPASRLEREKKRHHNDPKNIGHWRLDKLIGQGASGRVRLAIHDQTGQKAAVKIIPRTLINASRMSLRDADVKANKMILGIEREIVIMKLIEHPNLLGLWDVYETSKDLFLIMEYVAGGELFDHLVAQGKLSPRDARGYFRQIIFGMDYCHRFNICHRDLKPENLLLDETKKIVKVADFGMAALQPTEKMLETSCGSPHYASPEIVSGKRYKGTASDIWSCGIILFALLCGRLPFDDPNIQQLLGKVRAGKFIMPEWLEPASKDLIWRMLEVDPEKRIKMADIMRHPWFTNNGTESSVNPVSTSLDSLQMEELTLDTIDIDILGNLKTLWFELSEQDIIKELLAPGPSWQKTFYTLLVAHRENHSADDEDDMNDDILDEQIVTASAVPAHALLSTTSAAKTLEKPRPRRTSDAAGATSAPASPRLESVEMDRRHSTPEKGSVYHTTSRRPDNVTPPKVASPHVRPANPSPRLRPSPLDSPASTLDSAFVSASKLKVASPTKPRALGSSHGADKSGYVLPQISLQTASPQRNERPAVDLQRRNTSPTKPNTVGVTAPLSARIALANMYDAPTLSHTATASCGSTSSTASSTVSVSAARNRANRGSGSEMMPPLALPGRASSRPVSPTKSTFGAQATLPPQTAPQPAPPRPSTSRAYTTQPTPCIQVPQVGDATMQRFFQEIADELASIRATGEKPDALQSKLDQLKNSMAWQQQQQQQQLQSQPMAVTASAPSARTRNSEMNQFEDAEDDVSEGESMRSVSQASSHQQTYTPSTPMTPLSPVELIAPLALTDKSGAGARSSVASSSASASARNSVRSARSGTEASSSGTTSRPTSVFSNISTGSTGLGRKRSLLGLRRADKHAQQQHATATEANTIRSIAYESTPTPTALASVFAAPASGRFVPNGGATTASSVRMQRLNPGLGLDIGASSAAGIISPPSTPQSPNTATLSPAPAASASAIASASAPGKKDSWFAGLFNWKPATFTLMSSENFSETLTECIRRLQSYGVRVAMDDSSDVHHTTLKCSINEYRESNGVVTAAKPLRFRVDVHILAVGSPATNSAYMGGGLGLSLHGGAVGTNVNATSIMTHGLPSPALSTYSRASTPGGVTFATSVLVVQEKGALSTFKLIHARLRREWMLDLGSAII

SEQ ID NO: 6507 - protein, 1184 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 6508 - protein, 169 aa, Clarkia similis
SFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPA

SEQ ID NO: 6509 - protein, 266 aa, Clostridium perfringens str. 13
MNKKIGFIGCGNMGSAMVLGILKSGIVCKENIIASCSRESSAERIKNELGINTTLDNKEVCNNSDIIFLAVKPYMYEKVIKEIRDCVDLNKTIVTIAAGINLSDVEKWFKKETKIVKTMPNTPALIGEAMSAICPNELVNEEELKEVMDIFNAFGKSEVLSEKDFHGFIALCGSSPAYVYMFIEAMADAAVREGISRDKAYKLAAQSVLGSAKMVLETGEHPAKLKDNVCSPGGTTIEAVLELEETGFRSSVMSAMKKCSKKSKKM

SEQ ID NO: 6510 - protein, 456 aa, Zea mays
MDYRPSDSSGTDDDLPQFPHKSIRGSGRVSGNGRAVVPAGSYARAPTDMVAQVQQLEQEAYRSVLRAFKAQSDAITWEKEGLMTELRKELRVSDKAHRELLNRVNNDNIICSIREWRSTGGLQASLSNNPQLIHDSVPSPTTSGRKRQKTSQSVPALPAPPPAMHSQQLATPTQPSSSTARKAVPPGHKGKKMKPKFMHFQGQKVPGGSAAKPIPSSAGPSGRGPHMNRGGSAPEAQAQNVDPLIGRKVISRWPEDNSFYEAVIYEYDAETGLHALVYDIDTEDETWEWVDLKEMGPEDIRWQEDDSGIDPVTYLRSRGGPTSGVRKPAGRGGPMPGSVRGRGLQKNMPKKDFPPPQNGVGKRSSDDIDILHTESLIKEVGKVFSVSNPDPQEVEKAKKALKEQEQSLIDAIARLAEASDGESDGHNRGRRNLYAANQHQASYVGAMPVGDRAGAM

SEQ ID NO: 6511 - protein, 121 aa, Photobacterium sp. SKA34
MSITNEQILDAVAEMSVMQVVELIEAMEEKFGVTAAAAVVAGGAAAEAAEEQTEFDVILTACGPNKVQVIKAVRGATGLGLKEAKAVVDGAPAPLKEGVEKSEAEALKAQLEEAGASVEIK

SEQ ID NO: 6512 - protein, 178 aa, Clarkia similis
SFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 6513 - protein, 398 aa, Mesorhizobium loti MAFF303099
MTPAWATEKPTALLVLADGTVIEGRGLGATGSAVAEVCFNTALTGYQEILTDPSYAGQIVTFTFPHIGNIGTNGEDIEDLNPAARAGAVGAVFKADVTNPSNYRAAGHLDQWLKKRGIVALSGIDTRALTALIREKGMPNAVIAHAPDGVFDLDDLKQRAAAWSGLIGLDLAKEVTSGQSSVWRETPWVWNEGFGEQAEPSLHVVAIDYGVKRNILRLLAGLGAKVTVVPANTGSEEILAMQPDGIFLSNGPGDPEATGDYAVPVIQDLLKTDIPVFGICLGHQMLALALGGRTAKMHQGHHGANHPVKDHTTGKVEIVSMNHGFAVDADSLPEGVEETHVSLFDGSNCGIALTGRPVFSVQHHPEASPGPQDSHYLFRRFVNLIREKRGEEQLAERV

SEQ ID NO: 6514 - protein, 168 aa, Clarkia similis
SFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPT

SEQ ID NO: 6515 - protein, 467 aa, Pseudomonas putida KT2440
MQQAQGLKRGLSARHIRFMALGSAIGTGLFYGSASAIQMAGPAVLLAYLIGGAAVFMVMRALGEMAVHNPVAGSFGHYATTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGMSNLFDHGGFMPNGVGGLIASFAVVMFAFGGIEIIGVTAGEAKDPQRVIPKAINAVPLRILLFYVLTLFVLMCLYPWPQIGSQGSPFVQIFSNLGIGSAAAVLNVVVISAAISAINSDIFGAGRMMYGLAQQGHAPRGFSKLSKHGVPWMTVVVMGAALLIGVLLNYLIPENVFLLIASIATFATVWVWLMILLTQVAMRRSMSREQVAQLKFPVPFWPYGPAMAIAFMVFIFGVLGYFPDTQAALIVGVIWVVFLVASYLLWCKPRAGQGQPVAEPAELHR

SEQ ID NO: 6516 - protein, 510 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGVPNKIDMIALSFVRKGSDLVNVRKVLEPHAKTIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 6517 - protein, 1437 aa, Physcomitrella patens subsp. patens
MGKRPKPDHHHPHQLAVDVDAPSSSTPSLKPAPLLPSRELSVAQAHPNPSEIAMAPGPWVPHSISVGVVGRMGGDDETDVAGGSVAKAANQSLNPVGMQIYWNLSSLNMAVREAAALALVDELRAKQEEFEAGGGQGGVSEVLGAKENDDLLEGCAPGVQYALRRLVRGLGSSRECARQGFATALTAVITALPVLRGKALLQTIPSNLEVTSSMKKQAEGFTLYLRLASSQVFREANADFGWRLTHVFLSACMASKDARDGLLGRLFAYGSLIRAKRLIGNGSSPEEKELITEIVQQLFGLAKQKTFLREPAVNLVFDLASRLPSSAVSETVCAAPVFDEWLRRDLESQSADALVLVLQLYDKLPSQSSPLLPESGNLQDFFEASHLAKLVPCLKESSSSHPRVHSVWNLLLDRLFSLYSVQESSKKKRAKSSSSKDIKDAKKVEEALGNLWSVVVDGALLPSSHERKNLAMELLLLVLPRLPNPETVGVVLSNIFVRCILDILSSKDTHLFKSAQRCLGEVRLWAESSNSRRVAVIGALQKNSYGKFDTLSKSSTVKTLTNGLITEEGVLAFVHNLQELFVATESTFVKATEITEDPAELSEDALMNGHDSPGANDRIWIIEQMCALCRQVKLEPKAQETLYREVIKFLVTHSLFQASNEQNGGGVEKKSYRWPQMPLTPNIRKLCVERLHSILVDAEHWMSSQKSRSNKSSAGGSTDTAKEDEVSAVSAASYCLSLHESPAAVLVQPLKEESAESIKILHQTVSTISSAVKSDTTGKLRRLLAMRGLLSNLLLESFLEPGSTDDIAAELVICCSRAFPDLPELAKIAPPVEEEEDNEEVPPVMDVLLDVLLSLLAKSSTPIRNAVEQVFKVYCDDLTSAGMADILRIINKGSRSGRHKSILDDDEEDSDDDDDDILEDEEDDEADGNIGKVEGSQEAKEEEEDDDEDDEDDEDDEDEDDEEEEDVEMGDGDAQTRTLQQQMRFKRPGEDLDDEAESSDSDISDMDDEAMFRADVLLANVLKHRKEANKNTAQTQLTHFKFRVLSLLEHFLQKHPSSSLCLLAAENLLKAFVVAMNQLGTAPEENEVLVKRLESMLNSKVLHTKKYPKGKDVDLPLARSLLKKALKLSSRSSIKRVRVLAQTCTLWTFKVLLGNLPDVEEKCDSETLDLLFSALDDYFTHKKSRLAGSFFTELFRRYPVLGRCSIGKLMEKCGNGRTEFMKCEAMRLLTEILKPVTSGKGKKTINGGDEHKLLVKAFEEHMGPRGSSILSTVQNPPERAAYKFIALQFCSSCIDAFRMLYPQKGLHAVLDTEALLAGLKAVDTPTKGKLQNLITKLVKVVAEDLAKNPGRSGSAKGDGNKTSSKKKLKAVEVPMEVENVVTPSKNKGKNLKEDRMPSKRKNARDSQVQMEVQVEETPSKKKSKSPSSKKVKVSKES

SEQ ID NO: 6518 - protein, 350 aa, Dechloromonas aromatica RCB
MKICVLPGDGIGPEITAQAVRVLNSLDLKFEMEEALLGGGAVDATGNPYPEATQKLARAADAVLLGAVGGPKWDSLPREQRPERGLLGIRKDLNLFANLRPAILYPELANASTLKPEVVAGLDILIIRELTGDIYFGQPRGVREENGERVGFNTMVYSESEIRRIGHVAFQAAQKRDKRLCSVDKMNVLECTQLWRDVMIEISRDYPDVELSHMLVDNAAMQLVKAPKQFDVMVTGNMFGDILSDEASMLTGSIGMLPSASLDDKNKGLYEPSHGSAPDIAGKGVANPLATILSAAMMLRYTFGLEEQALRVENAVKKVLAQGYRTGDIYERGTNKVGTREMGDAVLAAL

SEQ ID NO: 6519 - protein, 273 aa, Triticum aestivum
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 6520 - protein, 117 aa, Zea mays
  misc_feature (13)..(13): Xaa can be any naturally occurring amino acid
  misc_feature (110)..(110): Xaa can be any naturally occurring amino acid
MTCAYARTEQMFXASDERINALTHNIMALTHYLIASSSRAFLARSRCLTSNCIFRAMDGLPVTILLQQALLQEFLPQWNIQDIVHQVCAETGAMYQDTLPRSYNRSELTXTLGFHGC

SEQ ID NO: 6521 - protein, 412 aa, Erwinia chrysanthemi str. 3937
MNYPVEHYPIDRVRADFPILQQSVNGQPLAYLDSAASAQKPLAVIDRERDFYLHEYAAVHRGIHTLSARATSAMEEVRAKVATFIHAASAEDIVFVRGTTEAINLVANSYGRTAFQPGDNLVISEMEHHANIVPWQMLAQARGLTLRVLPITDDGELDMAQLPALLDERTRLVAVTQVSNVLGTVNPLAEIIRQAHACGAKVLVDGAQAVMHQAVDVQALDCDFYAFSGHKLYGPSGIGVLYGKSELLQAMPPWEGGGAMIREVSLTQGTTYADPPWRFEAGSPHVAGIIGLGAALDYVSALGVDAIQAHEGLLMRYALASLAEVPTLRLYGPVHRQGVIAFNLGRHHAFDVGSFLDQYGIAIRTGHHCAMPLMSRYGVPSMCRASLALYSCQDEIDRLVAGLHRIHRLLGE

SEQ ID NO: 6522 - protein, 479 aa, Chlamydia muridarum Nigg
MAPADIGLIGLAVMGKNLVLNMIDHGFAVSVYNRSPEKTEEFLKEHGENISLQGFTAIEEFVQSLKRPRKIMIMIKAGAPVDEMISSLLPFLEEGDILIDGGNSYYLDSERRYIDLKKKGILFVGMGVSGGEEGARKGPSIMPGGNIEAWPVIAPIFQSIAAQVDGQPCCSWIGTGGAGHFVKAVHNGIEYGDIQLICETYEILKSRLDLSLEQIGNIFFEWNQTDLNSYLMGASAAVLTAKDENGVAVASTILDVAGQKGTGRWVAEDAIKAGVPMSLIIESVLARYLSAWKEVRRQAAREFPVASLLYQPSQEASVLIEDAREALYAAKIISYAQGFMLLKQISEERNWDLNLGELALIWRGGCIIQSAFLDKIHQGFESCPDAHSLMLQDYFKNVLLNSETGFRRAILHAVGAGVAIPCLASALAFYDGYRTENSPLFLVQGLRDYFGAHGYERQDRPRGEFYHTDWLGSKNASRM

SEQ ID NO: 6523 - protein, 647 aa, Flaveria bidentis
MISLNSSFLERSSVAGGSRTQSQSLRLSVRRPVVASMLNSNSLPERNVNVSVDSAVRDVNAPVAVEVDRSVGEKPFAVVGGGVEDMYGEDTATEDQYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKIWPHKKIQVIVVTDGERILGLGDLGCQGMGIPVGKLALYTALGGVRPSACLPITIDVGTNNEKLLNDEFYIGLKQKRAAGQEYAELMNEFMSAVKQNYGEKVLIQFEDFANHNAFDLLEKYRTTHLVFNDDIQGTASVVLGGLISALKLVGGSLADQKFLFLGAGEAGTGIAELIALEISKQTNIPLEESRKKVWLADSKGLIVKSRLDSLQHFKKPWAHDHEPVNEFLDAIKTIKPTVLIGSSGTGQTFTKEVVETMSSLNEKPIILALSNPTSQSECTAEQAYTWSESRAIFASGSPFKPVEYNGKLYVSGQANNAYIFPGFGLGLIISGAIRVHDDMLLAASEALAEQVTQEHFDKGLIFPPFTSIRKISAHIAAKVAAKAYELGLASRLPQPENLVAYTESCMYSPKYRIYR

SEQ ID NO: 6524 - protein, 595 aa, Glycine max
MGICLLKWQWPWLLYVLLIHVVINKSEAITPDGEVLLSFRTSVVSSDGILLQWRPEDPDPCKWKGVKCDLKTKRVTHLSLSHHKLSGSISPDLGKLENLRVLALHNNNFYGSIPPELGNCTELEGIFLQGNYLSGAIPSEIGNLSQLQNLDISSNSLSGNIPASLGKLYNLKNFNVSTNFLVGPIPSDGVLANFTGSSFVGNRGLCGVKINSTCRDDGLPDTNGQSTNSDQNQIGKKKYSGRLLISASATVGALLLVALMCFWGCFLYKKFGKNDRISLAMDVGAGASIVMFHGDLPYSSKDIIKKLETLNEEHIIGIGGFGTVYKLAMDDGNVFALKRIVKLNEGFDRFFERELEILGSIKHRYLVNLRGYCNSPTSKLLIYDYLPGGSLDEALHERAEQLDWDSRLNIIMGAAKGLAYLHHDCSPRIIHRDIKSSNILLDGNLDARVSDFGLAKLLEDEESHITTIVAGTFGYLAPEYMQSGRATEKSDVYSFGVLTLEVLSGKRPTDAAFIEKGLNIVGWLNFLITENRPREIVDPLCEGVQMESLDALLSVAIQCVSSSPEDRPTMHRVVQLLESEVVTPCPSDFYDSNSD

SEQ ID NO: 6525 - protein, 529 aa, Chlamydia muridarum Nigg
MTQTAEKPFGKLRSFLWPIHMHELKKVLPMFLMFFCISFNYTILRDTKDTLIVTAPGSGAEAIPFIKLWLVVPSAVVFMLIYAKLSNILSKQALFYAVLSPFVVFFALFPLVIYPYRHILHPTDFADTLQAILPSGFLGFIAMLRNWTFAAFYVLSELWGSVMLSLMFWGFANEITKISEAKRFYALFGVGANVALLISGPAIVWSSKLRASLGEGVDPWGVTLYFLMAMFLCSCAIIAACYWWMNRYVLTDPRFYNPAELKAKKSKPKMSMGESFSYLLRSPYMLLLALLVICYGVCINLVEVTWKSQLKMQFPNPNEYSAFMGTFSFWTGVVSVFVMLFIGGNVIRRFGWLTGALVTPVMVLVTGAIFFALVIFRDHATGLVAALGTTPLMLAVVVGAVQNILSKSTKYALFDATKEMAYIPLDQEQKVKGKAAIDVVAARFGKSGGSLIQQGLLVVCGSISAMTPFLAVALFAIIMVWLTSATKLNKLFLAASAAKEQELAEATAAAEKEASPAAKEVSPAIEGVS

SEQ ID NO: 6526 - protein, 169 aa, Triticum aestivum
  misc_feature (30)..(30): Xaa can be any naturally occurring amino acid
LLQSEHCRGKIVMELINANPVIHEKRERRXSGQAPENIDENAPEAIDQLEIFDHIRDIKDPEHPYSLEDLNVVNEDSVEINDELSHVRVTFTPTVEHCSMATIIGLCLRVKLMRSLPPRYKVDIRLTPGSHATEAAVNKQLSDKERVAAALENSNLLDIVEECLSPTLG

SEQ ID NO: 6527 - protein, 568 aa, Lentisphaera araneosa HTCC2155
MSKYFFHFTLIFSSFLFADPIIRIPQIDLKNTSVSRSKNVMIVCQDDKAADIGLEIIEAGGNAADAGVAIAYALAVTQPKAGNITGGGFALYYDAETKKTVAIDFRERAPSSVKKSDFLKADGSVDQNALRFSPKACAVPGTLAGLDYINKKFGLLKHKTVIEPAIYLAEDGFEVSAGLAYDFKSKKDFLMQNPEAKRIFFPEGEALKQGEILVQEDIAGTLKRLKKYGPNYFYTSHLGKEFVKWHKENGGLITQLDLKSYKVVEREPLIGKYRGLTIASMPAPSSGGMHLIQMLNILENYDLKEMPKDQYYHLLTETMKLAYADRSHYPGDPDFNYIPQQEIISKKYAKKLKRSIKMNRARPAKEISHGKVHFRESNDTTHFSVSDRQGNVLSFTYTINYSFGSGIMIPGLGFFLNNEMDDFAILEGVPNSYGLLGGEANFVKSNKRPLSSMTPTIVFKKDQPYLCTGSPGGSRIISTVLQILLNVIDFNMDLREATLRPRIHHQWLPDKLEFESGLNEEIVESLKKKGHNTEEVFPFGCAETIMMRYDGKHGFADPRRIDGKALGK

SEQ ID NO: 6528 - protein, 94 aa, Nostoc punctiforme PCC 73102
MPLTDAIPALLVLADGTTYRGWSFGATGTAIGEVVFNTGMTGYQEVLTDPSYCGQIVIFTYPELGNTGINLEDEESDGPQVRGAIKKKYLSTTK

SEQ ID NO: 6529 - protein, 421 aa, Populus trichocarpa
MIEMVDSFNHWSFGHLRPFVKRVLSFGKGVVIKGHCKFWIFQSFNGVVVVGSLLSFLLAMAYVYVILFPRFQPVINKTYETPHFNSSVSECNYFEGNWIQDESYPLYDASQCPFAENGFNCLANGRRDGGYTKWRWKPKNCEIPRFNAREILEKMRGKRIVFVGDSLSRTQWESLICMLMTGVEDKRSVYEINGNKITKQIRFLGVRFSSFDLRIDFYRSVFLVQPGPAPRRAPKRVKSTLKIDKLDDIRNEWIDSDILIFNSGHWWTPSKLFEMGCYFLVGGSLKLGMPITAAFERALHTWASWLNTTINANRTSVFFRTFESSHWSGRNRLSCKVTRRPSSRTGGRDRSLISDIIIKVVKAMAVPVTVLHVTPMGAFRSDAHVGTWSDNPSVPDCSHWCLPGVPDMWNEILLSNMLSRN

SEQ ID NO: 6530 - protein, 493 aa, Rhizobium leguminosarum bv. viciae 3841
MAFTSALTKHVPFSSPLLRDAGYIDGVWTSGDATKTFDVLNPATGELLASLPDMGAAETRAAIDAAHAAQPGWAARPARERSTILRKWFDLMVANADELAAILTAEMGKPFPEARGEILYAAAYIEWYAEEAKRIYGETIPAPSDDKRMIVIRQPVGVVGTITPWNFPAAMITRKIAPALAVGCTVVSKPAEQTPLTAIALAVLAEQAGIPAGVFNVIVGVDGPAIGRELCGNEKVRKISFTGSTEVGRILMRQCADQIKKVSLELGGNAPFIVFDDADLDAAVEGAIASKYRNAGQTCVCANRLYVQSNVYDAFAAKLAAKVAEMSVGDGFEPGVVIGPLIDEQGLAKVEDHVSDALAKGAKLLTGGKRIDGAGTFFTPTVLTGVARGMKVAREETFGPVAPLFRFDTVEDVINQANDTEFGLAAYFYAGDLKKVWRVAEALEYGMIGINTGLMSSETAPFGGIKQSGLGREGSRHGADDYLEMKYLCIGGV

SEQ ID NO: 6531 - protein, 165 aa, Zea mays
MNHWAVQPNAFGDQSVVVCPKPRRIALRNPSLYHHPARSLRCYFSHQQVEVCESEAETDILDIILTKDGYGTEQVQAQVLDSPSPFLCGSPPSRVANPLTQDARFRDELSLVSSSISTPLGQPQSSSGRKGGCVRGSFGSSPAVRIEGFDCLDRDSRNCSIPALA

SEQ ID NO: 6532 - protein, 129 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 6533 - protein, 426 aa, Rhizobium leguminosarum bv. viciae 3841
MNATSLTDRKNAAISRGVGMTTQIYADRAENAEIWDKEGRRYIDFAAGIAVLNTGHRHPRVIAAVKDQLDRFTHTCHQVVPYESYVHLAERLNALLPGDFEKKTIFVTTGAEAVENAVKIARAATGRSAVIAFGGGFHGRTFMGMALTGKVVPYKVGFGAMPGDVFHIPFPVELHGVTADQSLAALKKLFAADVDPQRVAAIIIEPVQGEGGFYSAPAAFMKALRELCDQHGILLIADEVQTGFARTGRMFAMDHHEVAPDLTTMAKSLAGGFPLAAVTGRAAIMDAPGPGGLGGTYGGNPLGIAAAHAVLDVIVDEDLCNRANLLGGRLKQRLESMRETVPEIVDIRGPGFMNAVEFNDRTTGLPSAEFANRVRLIALDKGLILLTCGVHGNVIRFLAPITIQDEIFGEALDILEASMLQASAAK

SEQ ID NO: 6534 - protein, 190 aa, Kokia drynarioides
HVGLNGNGKLFVACHDCNFPICKTCFDSELKEGRKACLRCGNPYGENLLDDAEKASGDRSTMAAHMDKSHDAGIHARHISSVSTLDSEMTEDNGNPIWKNRVESWKEKKNKKKKTSIKVEIEAQVPAEQLMEDKPRAADAFQPLSTVIPIPKSRLAPYRTVIIMRLIILGLFFHYRVTNPVDSAFALWRT

SEQ ID NO: 6535 - protein, 278 aa, Populus trichocarpa
MVSKRQKLARKIYKEDHPELFPKPEPTPPNDPNKMKKKKKKSLFKRKNSDPKDPNKANKKGFRKQPLRVPGMKPGDSCFICKAKDHIAKLCPQKDEWEKNKICLLCRHRGHSLKRCPKKNDETMDQKLCYNCGETGHSLSQCPQPREDGGTKFANCFICNERGHLSKDCPKNNRGIYPKGGCCKLCGGVTHLARDCPDKGKRGDAAFGRGAIGREVRPTGRVTKFVSGDELDDDFMTENMYSIPKDKSTDSKVVPPDSKDGHVKSKKKQGPKIVNFVG

SEQ ID NO: 6536 - protein, 495 aa, Streptococcus pneumoniae TIGR4
MSSKVIVTIFGASGDLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQPDITYRQDGRLE

SEQ ID NO: 6537 - protein, 132 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 6538 - protein, 240 aa, Populus trichocarpa
MAGQTILVTGGAGFIGTHTVVQLLKEGFKVSIIDNLDNSVTEAVDRVKEVVGPQLSKNLEFNLGDLRNKDDLEKLFSRTKFDAVIHFAGLKAVGESVANPRRYFDNNLVGTINLYEVMAKYNCKKMVFSSSATVYGQPEKIPCVEDFNLMAMNPYGRTKLFLEEIARDIQKAEPEWSIILLRYFNPVGAHESGKLGEDPRGIPNNLMPYIQQVAVGRLPELNVYGHDYPTKDGSAVCSST

SEQ ID NO: 6539 - protein, 569 aa, Francisella tularensis subsp. tularensis SCHU S4
MNSETKKDFSQLGLNQDIVDTVIKLGYENPTPIQQYAIPYILSGRDVLGQAQTGTGKTAAFALPLINNMDLASRDRAPQVLVLAPTRELAIQVAEQFEAFAKNVPNLDVACIYGGQEYGSQIRALKQGVKVVVGTTGRVMDHIEKGTLQLDNLRALVLDEADEMLRMGFIDDVKFVLSHVSEQCQRLLFSATIPTDIADIIEEYLRNPCKIQVKAKTKTANTVTQKFIVIKGFRKIDALDRLLETEETDGVIIFVKTKTSTIEVADNLKALGYKVAAINGDMQQSQREYIVDQFRSAKSDILVATDVVARGIDLERISHVINYDMPNDTDTYVHRIGRTGRAGREGTSISLVPLKEMRFLRTLERFTGSPMQEVFMPSAKELAQSRVEHFKARIISALDKNKSLDKYKEIITSIRDELQLDSEELLAGLTLLAQGKKTFFPKEIQAKEEKPARDNRNSRDGRRNERFERRNDQGDRTKRFDKADRKPRRAVNIDLTTYKLDVGRDNDVQARNIVGAIANEGNIDSKHICNISIQKDYTLVDLPANLSPKVINHLKKVWVAGKKLNLTAQ

SEQ ID NO: 6540 - protein, 246 aa, Helicobacter pylori 26695
MKKEKHLKQEKIINMFDDIASSYDQANRLMSFGLDVKWRERACEHAFLFLENKKALRLVDVACGTGDMLVAWQKSALNCGIEFKECLGIDPSNNMLELAIKKCEELENKASFIQAQAKDLKGVENNSVDILSIAYGLRNVVERQEALKEFFRVLKPRGVLVILEFLKKDNPTWLDKISGFYTNKVLPLVGGAISKNYGAYSYLPQSIEGFLSLEGLKHELRNAGFEILRTEDSIAQISTTMLVKKN

SEQ ID NO: 6541 - protein, 494 aa, Saccharomyces cerevisiae YJM789
MDLRVGRKFRIGRKIGSGSFGDIYHGTNLISGEEVAIKLESIRSRHPQLDYESRVYRYLSGGVGIPFIRWFGREGEYNAMVIDLLGPSLEDLFNYCHRRFSFKTVIMLALQMFCRIQYIHGRSFIHRDIKPDNFLMGVGRRGSTVHVIDFGLSKKYRDFNTHRHIPYRENKSLTGTARYASVNTHLGIEQSRRDDLESLGYVLIYFCKGSLPWQGLKATTKKQKYDRIMEKKLNVSVETLCSGLPLEFQEYMAYCKNLKFDEKPDYLFLARLFKDLSIKLEYHNDHLFDWTMLRYTKAMVEKQRDLLIEKGDSNANSNAASASNSTDNKSETFNKIKLLAMKKFPTHFHYYKNEDKHNPSPEEIKQQTILNNNAASSLPEELLNALDKGMENLRQQQPQQQVQSSQPQPQPQQLQQQPNGQRPNYYPEPLLQQQQRDSQEQQQQVPMATTRATQYPPQINSNNFNTNQASVPPQMRSNPQQPPQDKPAGQSIWL

SEQ ID NO: 6542 - protein, 460 aa, Francisella tularensis subsp. tularensis SCHU S4
MQTEKKINFVVVHVAIIAALAGLLFGMDIGYVNGSLHFISETFGLSVEQSGHVSSVLLLGAACGALFSGFLSKRYGRRKVLLIAAAIFSIFTIVGILAPNYQIFISSRFILGIAVGIASFIAPLYLSEIAPKEFRGALIALYQLMITIGLFLVFLTNSALERTGSWRVMLAVLAIPSVIMFFGCLTLPRSPRWLILKGNDNEAALVLKKIRSSEAEALEEHNEIKQTTHRGVSVFSLLKQKFFIKVVLLGIALQAFQQFTGMNAFMYYSTDIFKLAGFTNPSTSTIVIGLLNMLTTFLAIKYVDKFGRKPILYFGLSLLIISCIIVGFIFKTHFVYGQAMVLSQTLQWTALIFCLLFIFGFAISMGPVIWILCSEIQPIEGRDFGVTASTMSNWICNAIIGNFALTWLTFHPDSTFFGFAISCIICILFVKFFVPETKDVSLEEIENNLRSGKSLAKIGR

SEQ ID NO: 6543 - protein, 706 aa, Fusarium oxysporum
MAPRGFEDEELTISLSSSHVRRPQQQQQQQSQQQQQHASSDAPTPGSRPADAPLKERIKTEQRIGAYKVLRTLGEGSFGKVKLAIHNGTGQQVALKIIARKKLISRDMAGRVEREIEYLQLLRHPHIIKLYTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPAGAANLIKKMLVVNPVHRATIEDIRADPWFTTDLPAYLQLPVEEFFNTGVDPNKAIKKNDIAPNASEKVQERLHNEVTEKISKTMGYGKSDVEEALQAAEPAAIKDAYMIVRENKMMQVNHNPEALLAEPEGSSPMLSMSSARSTTSQATTTPRPYVSKVGILPSSLPAYHKDYMEREKAGSVENSPPKVLINDEPPSNRTDAEKEETARRLRPHSRSQLRMDEANTRPQGMTPINPPKKNKPVRWQFGIRSRNSPWEALLCIHKALHKLGATYIPDEDYESRTAEERAEASGEGSFADSHDNNRGSSSSIDPKKRYNLPADPWHINVRWDTSAIKKKAASVPGTPSSPSTPEGQHHPKEPFVALHMDIQIYEMEHGVYLVDFKCSGYETAHGRLLEEKDVTSPFPFLDMAAKLIMQLAEAD

SEQ ID NO: 6544 - protein, 315 aa, Burkholderia xenovorans LB400
MSNFRGVIYDSIVDTIGATPLVRLSKLAAACDCRADVVGKLEFFNPLASVKDRIGIALIETAERAGRIKPGTLLIEPTSGNTGIGLAFVAAAKGYPLVLCMPESASIERRKMVGLLGAKVELTPASEGMGGAIRRAEALKRNHPDSLILQQFDNPANPDAHRHTTAEEIWNDTAGRVDIIVSGIGTGGTITGIGQTLKARKPELQMIGVEPSGSAVLSGGKPGPHKQQGIGSGFLSSILDLSVVDEIVTATDEDAIQTARQAAALEGVPIGISSGAALSVALRVGRRPGNAGKLIVVIVPSFAERYLSTELFADV

SEQ ID NO: 6545 - protein, 536 aa, Bacillus sp. SG-1
MFKVKMKGSHIMHELDLHHIFQLGLILVMIAAGITAVAKKLKQPYPIALVIIGALIGLFDIPVLEPLKLFITEGEVFNFVIITLFLPALLGEAALKLPFAHLKDNKEPIFSLAFVGTFVSTIIIGFSTIYFFDFSIPAAFVFAALMSATDPVSVLSIFKSVGVNKRLAVVIEGESLFNDGLAVVLFNISAFYLLSYLDAGWAGLGSGAWEFVRVVSLGLIIGGSLGFGFSVLTKYFDDYPLEIIFSIILFYGSFLLAESVHASGVIAVVVAALIFGNYGGRIGMSPTTKLNINNFWDVAALLANSLVFLMVGLEITRIDLVDKWQLILAAIPLVLVARSIAVYSSLAFIKSFPLKWKHILNWGGLKGSLSVALVLSLPREFTGREDILVLAFSVVLFSLVVQGLSLKPLIGWMGVKPEKEGSVEFEKLIAQLHRYETAITEIHRVKQKLYITDPVSEELVAVYEKRLDILKAEINELFEKVPDLKQDQMNSLKKHTLYAEHEAIDNLLREEIISNETAEREHERLTDAIINIEGKH

SEQ ID NO: 6546 - protein, 169 aa, Clarkia similis
SFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPA

SEQ ID NO: 6547 - protein, 403 aa, Oryza sativa Indica Group
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFRSTMVTDGGTRFTMIDRSSGARNPIYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKACSKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQEMPFADINKAFQLLEEGKSLRCLLHV

SEQ ID NO: 6548 - protein, 350 aa, Triticum aestivum
  misc_feature (210)..(210): Xaa can be any naturally occurring amino acid
MGSMAAEMTAVEEEACIYAMQLSSTAVLPLTLKNAIELGMLEVLMGAGGKMLSPSEVAARLPPTTTNPDAPAMVDRMLHLLASYKVVSCEVEEGTHARRYGPTPVCKWFTPNQDGISMAPLLLLTNDKVPMESLYHLKDAVLDGGLPFHKAHGMTMYEYTKTDARLNHVFNEAMKGYTTIITGKLVDLYTGFHDIATLVDVGGGVGATIXHIKGINFDLPHVIAEARQSPSVQHVAGDMFKNVPSGDAIVLKWILHNWPDEHCTTLLKNCYGALPAHGRVVVVEGILPVKPEATSRGQQASLTDMIMLTHTAGGKERNQREFEELAKSAGFTGVMTAYIHSNTWVIEFTK

SEQ ID NO: 6549 - protein, 222 aa, Triticum aestivum
MAGMGMEEVDMDMEDDGEMDMEMEMQLEEARWPEVACPYCYEDYDLGSLCVHLEEDHPYEPHPAPCPICSEKITRDMLNHITMHHGYLFKNGSRLRRFVIPERRALSLLSRDLRDAHLQALLGGGHSHRSRNTTTATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 6550 - protein, 454 aa, Mesorhizobium loti MAFF303099
MSDAEATAPRSSWRFAGRDEDDQPSLREVNSTIAVPSSGVWFRRLFAFMGPGYMVSVGYMDPGNWATDLAGGAQFGYTLLFVIMLSNLMAILLQALAARLGIATGRDLAQACRAYYPRPVNFVLWIACELAIIACDLAEVIGTAIALKLLFGIPLIGGAILTALDAFLVLLLMNKGFRYLEAFVIALLIIIFSCFAIQIFVAAPPAGTILHSMFVPSSEIVTNPAMLYIAIGIIGATVMPHNLYLHSSIVQTRAYERTEKGKRDAIKWATTDSTIALMLALFVNAAILIVSAVAFHNTGHQDVAEIDQAFELLSPLLGLGIASILFAVALLASGLNSTVTATLAGQIIMEGFLRLRIPNWARRLLTRGLAIVPVVVVTALYGEKGTGQLLVFSQVILSMQLPFAVVPLVQFVSDKKKMGNLAIPRGVAALAWVVAAIILVLNFKLLYDTLFGVG

SEQ ID NO: 6551 - protein, 656 aa, Oryza sativa Indica Group
MAGCPGNCGGVGIPYPFGIGAGCFRPGLEIICKNDAPFLAGSGNQLIPISDLSIDSSEARVTLPIGWQCFNSSDQVDSYDESMVDFNRDGMYRISHTRNHLVVLGCNTLGYVGSQRRSGVVGSDYDRASYTGCLCYCNDSSSAVSSECDGVGCCQVDIPPDISDNMVSFDNYPHERNLNYSPCDYAFLVEKTNYTFSTADLRMDKSRTMPVTLDWAIRDNLTCSQARKTAAQVGGYACVSDNSDCHDSTNGPGYVCKCNKGYEGNPYIPNGCIDIDECQLPNTCYGRCRNKPGSFECWCPKGHSSADPFKERCTPNFPLPAQIVVGVLGGLFIIALLVFIALLRREKRKTKEFFEKNGGPILEKINNIKLFKKEDLKPILKNANVIGKGGFGEVYKGHIGNNNQLVAVKKPINVNLAKKDQFANEVIIQSRVIHKNIVKLIGCCLEVDIPILVYEFVSKGSLEDVLHGSNRLPLNLDQRLQIAAESAEGLAYMHSKTSTTILHGDVKPANILLNDDLLPKISDFGISRLLAIDNDHTMSVIGDMSYMDPVYFQTGLLTDKSDVYSFGVVLLELITRKKASHSDNNSLLRNFLDAYTSGKTVTEFVDEEIAAANDHELLVNLAGMIAQCLNLEVDQRPEMTDIAERLRYMAKRARSN

SEQ ID NO: 6552 - protein, 386 aa, Clostridium perfringens str. 13
MNKIYFDNAATTFPKPDSVIKAMFDYMSFEGGSANRGSSSTALQSSRAVYECRYEIAKFFNFPKSENVIFTNNITTSLNMLLLGIIKSDWHIITTSMEHNSVLRPLVKISEELPNVELDIVQCNNEGLVSVEKIKEKLKSNTKLIILSHASNLVGTIQPIKEIGKLCKENNIFFILDSAQTAGVIPIDMTELNLNALAFTGHKALLGPQGIGGFIIDDKLNSICKNIFSGGTGSNSSLIEHPQELPDKFEYGTLNTPGIIGLLEGIKFIEKEGIENIKAKEEVLCQKAMDLLSEIPEVKIYGPMDAKKKTSTISFNIEGMDPEFTGFLLDSEFNITCRTGIHCTPLAHKTVGSYPAGSIRISLGYFNTIEEVYRFVEVIKELISRR

SEQ ID NO: 6553 - protein, 233 aa, Zea mays
LDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 6554 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 6555 - protein, 119 aa, Brassica napus
MDTIIDRGAPKARNFEPYASNGGSIVAISGKDFAIVASDTRLSEGYMIYTRKQSKLFQLSDKSVLGCTGCWCDTLSLTNIIQSQLKSYLYDHNKIMQPNSIAQLLSTLLYSRRFFPYYV

SEQ ID NO: 6556 - protein, 388 aa, Idiomarina loihiensis L2TR
MNLHEYQGKQLFKEFGLPVSEGYACDTADEAVEAAKRIGGDIWVVKCQVHAGGRGKAGGVKLVKSLDDVRAFAEQWLGKNLVTFQTDEKGQPVAKILVESCTDIADELYLGAVVDRASRKIVFMASTEGGVEIETVAEETPEKILKAEIDPTVGAQPYQGRELGFKLGLTPDQVKQFTKVFMGLAKMFEQYDLALLEINPLVITDEGNVHCLDAKVGIDSNALYRQPKIREMHDPSQDDAREAEAAKWELNYVALDGNIGCMVNGAGLAMGTMDIVKLSGGEPANFLDVGGGATKERVSEAFKIILSDSSVKAVLVNIFGGIVRCDMIAEGIIGAVEEVGVKVPVIVRLEGNNAELGTQKLNESGLNIIAAESLSDAADKVVAAAGGQ

SEQ ID NO: 6557 - protein, 520 aa, Idiomarina loihiensis L2TR
MAIDIKVPQLPESVADATIATWHVKPGDKVSRDQNLVDIETDKVVLEVVAEADGVLGEITAEEGTTVTAEEVIGKIEEGDGASASDDKSDNKDSDDDKKSEKKESDSSEDKGSDKKGSGEKMEVKVPQLPESVSDATVSTWHVKAGDAVKRDQNLVDIETDKVVLEVVAPADGVLAEIKHEEGATVGADDVIGIVEAGGSAGGSSSKSDDSKSESSSESKDDDGDNEVAGPAVRRLLGEHGLKPSDVKGTGKGGRVTKEDVEKHVKAQSSKSSDSSKQQSSQPAVSGDRDQKRVPMTRLRKRIAERLLQAKNDTAMLTTFNEINMKPIMDLRKKYKDVFEETHGTRLGFMGFYVKAVTEALKRFPDVNASIDGDDIVYHNFFDISIAVSTPRGLVTPVLRDTDRLSIADMENGIRDLAIKGRDGKLTMDEMQGGNFTITNGGVFGSLLSTPILNPPQSAILGMHKIQERAMVVDGKIEILPMMYLALSYDHRIIDGKQSVGFLVTVKELLEDPQRLILDI

SEQ ID NO: 6558 - protein, 324 aa, Candida tropicalis
MSTTPTIPTIKLNSGYEMPLVGFGCWKVTNATAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKLIADKHGKSPAQVLLRWATQRNIAVIPKSNNPERLAQNLSVVDFDLTKDDLDNIAKLDIGLRFNDPWDWDNIPIFV

SEQ ID NO: 6559 - protein, 625 aa, Bacillus subtilis
LSTGITGVQAAPASSKTSADLEKAEVFGDIDMTTSKKTTVIVELKEKSLAEAKEAGESQSKSKLKTARTKAKNKAIKAVKNGKVNREYEQVFSGFSMKLPANEIPKLLAVKDVKAVYPNVTYKTDNMKDKDVTISEDAVSPQMDDSAPYIGANDAWDLGYTGKGIKVAIIDTGVEYNHPDLKKNFGQYKGYDFVDNDYDPKETPTGDPRGEATDHGTHVAGTVAANGTIKGVAPDATLLAYRVLGPGGSGTTENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKAAIMNTAVTLKDSDGEVYPHNAQGAGSARIMNAIKRDSLVSPGSYSYGTFLKENGNETKNETFTIENQSSIRKSYTLEYSFNG

SEQ ID NO: 6560 - protein, 259 aa, Neisseria meningitidis MC58
MRYAALDGGKRLRPMLVLAASELGEAVHEAVEQAMAAIEMIHVYSLVHDDMPAMDNDSLRRGKPTCHIKYGEATALLTGDALQTQAFDVLSRPTELPAARQLAMLSVLAKAGGSRGMAGGQAIDLANVGKQMVQADLEQMHSLKTGALIRAAVLLGATACPDLSDAELSVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 6561 - protein, 796 aa, Acidovorax sp. JS42
MSARFEATALVVPFENLRMSDVEVVGGKNASLGEMISQLPQGVRVPTGFATTAHAFREFLKYEGLHDRISQRLAALDVDDVRALAEAGAEIRGWVENQPFPADLEKAVREAFAALSAGNDQASFAVRSSATAEDLPDASFAGQQETFLNVVGIEAVLHKMKEVFASLYNDRAISYRVHKGFAHDVVALSAGVQRMVRSDLGAAGVMFTIDTESGFEDVVFITSSYGLGETVVQGAVNPDEFYVHKPMLQAGKQAVIRRNLGSKLIQMVFSTAQEKAASGKLVKTTEVATELRNRYSLTDAEIEQLAHYALVIEQHYGRPMDIEWGKDGTDGQLYILQARPETVKSQAKGQAEQRFKLKGHGPVLAEGRAIGQKIGTGPVRLVNDIAEMDKVQPGDVLVTDMTDPNWEPVMKRASAIVTNRGGRTCHAAIIARELGIPAVVGCGHATDVLKDGTLVTVSCAEGDTGRIYDGLLETEVTEVQRGEMPPISTKIMMNVGNPQLAFDFAQLPNEGVGLARLEFIINNNIGVHPKAILDYPAVDADLKKAVESVARGHASPRAFYVDKVAEGVATIAAAFWPKPVIVRLSDFKSNEYRKLIGGSRYEPEEENPMLGFRGAARYVSQDFGEAFAMECEAIKRVRNDMGLTNVQVMVPFVRTLGQAERVTKLLAQHGLQRGENELKLIMMCEIPSNAILAERFLEYFDGFSIGSNDLTQLTLGLDRDSGLELLAADFDERDPAVEALIHLAIKACRAQGKYIGICGQGPSDHPDFAQWLAREGITSISLNPDSVIDTWQQLAR

SEQ ID NO: 6562 - protein, 86 aa, Silene latifolia
PAGLFFRHAGHRGKVVDFHWNSIDPWTLVSVSDDCSSSAGGGTLQIWRIIDLLYRPEEEVLAELDKFRSHVAACSPTPTKDVNHSA

SEQ ID NO: 6563 - protein, 425 aa, Dechloromonas aromatica RCB
MHFSDLGLKAELLRAVADQGYDTPTPIQQQAIPAVMTGRDLMATAQTGTGKTAGFTLPILHRLCSGPNDRLTRVAKTPRVLVLTPTRELAIQVEESVRTYGKHLPITSLAVFGGVGINPQIANLRRGVDILVATPGRLLDHVQQRTVDLSKIEIFVLDEADRMLDMGFIRDIRKIIALLPKQRQNLMFSATFSPDIRELAAGLLHNPASVDVAARNTAAETVTQRVIETNRDQKKELLCHLFETRGWHQVLVFARTKHGADALSKTLEKAGIKSAAIHGDKSQGARTRALTEFKEGKLVALVATDIAARGIDIDALPYVINYELPNVAEDYVHRIGRTGRAGMEGEAISLVSHDERGSLRDIERLIKRDLERVVIPGFEPSAIAPPKPVQPPRGARKPQPGRPSAQKTAQKPGGPAQHRSGSRHR

SEQ ID NO: 6564 - protein, 187 aa, Acidovorax sp. JS42
MSVLNTTIKPFKAQAFKSGKFIEVTEKDVLGKWAVFFFYPADFTFVCPTELGDVADHYDELQKLGVEVYSVSTDTHFVHKAWHDASDTIRKIKYTMLGDPTWQISQNFDCLREGQGLADRATFIVDPQGVIQAMEITAEGIGRNAADLLRKVKAAQYVASHPGEVCPAKWEEGAKTLAPSLDLVGKI

SEQ ID NO: 6565 - protein, 145 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 6566 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 6567 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 6568 - protein, 508 aa, Burkholderia xenovorans LB400
MNAVTRESSGNIGTARLLIAGEFVESKTTEWRDIVNPATQEVLARVPFATAEEVDAAIRSAHAAFATWKNTPIGARMRIMLKYQALIREHMPRIAKTLSAEQGKTIPDAEGDIFRGLEVVEHAASIGTLQQGEFAENVAGGVDTYTLRQPIGVCVGITPFNFPAMIPLWMFPMAIVCGNTFVLKPSEQDPLSTMQLVELALEAGVPKGVLNVVHGGKDVVDALCTHELVKAISFVGSTAVGTHVYRLGSEHGKRVQSMMGAKNHAVVLPDANREQTLNALAGAGFGAAGQRCMATSVVVLVGAAQQWLPDLVAKAKTLKVNAGNEPNTDIGPVVSRAAKQRILDLIETGVKEGATLALDGRDVKVAGYEQGNFIGPTVFTDVTTDMEIYRQEIFGPVLVVLNAATLDDAIALVNRNPFGNGVGLFTQSGAAARKFQSEIDIGQVGINIPIPVPVPFFSFTGSRGSKLGDLGPYGKQVVQFYTQTKTVTARWFDDDTVNDGVNTTISLR

SEQ ID NO: 6569 - protein, 148 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 6570 - protein, 427 aa, Physcomitrella patens subsp. patens
MSGAASAIFLLDMKGRVLIWRDYRGDVSSVQAERAFAKLMDGENDPASHDPILLENGVTYLFIQHNNVYVMTASRQNCNAASLLLFLHRIVDVFKHYFEELEEESLRDNFVVVYELLDEMMDFGYPQYTEAKILSEFIKTDAYRMEVTTRPPMAVTNAVSWRMEGIKYKKNEVFLDVVESVNILVNSNGQLVRSDVVGALKMRTYLSGMPECKLGLNDRVLLEAQGRATKGKAIDLDDIKFHQCVRLTRFENDRTISFIPPDGSFDLMTYRLSTQVKPLIWVEAQVERHSRSRVEFMIKARSQFKERSTASNVEIELPVPSDASTPAVRTSMGTAVYAPEKEALIWKIKSFPGGKEYMMRAKFGLPSIEAEETVVEKRPPIRVKFEIPYFTVSGIQVRYLKIIEKSGYQALPWVRYITTAGEYELRI

SEQ ID NO: 6571 - protein, 333 aa, Acinetobacter sp. ADP1
MTDLPTTMRHIEISQSGDPDVLHIVETSLPKIKIDEILIEVKAFGINRPDVLQRKGLYPMPKDVTPIPGLEVAGIVTAIGENVSQFKVGDRVCALTNGGGYAEYCAVPETQTLPIPSNLSYIEAAAIPETYFTVWANLFDIGQLSVGETALIHGGASGIGTTALTLCHAMGIKTFCTVGSDDKVDALNKITTAINYKKHNFEEVILEQTQNKGVDVILDIVGGKYFQQNMNTLKRDGRLVILGFMGGRYAKEFDLQQLILKRAKVTGSTMRARTDQEKSEITQSLRQHVWPLLSEGKSLPLIYKSFSFEDISKAHTCMEESEHIGKIVITLTE

SEQ ID NO: 6572 - protein, 339 aa, Colletotrichum gloeosporioides f. sp. malvae
MVVSQPEVDFAREKDRLAEAQPQGQRAASSHDDAAPPPIGMTEPDERRGTRSRHDHSGKRDKVVRFGDYILGNTIGEGEFGKVKLGRKQDGGVQVIPVAVKLIKRDSVGNNPSRLAKIYREIAILRGISHPNIVRLHEMVETERHIGIILEYASGGELFDYILNHRYLKDNAARRLFAQLVSGVGYLHKKGIVHRDLKLENLLLDRNRNIIITDFGFANTFDGTRKGDLMQTSCGSPCYAAPELVVSDSLYTGRKVDVWSCGVILVSTAARYAMLAGYLPFDDDPANPEGDNINLLYKIVNTPLTFPEYVTPTPVTYSAASRSQSPQASGSLRGGRTAG

SEQ ID NO: 6573 - protein, 839 aa, Nostoc punctiforme PCC 73102
MAAIAIVIVSHSKQLALGVRELAAQMVRGQVSIAVAAGIEDPENPLGTDPIQVYEAIASVFSDDGVLVLMDLGSALLSAEMAIEFLPEAQQQKVYLCEAPLVEGAVAAVVAAAAGKNIHQVMAEARGALLAKATQLGVSPLSVVSDNIEVRNSELPVKEIRLIVSNRLGLHARPAAQFVGTSARFQSQILVQNLTRNTGLVRGDSINQVTTLGVRQGHELVITATGSDADEALAALQALFANNFGEDNVVLNSPPVFHHEVTPATHGELSGIAASAGVAIAPVVNYQPTHITITEYHVDNPESEWQRVQAAIHTAKQEIQAVFSQASLQIGDTEAAIFDAQLLFLEDPVLLEAAHQRILDHYINAEAAWQAVVDEVATSYRTLEDAYLQERVEDVVDVGQRVLRLLAGNAPANLHLSEPAILVATDLTPSDTARLDPRMVLGICTTSGSATSHSAIIARTLGIPAVLGVDSQVLHLADGTLMALDGESGKAWVEPESHILDLLEAKREAWQTAQEEARATAHQPAITLDGRQVSVFANIGSINDVQVAVASGAEGVGLLRTEFLYLDRTSAPTEEEQLEVYQAIAQVLDNRPLIIRTLDVGGDKPLPYLRVGFPEANPFLGWRGIRFCLDHLDLFKTQLRAILRASVGHQIKIMLPMIATVTEVRAAKVILGEVQAELNQAGIPFDAAMKVGIMVEVPSAVAIADQLAAEVDFFSIGTNDLSQYVMASDRTNPRVANLVDALHPAVLRMVQQTIQAAHAAGISVGLCGELAADTLATPILLGLGLDELSVNPQSIPGVKQAIARLSIVESEAIAASALQQDSAVHVREIISTSIIPPTN

SEQ ID NO: 6574 - protein, 145 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 6575 - protein, 405 aa, Neisseria gonorrhoeae FA 1090
MALIVHKYGGTSVGSPERIKNVAKRVAKARAEGHDIVVVVSAMSGETNRLVALAHEMQEHPDPRELDVVLATGEQVTIGLLAMALKDIGVDAKSYTGWQVSLKTDTAHTKARIESIDDEKMRADLAAGKVVIVAGFQGISSEGNISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERKDSIGAASIDGDDTVCKVSAVGLGMRSHVGVAAKIFRTLAEEGINIQMISTSEIKVSVLIDEKYMELATRVLHKAFDLG

SEQ ID NO: 6576 - protein, 470 aa, Francisella tularensis subsp. tularensis SCHU S4
MSDIKTQVVVLGSGPGGYSAAFRAADLGLEVVLVERYAEIGGVCLNVGCIPSKAMLHIAKVINEARHLESLGIIEMGGLKINRENLLKYKDGVIGKLTGGLKGMAQMRKVKIVQGYGKFTSDKELAVEAADGKVTKIAFDNCIIAAGSSVIKLPFVPEDDRIIDSTGALEMKEIPETMLVVGGGIIGLEMAQVYSELGTKITVVEFADQLMNGVDKDLVKAYQKVNSRYDVRLKTAVTAMEAKEDGIYVTMEGDHPAKDERFDRVLMAIGRKPNGKLIDAEKAGVKVDERGFIPVDKQLRTNVPHIFAIGDIVGQPMLAHKAVPEGRTAAEVISGLNHSFDPLVIPSVAYTDPEVAWVGETETSAKAKGIKYEKGVFPWAASGRSLSIDRSEGMTKILFDENHKIIGASIVGTHAGELISEAAIAIEMGCDAEDIALTVHPHPTLSESLMMATEVYEGTATDLPPQKKKK

SEQ ID NO: 6577 - protein, 631 aa, Francisella tularensis subsp. tularensis SCHU S4
MSIEIVKVPDIGDYDNVDVIEVNVAVGDVIAEEDSLITLETDKASMEVPSPFAGKITKLTVKVGDKVSQGTAIMEVEVESAADQAATTQSQPQTTSSAPVAATTNLIVDVEVPDIGDYDSVDVIEVSVKVGDEIAEEDSLITLETYKASMEVPSPVAGKVVEVITKVGDKVSQGSLILKVETGSSAQAPAQEQSQQSAPVKSAAEEIIDVKVPDIGDYDSVDVIEVSVAVGDKIEEEDSLITLETDKASMEVPSPVAGEVVEIITKVGDKVSQGSLILKVKTQGSAPVEQTSSQPAPAKQEQAKQQAATPAAPTPASSSVNEYAVDNSNAHASPAVRKLARILNIDLSKVKATGRKGRVTKEDCYNYIKHAVTQVQTGKVAASGSGLDLLDDPVVDFAKFGEIETQPLSRINKISAKNLHRNWVKIPHVTFYDDADVTDLEEFRNAKKAFAEKKGIKITPLSFLVKAAAVALQEFPRFNSSLSNDGENLIIKKYYNIGFAADTPAGLMVPVVKDADKKGIIEISKDIMELAGKARDGKLGAKDMTGATFTISSLGVLGTTSFTPIINMPEVAIMGVSKTAVKPIWNGKEFIPRTMLPLSLSTDHRVIDGALAAKFLTRYCQILSDLREIIM

SEQ ID NO: 6578 - protein, 583 aa, Myxococcus xanthus DK 1622
MSELLSRIGSPSDVRALPEEALPLLCQELREDIISICGRVGGHLGASLGAVELIVALHRVFHSPQDALLFDVGHQTYAHKLLTGRRDRMHTLRHAGGIAPFLDPRESPHDALLAGHSCTAVSAALGVLEGRRQQGHRGHVVAVLGDGGLTGGLTFEGLNNAGGSSLPLVVVLNDNQMSISANVGAIPALLRTREARDFFEGLGFTYLGPVDGHDLPALIRALREARASSRPVVVHALTLKGKGFPPAEADTQTRGHAMGPYEWRDGKLVRSRGGQRTFSEAFAAVLEDAMARDPRVVAVTPAMLEGSALNALKARFPDRVHDVGIAEQHAVTFSAGLASAGARPVCCIYSTFLQRAYDQIIHDVCLPGLPVVFAVDRAGLVGADGATHQGTYDVASLRPLPDLHLWSPMVGEDLAPMLDTALAAPHASVIRFPRGTLPPLPEGLGAGEAPLRGARWLLRAEQPRLTLVTLGPLGIAALEAARGEPGWSVLDARCASPLDEAALLEAGRSGHVVVAEEGTTRGGLGSAVLELFAAHGLMARVRLMGMPDAFVPHGDARVQRAEQGLDAEGLRRAGLALLAGGGR

SEQ ID NO: 6579 - protein, 306 aa, Arabidopsis thaliana
MAATSLTAPPSFSGLRRISPKLDAAAVSSHQSFFHRVNSSTRLVSSSSSSHRSPRGVVAMAGSGKNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 6580 - protein, 258 aa, Neisseria gonorrhoeae FA 1090
MSDNALTSSRRFGGIARLYGDSALTHFSQAHVCVVGVGGVGSWAVEALARTGIGRLTLIDLDNVAESNANRQLHALTGDFGKAKVTALRERITQINPQCEVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKEKMRVPCVYSTENIMPPQSGAACSADAAPQGLSCAGYGASMLVTASFGLYCAQAAVEHIAGKK

SEQ ID NO: 6581 - protein, 369 aa, Ralstonia eutropha JMP134
MRVFKLPDLGEGLQEAEIVTWHVKVGDTVAADQPLLSVETAKAIVEIPSPYAGTIGKLFAQAGDLVHLGAPLASFEGAGNDADAGTVVGAVKVGSHVVAESATPLSGGAAGAGIKATPAVRALARRLGVDLAMANPSGPDGVVTAADVERVASTLAETGPGEVLRGVRRAMAQNMARAQSEVAAATVMDDADIHAWQGAHDVTIRLVRALVAGCRAEPGLNGWYEGQTGKRHVMQKIDVGIAADLPEGLFVPVLRNVGNRDAADLRHGLDRMRADIRARTIAPEEMRGNTITLSNFGMIAGRYAAPIVVPPTVAILGAGHIRDEVVAANGVPAVHRVIPLSLTFDHRVVTGGEAARFLAAVIADLALPE

SEQ ID NO: 6582 - protein, 354 aa, Vitis aestivalis
MRRGPLNPSNLKLTLPPDEDSLTKFLTQSGTFMDGDLLVNRDGVRIVSKSEAEVPPLIKPSDNQLSLADIDTIKVIGKGAGGTVQLVQHKWTGQFFALKVIQMNIQEAALKHIAQELKINQSSQCPYVVVCYKSFYDNGAFSIILEYMDGGSLLDFLKKVKSIPEPYLAAICNQVLKGLSYLHHERHIIHRDLKPSNLLINHRGEVKITDFGVSAILTSTSGQANTFVGTYNYMSPERISGGKYGSKSDIWSLGLVLLECATGQFPYSPPEQGEGWTSFYELMEAIVDQPPPCASTNQFSAEFCSFISACIQKDPNDRKSAHELMAHPFISMYRDLNVDLATYFTNAGSPLATF

SEQ ID NO: 6583 - protein, 432 aa, Francisella tularensis subsp. tularensis SCHU S4
MSEYFLFSLLTVVAALMSYINTKFLKLPKAIGLTILSITFSALCASFLSPSNFLVVALSSFDFKKTVLDGMLSFLLFANALHFNMIDLKKELKAIFGLASIGLLLSALTTAILIYGFCLLVGFEISLGYCLVFGALISPTDPIAVISTLAGNKSIPKHIKTRVVGESLFNDATGIVLFVVLSNIVFFGSGGEFGQAINGHGIEYIWIIAKQIGSEAGGGILLGYIFARVALIFLKTNQDSETSIFVTLAVASMGYVIAHSLNVSGPIAMVVAGLFIGNNLSDRKKTSPDQVEKLDNFWMVIDNMLNSFLFILIGLELTSIPFNHGAFWVGAAGIFIVTFARLVSISIPITVIDKKLTRASAKDNLLVAWSGVRGGISLALALSLPDEGNVIVSITYTVVILSILAQGSTLKIVLNIIYPHNITKKAANTVDN

SEQ ID NO: 6584 - protein, 488 aa, Candida glabrata CBS 138
MDVERQTFKVFNQDFTIDKRFELIKEIGHGAYGIVCSARFTEASEETTVAIKKVTNIFSKTLLCKRSLRELKLLRHFRGHKNITCLYDMDIVFYPDGSINGLYLYEELMECDMHQIIKSGQALTDAHYQSFTYQILCGLKYIHSADVLHRDLKPGNLLVNADCQLKICDFGLARGYSENPEENNQFLTEYVATRWYRAPEIMLSYQGYTKAIDIWSTGCILAEFLGGKPLFKGKDYVDQLNRILQVLGTPPDETLRRVGSKNVQDYIHQLGYIQKIPFSELFPNANEDALDLLEGMLAFDPQKRITVDKALEHPYLTIWHDPADEPECNEKFEFSFESVNEMEDLKRMVVDEVQSFREFVRQPLMDDKSQEDEQQQGSPENYQQTSPTNISPQRLHNNGSHDLLQEPEFLTQTPNQNSTIPDQLQESFVGIHSDNLPEHDTDFPPRPQENILASPMGLPSASDRNSMNNDSFLDLERELEFGLDRRYL

SEQ ID NO: 6585 - protein, 552 aa, Ralstonia eutropha JMP134
MIALREAWQAGLFHRGNWFPNIVAGAIVGVVALPLAMAFAIASGAKPEQGLYTAIVAGLLVSACGGSRVQIAGPTGAFIVILSGITAKHGIDGLQIATLMAGLILLAMGLARLGSVIRFIPAPVIVGFTAGIGVIIFVGQWRDFFGLPAVAGEHFHEKLWHLLQVFPQLHVATTAIAVLSLLLVVGAPRVHWLRRIPGPLLALVAATAIQAVFRFEGVATIGSAFGGLPRGLPGLSLPEVTLARVIELAGPAFTIAMLGAIESLLSAVVADGMAGTRHDSNQELMGQGLANVVAPLFGGFAATGAIARTATNIRNGGNSPLAGITHAVTLVLVVLFLAPLAANVPLAALAAILFVVAYNMSELRHFARMVRRAPRADVAILLITFSLTVLTDLVVAVNIGVILAMLQFLRRMSVSVEVSRQDAPDLEHELSRDGGTPPGLPPGVLVYGIDGPFFFGAVENFERALIQTHTDPRVLLIRLRRVPFMDMTGLQTLDEVIGKLRERGVAVVLCEANARVRQKLMRAGVLAALGEANYQDTLAAAAERCAQLAREQ

SEQ ID NO: 6586 - protein, 259 aa, Aspergillus nidulans FGSC A4
MADAAPRGRGGFGSRGDRGGDRRGRGRGRGRRGGKTEEKEWQPVTKLGRLVKAGKITSMEQIYLHSLPVKEYQIVDFFLPKLKDEVMKIKPVQKQTRAGQRTRFKAVVVIGDSEGHIGLGIKTSKEVATAIRAAIIIAKLAVLPVRRGYWGTNLGEPHSLPVKQSAKCGSVSVRLIPAPRGTGLVASPAVKRLLQLAGVQDAYTSSSGSTKTLENTLKATFLAVVNTYGFLTPNLWTETKLTRSPLEEFSDVLRQGKKY

SEQ ID NO: 6587 - protein, 527 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 6588 - protein, 376 aa, Streptomyces alboniger
MAPTEATRGGPADPAPAPEAHRGGHTEHADPAEHAAQFGAQERILTLVWGYISSEILDLATRLDLPDLMGTEERAAAELAASLDTDPVATLRLLRAFAALGLAEETGAGRFRLTPAGHRLRTDVPDSLHAFVRQGMGVFRQAWSHFDHSIRTGEPAFDQVFGTDFFSYLSERPELSGTFTSSMREATRTMSTALAKEEEYDFSSYGTVVDIGGADGSLLAAVLSAHPGVEGVVFDSPEGARDAAATLDAAGVGERGRVETGDFFTRVPGGGDLYVLKSILHDWSDARSADILRTVRAAMPAHARLLVVEVLLPDTVDSSAHPLGYLSDLYMLVNMGGRERSERDLRSLLSDTGFRTTRVRTPPGLTPFSLIEAAPV

SEQ ID NO: 6589 - protein, 220 aa, Zea mays
  misc_feature (200)..(200): Xaa can be any naturally occurring amino acid
NESTIEENEIRITAQGLIRNYVSYATSLLQERRIKEIVLKAMGQAISKSVAVAEIIKKRIPGLHQDTNISSVSITDVWEPIEEGLVPLEMTRHVSMISITLSPRELDKHTPGYQAPVYIEQPRQQQVPPPQRQPRRPPAQFQQLEYEDSYARGRGRGRGRGRGWGRGGYGGYGGYGNNQGGYHQGGGYYDNQGGYNGYDXNQGGYSGYDNQGGYGGGYGY

SEQ ID NO: 6590 - protein, 586 aa, Ralstonia eutropha JMP134
MSFALHGIPVSRGVAIGRAHLLAPAALDVSHYLVDEDRLDDEVERLRSARAAVRAELITLKRDLPRDAPEELGAFLDVHAMILDDEALSREPEALIRGRRYNAEWALTTRLEELMRQFDEIEDEYLRERKTDIHQVVERILKVLAGAPVLAPAPVPALAADGEPAPGVIVVAHDIAPADMLQFRHTVFHGFVTDMGGKTSHTAIVARSLDIPAAVGVQSASELIRQDDWIIVDGDAGLVIVDPSAIILEEYRHRQSERALEKKRLQRLRHTPAVTLDGQEIDLLANIEMAEDAGVALSAGAVGVGLFRSEFLFMNRRGELPDEDEQFAAYRGAVEAMHGLPVTIRTIDIGADKPLDGRGDDFETALNPALGLRAIRWSLSEPAMFLTQLRALLRASAFGPVRLLVPMLSHAREIDQTLELLAQAKRQLDERGVPYDPGLKVGAMIEIPAAVLLLPLFLRRMDFLSIGTNDLTQYTLAIDRADNAVAHLFDPMHPAVLQLIARTIREANRAGVPVAVCGEMAGDPSMTRLLLGMGLREFSMHPAQLLRVKQEVLHADCARLEPLVDQVLNAYDPLEQTAALEQLAKP

SEQ ID NO: 6591 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKSIADKHGKSPAQVLLRWATQRNIAVIPKSNNPERLAQNLSVVDFDLTKDDLDNIAKLDIGLRFNDPWDWDNIPIFV

SEQ ID NO: 6592 - protein, 297 aa, Petunia x hybrida
MSNIVSLYFYLTTKSITTCQFCPSINQLCYYSFAPVCSLYLYSCNLRTNTSKSRAKMSPPVSVTKMQVENYAFAPTVNPAGSTNTLFLAGAGHRGLEIEGKFVKFTAIGVYLEESAIPFLAEKWKGKTPQELTDSVEFFRDVVTGPFEKFTRVTMILPLTGKQYSEKVAENCVAHWKGIGTYTDDEGRAIEKFLDVFRSETFPPGASIMFTQSPLGLLTISFAKDDSVTGTANAVIENKQLSEAVLESIIGKHGVSPAAKCSVAERVAELLKKSYAEEASVFGKPETEKSTIPVIGV

SEQ ID NO: 6593 - protein, 356 aa, Arabidopsis thaliana
MELDLTPKLPKKVYGGDGGSYSAWCPEELPMLKQGNIGAAKLALEKNGFAVPRYSDSSKVAYVLQGSGTAGIVLPEKEEKVIAVKQGDSIALPFGVVTWWFNNEDPELVILFLGETHKGHKAGQFTEFYLTGTNGIFTGFSTEFVGRAWDLDENTVKKLVGSQTGNGIVKLDAGFKMPQPKEENRAGFVLNCLEAPLDVDIKDGGRVVVLNTKNLPLVGEVGFGADLVRIDAHSMCSPGFSCDSALQVTYIVGGSGRVQVVGGDGKRVLETHIKAGSLFIVPRFFVVSKIADADGMSWFSIVTTPDPIFTHLAGNTSVWKSLSPEVLQAAFKVAPEVEKSFRSTRTSSAIFFPPSN

SEQ ID NO: 6594 - protein, 438 aa, Candida albicans SC5314
MASQIHFLDIKGKPLLSRDYKGDISSTTIEKFPLLLLELENTVDDGEYKPFINHEGINYIFINHNNLYICALTRKNENIMTIIIFLSKLVEVMTQYFKSLEEESIKDNFVIIYELLDEMMDFGVPQTTDTKILKEYITQDYYSLIKSTPTHLVAPPNALTNSVSWRKEGIFYKKNEAFLDVIESINMLITANGQVLNSEILGEIKIKSHLSGMPDLRLGLNDKGIFTGNNDATTDSGKNIEMEDIKFHQCVRLSKFENEKLITFIPPDGEFTLMSYRLSSSQFLMKPLILVNCKTKVHKHSRIEIVCTVKAQIKKKSTANNVEVVIPIPEDADTPKFSPEYGSVKWIPEKSCLIWKLKTFPGGKQFSMRAELGLPAVTDPESIMSKKPIKVNFSIPYFTTSGIQVRYLRINEPKLQYQSYPWVRYITQSGDDYIVRTK

SEQ ID NO: 6595 - protein, 484 aa, Oceanobacter sp. RED65
MLDTEFLIIGAGFGGIGMAIKLKQQGHNCITLWEKESDLGGCWRDNHYPGAACDVPSHLYSYSFAPNSQWSHKFAPQQEIYDYIKDCADRFKITEHIHFNKEVSEARYDSENNLWRVTDTQGNELRCRYLITATGQLNRPAYPGIAGLESFKGEQFHSARWNHDVDLKDKNVAVIGTGASAIQFVPSVVNKAKHVTLFQRSAPYVIPKPDRPYSKFERWAFKRIPGLLKLSRLKTYLQFEVRFLAFRDLQFLLKPYIAYWRRFMNKQVKDEGKRKKLTPDYIIGCKRILIANNYYPAIDQDHVDLVDSGIAEVTPSGITDKQGNQHDVDVIILATGFKATDFLSPIKIYGQDGISLNNAWKDGAEAYLGMCVNGFPNCFMLYGPNTNLGHSSIIYMLESQINFILKAIDYAKRHDTKTLNVKADIQSKYNDTLQRKIHASVWDQGCTSWYKNESGKNTNNWSGFTLSYRRLTKHFKAKDFATNE

SEQ ID NO: 6596 - protein, 295 aa, Triticum aestivum
  misc_feature (108)..(108): Xaa can be any naturally occurring amino acid
TSGRKRQKTSQSVPPLPVPSPPVMHPQQMATPTQPSSSAAKKGFLPGTKGKKTKPGQKIPGGSAVKSMPPSAGPSGRGPHMNRNFPGRPAAPEPSQGQHHLNPLNWSXKFMSRWPEDNNFYEATITDYNAEKIKPEDIIWQGEDPGLYQGGRGAPGSGGKKSTSRVMPTPGTGRGRGFQKNVSKKDFPRSQNGVGKRSSDDIDILHTESLIKEVERVFSVSHPDPLEVDKAKKALKEQEQSLIDAIARLAEASDGESDEQNRGRRMGPYGGHPHQANYADAMGVDGDHMVGGAAT

SEQ ID NO: 6597 - protein, 266 aa, Lentisphaera araneosa HTCC2155
MKELSFIGTGKMASAIAKGICLNGVLTSEEIIGTAPDQSRFDFRDLTNIPVSDDNAEAMNSRMVVLAFKPQVAEQICRSLQPMVKDQYFVSICAGITLDNLEQWLGTDKVTRTMPNTPLCVSKGAVAYCSASGVGESDLALLTQYFECSGILAKVAEDDINTITALSGSGPAYVFEMIDALAQSAKANGLSDEVALAFSIQTFLGSAQMLSDKLGTPEELRNAVTSPNGTTYAALENFKQNNLREVLHQGFQAAKDRGDELSRGEK

SEQ ID NO: 6598 - protein, 204 aa, Brassica napus
  misc_feature (77)..(77): Xaa can be any naturally occurring amino acid
  misc_feature (156)..(156): Xaa can be any naturally occurring amino acid
  misc_feature (172)..(172): Xaa can be any naturally occurring amino acid
  misc_feature (180)..(180): Xaa can be any naturally occurring amino acid
  misc_feature (190)..(190): Xaa can be any naturally occurring amino acid
MGQKRWVFLLAIFAVLLAFSSGRVLKLKSDDDRHVYNHTLTLTLVEYASAVYVSDLTELFNWTCERCNGLTKGFEVXIEIIFDVEHCLQAYVGVAKDLNAIIIAFRGTQEHSIQNWVSDLFWKQLDLNYPDMPDAMVHHGFYSAYHNTTVRPCSLXAVQRAKISYGANINIXVTGHSMGXGAMAAFCGLXLVVNGGEENVQVMT

SEQ ID NO: 6599 - protein, 417 aa, Lentisphaera araneosa HTCC2155
MDKLFKNVVNIFNQACKKADISKTIHTILKQPKNEIIVNFPVRMDSGEMKLFKGYRIQHNNILGPYKGGFRYHPQVNLDEVKGLAMLMTLKCSLAGLPFGGAKGGVKFNPKDFSISEIEKITRRFVHALGDNIGPNFDIPAPDMGTGAQTMNWMMDTYLNTSGSLDRQCLKGVVTGKSVKVGGTKGRAQATGYGVVMCIEEWAKQHNYKISDKTFIIQGFGNVGSWAAKRLDSLGAKVVAVNDCAGTLYMKEGVPVRQLTEYIAENGSIAGFMGQELLSREEFFSMKADVMIPAALENQIGEKEAHAAQVELIAEGANGPITNRADEILAEKDIQVIPDVLANSGGVIVSYFEWLQNRSNDYWHEHHVLEKLQDKIIKAYHIVHDLSIELDVSKREAAYIRALKNIDEVYNERGIFP

SEQ ID NO: 6600 - protein, 295 aa, Acidovorax sp. JS42
MNAPTRVRKAVFPVAGLGTRFLPATKASPKEMLPVVDKPLIQYAVEEAYEAGIRDMVFVTGRSKRAIEDHFDTAYELENELENAGKREMLALVRSIAPDDMNCLFVRQPRSLGLGHAVLCAEPLVGNEPFAVILADDLMTGEPGGPGVMAQMTAAFAKQGRSLLAVQEVPLEHTKRYGIVKGESAGGALIRVDEIVEKPAPEKAPSRMGVAGRYVLTPRIFEEIRNQPQGVGGEIQLTDAIARLMQHETVYAYQYAGKRYDCGSKEGFLEATVELALQHPQVGPQFREYLQSLAL

SEQ ID NO: 6601 - protein, 127 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 6602 - protein, 103 aa, Glycine max
  misc_feature (87)..(87): Xaa can be any naturally occurring amino acid
LFSDWFQWNLHRRVLETTVKAVNLFIVPRFFVVSKIADPDGLEWFSIISTPNTIFTHLAGSSSVWKALSPSVLQAAFNVDPEVEQLXFRSKRTADAIFFPPPN

SEQ ID NO: 6603 - protein, 223 aa, Neisseria gonorrhoeae FA 1090
MTTQDELKRIAAEKAVEFVPENEYIGIGTGSTINFFIEALGKSGKKIKGAVSTSKKSGELLARYDIPVVSLNEVSGLAVYIDGADEVNHALQMIKGGGGAHLNEKIVASASEKFVCIADESKYVSRLGKFPLPVEAVESARSLVSRKLLAMGGQPELRIGYTTFYGNQIVDVHGLNIDQPLTMEDEINKITGVLENGIFARDAADVLILGTEEGAKVIYPCQG

SEQ ID NO: 6604 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 6605 - protein, 502 aa, Rhizobium leguminosarum bv. viciae 3841
MDAAPTPPVTLVIFGATGDLTRRLLVPAIINLTRSRLVGEDLQILGIGIEPGDDEFLRGRLDQFLSHLSGEEPRVKDEAWESLRRRISYTSGDFTKDDIFVEIGKRLGPNANAAFYLAVPPSFFGTIVEKLAAHGLTDESDGVFRRVAIEKPFGTDLASAQALNAQILAQVEESQVYRLDHFLGKETVQNLMTARFANMMIESLWNNRYIDHVQITATEIVDVGSRGKFYDATGALRDMVPNHLFQLLAMIAMEPPNSFDAEAIRNEKSKVLKALRIYTPEEAKTHGVRGAYGAGPLNGTELPAYRDTKDVSPDSRTETFVALKLYADTWRWAGVPFYLRTGKALTARDTEIVITFQPVPFAQFRETEVNSRLPPNRLVIQVQPDEGMSMEISIKSPGLSVDTVPVSLDFRYADKFDIAKTTGYESLLYDLFIGDQTLFQRADGIEAGWAAVQPFLDIWAGDQSVPDAYAPGSMGPACADELIQRDRREWHELGVLLHRNGK

SEQ ID NO: 6606 - protein, 160 aa, Neisseria gonorrhoeae FA 1090
MTNIRIGQGYDVHQLTEGRKLILGGVEIPFEKGLLGHSDADALLHAVTDALLGAAGLGDIGSHFPDTAAEFKDADSRVLLRAAYQSVQAQGWQVVNVDTTVIAQKPKLAPHIPQMRANIAADLGIDISCVNIKGKTNEKLGYLGRMEGIEAQAAVLLVRI

SEQ ID NO: 6607 - protein, 211 aa, Candida glabrata CBS 138
MAVVADKPLVGKINYSRYFYYLVLFVVVVYALRKMLTGHGSDIDIGRFLSKTSPYMWANLGIASCIGLSVVGAAWGIFITGSSMIGAGVRAPRITTKNLISIIFCEVVAIYGLIMAIVFSSKLTVSSKDSLYSKSNLYTGYSLFWAGLTVGVSNLICGVSVGITGATAAVADAADSSLFVKILVIEIFGSILGLLGLIVGLLMAGKAADFQ

SEQ ID NO: 6608 - protein, 221 aa, Brassica napus
MEKYDRVVKKKEERTIDANEIRITSMGRARNYITYAMTLLQEKGSTEVVFKAMGRAINKTVNIVELIKRRIPGLYQNTSIGSTDITDTWEPKEEGLLPMETTRHVSMITITLSTKELNTSSIGYQCPIPVELVKPLGDIDYEGGEGSPGGRGRGRGRGRGRGRGGRGNAYVNVEYEDGGYERNQSYGGRGRGRGGRGRSSRGGRGRGGYNGPQNEYDAPQD

SEQ ID NO: 6609 - protein, 255 aa, Triticum aestivum
KSLYKKAGWYRSGIPGISSTHASDTIFTDPFDPRGCSHLQSYSAKLPRYRMQGIAKALSQHGKQLRLAVLQHMNKGIFSWATLISRIQSESPAVIIPHMGLENITVREILRAKGEAQSRAVYWCSTTHLVHEAVKHMTANNVGSLVVLKSGDDKQLAGIVTERDFARKILLPGRPSEETRVEDIMTEENKLITVSSNTNILRAMELMTDEHIRHVPVFDEKVVGMISIGDVVRAIVDQQHQEVKQLKKYITGDYY

SEQ ID NO: 6610 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 6611 - protein, 414 aa, Shewanella sp. MR-7
MSDIRQQALDYHEFPVPGKTAVCLTKPAETSHDLALAYSPGVAEPVREIAANPDNAYRYTNKGNTVAVITNGTAILGLGNLGPLASKPVMEGKALLFKHFANIDSTDIEVTHNTTEEFINTVAAIAGTFGGINLEDIKAPECFVIERELIERCNVPVFHDDQHGTAIVTAAGMINALEIQGKLISDATFVCMGAGAAAIACMTMLVKCGANRANIYMLDTKGVIHTGRTDLNEYKALFANDTDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKVAAVHAIAGLAKEEVPASVLKAYPKVSSLSFGPEYVLPKPMDPRLLPRVARAVAQAAIDSGVAAITTLPHYAD

SEQ ID NO: 6612 - protein, 313 aa, Bacillus sp. SG-1
MKKVVLFADPGIDDTFAIIYALTNPEIQLVAIVTGFGNVSQGDATKNAAYILSLAGREDIPVINGASKPLTGEYEPFYPEIHGEDGIGPIKIPDEYKYEAQPFSSILDIIYKHEDLHFVDIGRNTSMALTFNLNPFVKDRIKEVFLMGGAFLVPGNVTEIAEANFHGDPTATNFVLNAGPPVYVAPLNVTLYAQLKEEHIRLLAEKSRNQFKEIFLPIFMFYQKAYEELQPGLEGVPLHDLYTMYLLSNLENTTIVQKKVLISTEEKTQGFTYADFRNMENDPQPNHFINIDFKYEDFLKNVLNTLMGEIKQN

SEQ ID NO: 6613 - protein, 481 aa, Candida glabrata CBS 138
MLRNSLRVAQRRGYFQVSRLKNGLRVATSDTPGHFSALGMYVSSGSRYETGSLKGCTHIVDRLAFKSTKNIDARSMMETLELLGGNYQCTSSRESMMYQASVFNRDVEKMLNLLAETIRFPKITEEELQEQKFTAQYEIDNIWTKPDLILPELLHNTAYSGETLGSPLICPREILPSITKKSLLNYREKFYNPENTVAAFVGQPHEKSIELAEKYLGDWTTTGEPLDKTAAHYTGGETCIPSAPVFGTMPELMHIQIGFEGLPIDHPDIYALATLQTLLGGGGSFSAGGPGKGMYSRLYTHVLNQYYFVENCVSFNHAYSDSGIFGISLSCIPQAAPQAAEVIAQQFYNCFANGALRLTDAEVSRAKNQLKSSLLMNLESKLVELEDMGRQVLMHGKKIPVSEMVSKIESLTTKDISRVAEMVFTGKAHNKGNGTGRATIVMQGDRAAFGDVQEVLGHYGLGSSSFSTDQSKSSTTKLKWF

SEQ ID NO: 6614 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRVLRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 6615 - protein, 511 aa, Pseudomonas putida KT2440
MTSTPKPLVLIILDGFGHSDIPEHNAIFAANKPVYDRLCATQPHGLISGSGMDVGLPDGQMGNSEVGHMNLGAGRVVYQDFTRVTKAIRDGEFFENPVLTGAVDKAVGAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTALAGLEAAYARDESDEFVKATRIGEAVKVEDGDAVIFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMSAPEVTDRIVEAIEQQRFDVIVVNYANGDMVGHTGVFEAAVKAVEALDTCVGRIVDALDKVGGEALITADHGNVEQMEDECTGQAHTAHTTEPVPFIYVGKRNVKVREGGVLADVAPTMLKLLGLEKPVEMTGTSILVDA

SEQ ID NO: 6616 - protein, 159 aa, Moritella sp. PE36
MFRIGHGFDVHKFGNAGPVMINGVAIPYEQGFLAHSDGDVALHAICDALLGALALGDIGHHFPDTSAEFENIDSRILLRDVFSKVKELGYRIGNLDVTIIAQAPKIAPHIQAMRAVLSADLETELSAVNVKATTTEKLGFTGRKEGVACEAVVLLMKNT

SEQ ID NO: 6617 - protein, 505 aa, Oryza sativa Japonica Group
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 6618 - protein, 248 aa, Ralstonia eutropha JMP134
MYKLVLIRHGESTWNLENRFTGWVDVDLTDTGAAQARLAGKLLKEAGFAFDVAYTSVLKRAIRTLWHVQDEMDEMWIPVRNEWRLNERHYGALAGLNKAETAAKFGDEQVLVWRRSYDTPPPALEPTDPRASYDDPRYANVPREQIPLTECLKDTVARVLPLWNESIAPDIQSGKRVVIAAHGNSIRALVKYLDQISDDDIVGLNIPNGTPLVYELDASLRPLRHYYLGDQEAIAASLAAVASQGKAR

SEQ ID NO: 6619 - protein, 405 aa, Triticum aestivum
MGRKLALLVGINYPGTKAELKGCHNDVDRMHKCLVDRFGFDEENITVLLDRGSSGPQPTGANIRHALAKLVGDARRGDFLFFHYSGHGTRLPAETGQDDDTGYDECIVPSDMNLITDQDFRDLVQKVPDGCIFTIVSDSCHSGGLLDKAKEQIGNSTRQNQTQSREPEEERSHSGGGFRSFLKETVRDAFESHSRHGGEDQDEQPTGDGLTKNRSLPLSTLIEMLKEQTGKDDIEEGSIRLTLFNVFGDDASPKIKKFMKVMLDKFHEGGSGEQGGVMGMVGSLAHQFLKAKLEGTEEETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 6620 - protein, 433 aa, Moritella sp. PE36
MSKIVKIIGREIMDSRGNPTVEAEVHLDGGFIGMAPAPSGASTGSREALELRDGDKTRFLGKGVLKAVAAINGPIAEALMGKDATDQAAIDQIMIDLDGTENKAQFGANAILAVSLANAKAAASAKGLPLYAHIAELNGTPGQYSMPLPMMNIINGGEHADNNVDIQEFMIQPVGAKTFREAVRIGAEVFHNLAKVLKSKGLSTAVGDEGGFAPNLESNAAALAAIEEAVKAAGYEMGKDVTLAMDCAASEFYNKEEGIYDLKGEGKKFTAEEFNHYLAGLVDQYPIVSIEDGLDESDWAGFKHQTELLGDKIQLVGDDLFVTNTKILARGIREGITNSILIKFNQIGTLTETLAAIKMAKDAGFTAVISHRSGETEDATIADLAVGTCAGQIKTGSMSRSDRVAKYNQLIRIEEALGDAAPFHGLKEVKGQA

SEQ ID NO: 6621 - protein, 539 aa, Aspergillus nidulans FGSC A4
MADQFKARTLKRKNVKGLALNAAPKSTSTLSNGDSQVPGAAGNGESNRTDTLEIGLEFRLDLRSEDLITLKELGAGNGGTVSKVMHASTKVVMARKIIRVDAKENVRKQILRELQVGHDCNSPNIVTFYGAFQNEARDIVLCMEYMDCGSLDRISKDFGPIRVDVLGKITESILAGLVYLYEAHRIMHRDIKPSNVLVNSRGNIKLCDFGVATETVNSIADTFVGTSTYMAPERIQGGAYTVRSDVWSVGLTVMELAVGRFPFDTTDSAAGDRASAGPMGILDLLQQIVHEPAPKLPRSDAFPPVLHEFVAKCLLKKSEERPTPLELYEKDAFLAAAKRTPVDLQEWAISMMERHNRKSYLAPPAPKSLKETRESPSPAQAPSPVQKHGTSRPSRGTTGEIPLNVARDSSSHQRQHAPQSQSHFSSNPSHYSSNSSHYSSRSSRSSPPISLEHLSLESKQDEHRPTRRPSRTPLGDSSSSLDQSLRPSIGSRSASSHNTNSRMPLQSTALPFRVAPTPGGYPTPNSTSWQRRGDHMGAL

SEQ ID NO: 6622 - protein, 347 aa, Ralstonia eutropha JMP134
MRRSTVRAAMKLTFLGAGAWGTALASHAAANHDVVLWGRDPAQLAAIAATGSNEAYLPGVPLSPRLRVEADFEQAVGHAADDPDGLVVVATPVSGLREMTRRLAGRGNGHVRMLWLCKGFEAGTHALPHQMVREELDAAGRTSGFDYGVLTGPSFAREVALGLPCALTVAGSVPTLADCAQAAFHHHAMRIYGSDDLTGVEVGGAVKNVLAIATGASDGLGLGLNARAALVTRGLAEMTRLGLALGGRAETFMGLAGVGDLILTATGDLSRNRKVGQQLAAGQSLDQILASLGHVAEGVRCAQAVAALAEACKIEMPITRAVCAVLFEGLSAADAVAQLLQRDARDE

SEQ ID NO: 6623 - protein, 490 aa, Pseudomonas putida KT2440
MARFGTQKLYIDGAYVDAGSDATFEAINPATGEVLAHVQRATEADVEKAVESAERGQKVWAAMTAMQRSRILRRAVDILRERNDELAMLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFQHMESVLGYIAKGKEEGARVLCGGERLTAGDFAKGAFVAPTVFTDCTDDMTIVKEEIFGPVMSILTYETEEEVIRRANDTDYGLAAGVCTNDITRAHRIIHKLEAGICWINAWGESPAEMPVGGYKQSGVGRENGVSSLAQYTRIKSVQVELGGYNSVF

SEQ ID NO: 6624 - protein, 295 aa, Oryza sativa
  misc_feature (169)..(169): Xaa can be any naturally occurring amino acid
MPRTSVVESPGCPPLRALTTDILGLIKVVEARTKPAGVAKVVETWGAPDAPRAVLAASLADRAVDPVLAVARKNGVVELLNPLNGETLAGVNAAAGRAAPADSSAEEDPLATLHLFRRHALDSSMLGTFLACTEKGKAYVKSVAKENASSDMAVGPSSSWDVSNSGTVXFSSVDAGESYAMFGGKGIEVHLWDITSCSKIWSAQSPRGNSLQIFTAPWFTAGTFLCKDDHRKIVACTNNHQVRLYDTASQRRPVISVDFRESPIKAVAEDPNGHAVYIGTGRGDLASFDMRTGII

SEQ ID NO: 6625 - protein, 301 aa, Acidovorax sp. JS42
MKTYPTIEDAIGHTPLVALQRIGAQDNAARGNVILGKLEGNNPAGSVKDRPALSMIRRAEERGEIKTGDTLIEATSGNTGIALAMAAAIKGYRMVLIMPEDLSVERAQTMKAFGAELVLTPKSGGMEYARDLADQMVAQGKGVVLDQFANPDNPRIHYETTGPELWEQTEGRITHFVSAMGTTGTITGVARFLREKNPAVRIVGAQPQEGSRIPGIRKWPEEYLPKIYEPQLVDELVLVSQDDAEDMARRLAREEGIFAGISAAGACWVAQQIAQREENATIVFVVCDRGDRYLSTGVFPA

SEQ ID NO: 6626 - protein, 490 aa, Bacillus licheniformis ATCC 14580
MSQTLFIDGKWVGAKKGETRQIINPYNQEHIETVSEGDREDAVRAIAAARRAFDDGEWANTPGLERGNIVLKIAELIRRDHEELAELESLDTGKTIEESRADMDDIANVFQYYAGLADKDGGEVISSPIPDSKSKIVREPVGVCGQITPWNYPLLQASWKIAPALAAGNTIVVKPSEITPLTTIKIFKLMEEAGVPEGVANLVLGPGATVGDELARNKDVDLISFTGGIETGKKIMQAASTNVKKIALELGGKNPNIVFKDADFDVAVDQALNAVFFHAGQVCSAGARLLVEESIQDEFVAELVKRAKKIKLGNGFHEETQSGPLISAEHRSKVEKYVEIGLQEGAKLETGGKRPEDPELANGFFYLPTIFSSCTSDMRIVKEEVFGPVLTVETFKTEEEVVSLANDTIYGLAGAVWSKDIEKAERVASKLRMGTVWINDFHPYFAQAPWGGYKQSGIGRELGRMGLEEYTEVKHVYRNTKPAAVNWFKA

SEQ ID NO: 6627 - protein, 390 aa, Lentisphaera araneosa HTCC2155
MKNTIIIGNTSDNPFAIDVAHFCGQVVDISDVIALKDFQNTEFCPRFINDETAFEDIGYYLKGKTVVIVSTQSLTFSRNSLSMRNLVIARAAKDNGAEQVILMEPDLFYSCQDRGPRHEHSFFNEERSAEIRKKFDGQPFTALLYAQLLSLAGVDQAFTIHNHSFSTQNLFQKELNGYFHNYVPCDIFSHYLASSGIVDPGKTILCAPDKGAVPFVQMIKDEMSHLNPPILKMDKVRSGERAIEMEPSEDSDIGMEDIEGKDVIVFDDMVRTGTTIVKCCRILKQYKPRRIIFCVTHFHSSAESREKLADHSIDEIVTTNTIPAILNRDQQGRLRKKITVLKLENWIANKLNKIVTGKEIASSPGELYSVDISSKNPRWKQHISSAFGNK

SEQ ID NO: 6628 - protein, 253 aa, Triticum aestivum
  misc_feature (157)..(157): Xaa can be any naturally occurring amino acid
  misc_feature (177)..(177): Xaa can be any naturally occurring amino acid
  misc_feature (189)..(189): Xaa can be any naturally occurring amino acid
  misc_feature (205)..(205): Xaa can be any naturally occurring amino acid
MDTANMCTVERRGRVHLITLTGAGEHRLSPALISAIRAAVAACPGAGALVLAAEGKYFSNGFDQAWARTVPPHLHTTMSEGFRGLVADLLALPMPTVAAVTGHAAAAGCALALAHDSVVMRASRGFLYMSEVDAGIKIVDYFGELLRQKVPDAATRXRDMLLRGDKMTAAEAVRRGXVDPAADGGVEDXVVAAALPGPQGLPARXGWEGEVVAENQKGHVPRVWGQGQGLRGPPRCRPAPGAGRPLRLPEGLP

SEQ ID NO: 6629 - protein, 364 aa, Chlamydia muridarum Nigg
MGQTECGIVGLPNVGKSGLFNALTGAQVASCNYPFCTIDPNVGIVPVVDSRLEILARISQSHKIIYADMKFVDIAGLVKGAASGAGLGNRFLSHIRETHAIAHVVRCFDNDDVTHVSGKIDPEEDIAVINLELILADFSSATSVRDKLSKQAKGKKDIGQLIPILDRVIEHLESGNPVRTLSLSSEEGSLLKPYPFLTGKPMLYIANIDEDSLTDLDNPYVQKVRRIAQQEGANVVPICVKLEEEILSLPPEERQDFLHSLGLQESGLNRLVASAYQTLGLISYFTTGPQETRAWTISKGATAAEAAGEIHSDIQKGFIRAEVVTLEDIVTYNGRAGAREAGKLRAEGRDYIVQDGDIMLFLHN

SEQ ID NO: 6630 - protein, 620 aa, Clostridium tetani E88
MIMINTLDRYKDVYDIKNMSLDELNLLSRELRNFIIESVSQNGGHLASNLGVVELTLSLYNVFDFSYDKLIWDVGHQCYVHKILTGRRSGFQNLRKINGLSGFPKRCESKFDHFETGHSSTSISSALGMARARDLKGENYNVVAVIGDGALTGGMALEALNDVGDNKTKLTIILNDNQMSIGKNVGGLSTYLSSLRIDPNYNKFKRDVEGIIKKIPNIGKGVAKNLERVKDGVKQVLVPGMLFENMGIKYFGPIDGHNIKQLSKVMDKAKNMKEPVIIHVVTTKGKGYKFAEQNPDKFHGIGSFDYMTGCSKKSKGVTYSKAFGKAMVSIASKDKRVVAITAAMKDGTGLNEFSNKFKNRIFDVGIAEQHAVTMAAGMATAGLRPVFSVYSTFLQRAYDQVLHDVCIQNLPVVFAIDRAGLVGEDGETHQGVFDMSYLSHMPNMTIMAPKCVEELEFMLNWALSQESPIAIRYPKGESRLNLKPIKNFQKGKWEVLEDKGKISIIATGRMVEKAFNVKETLKERNIDIGLINATFVKPIDKEMLNKIIDEEKTIITLEDNVILGGFGNSVLNYVRDTNSNIKVVNLGFKDEFIPHGKVDDLFKMYGLDEEAILKEVMKLM

SEQ ID NO: 6631 - protein, 288 aa, Clostridium tetani E88
MNLNSYKDEVDTWLKEYFKDKGTYNKSVYEAMSYSVNIGGKRIRPILALITYKIYNKNYKEALSIACAIEMIHTYSLIHDDLPCMDDDLRRGKPTNHKVFGDGLAVLAGDGLLNEAFNIILKNGCQKGMTWVEAGYEIGKASGVEGMIGGQVVDVLNTNKSIEIEELDYIHEKKTAALITASIMTGAILGEANEKDTTILKEFGKKLGLAFQIKDDILDIESDTRKLGKTIGKDKEQNKNTFVKFYGLEKCKKMCKDLTSSCIELLQNMNKDTKELEEITLYLLNRDF

SEQ ID NO: 6632 - protein, 131 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 6633 - protein, 359 aa, Streptococcus pneumoniae TIGR4
MTKRILVLEDGTVFEGKAFGADIDVTGEIVFNTGMTGYQESITDQSYNGQILTFTYPLVGNYGINRDDYESIIPTCKGVVVFEEARRASNWRNQMTLDEFLKAKKIPGISGIDTRALTKIIRKHGTMRATLTHVGDSMDHVTDQLQATVLPTDNIKQVSTKTSYPAPGVGLSVVLVDFGLKHSILRELSKRNCNVTVVPYSTTAEEILHLNPDGVMLSNGPGNPEDVPQALDMIRGVQGKIPIFGICMGHQLFAMANGAKTYKMKFGHRGFNHAVREIATGRVDFTSQNHGYAVSREDLPEHLIITHEEINDKSVEGVRHRYQPAFSVQYHPDAAPGPHDASYLFDEFIEMMEVFKQSN

SEQ ID NO: 6634 - protein, 514 aa, Myxococcus xanthus DK 1622
MDAHQGLHIETHPREGDPLVRARRPDPCALVLFGATGDLAQRKLFPALFELARAHLLPKNFAVVAFSRSEGDSEAFREHVKASLLKFARTQPLDEAVWNDFAPRLELISGGYDDPKSFVRLREELDRVAQKFGTQGNQFYYLATPASTFPQILQGLSESGLLKRQEQADPRPWQRLIIEKPFGHDLESARALNRELAAVLDERQIFRIDHYLGKETVQNILVFRFANAIFEPLWNRQHIDHVEITAAETLGVEGRGGFYDETGVIRDMVQNHLLQVLALCAMEPPVSFGAEDIRDEKTKVFRALRPLEGREVSRAVVAGQYEGYLQEKGVKAGSRTPTYVAMKMNIDNWRWAGVPFYLRAGKKLKRRVTEVSIHFKSVPISLFSGEGATCQRLQPNVLTLRIQPQEGIALSFESKVPGEDVNIAGVTMDFNYQETFQRPVPEAYERLLLDCMRGNATLYARQDSVEQAWTFVTPILQALESGEGGPAHGYPGGSAGPDAAAALLARDGRRWTGL

SEQ ID NO: 6635 - protein, 501 aa, Oryza sativa Indica Group
MATWILGWLLWLPVFLISLYLVDILAHSCRRLPPGPRPLPFIGSLHLLGDQPHRSLAGLAKKYGPLMSLRLGAVTTVVVSSPEVAREFVQKHDAVFADRSIPDSIGDHTKNSVIWLNPGPRWRALRRIMATELFSPHQLDALQQLRQEKVAELVDHVARLARESAAVDVGRVAFATSLNLLSRTIFSRDLTSLDDRGASREFKQVITDIMEAAGSPNLSDFYPAIAAVDLQGWRRRCARLFTQLHRLFDDEMDHRKLHSRHGGPGENGKEKDDFLEVLLRLGARDDDIAGLDGDTLRSLFIDLFAAGSDTSSSTIEWAMVELLKNTLSMGKACDELAQVVGSRRRIEESEIGQLPYLQAVIKETLRLHPPVPLLPHRAKMAMQIMGYTIPNGTKILINVWAMGRDKNIWTEPEKFMPERFLDRTIDFRGGDLELIPFGAGRRICPGMPLAIRMVHVVLASLLIHFKWRLPVEVERNGIDMTEKFGLTLVKAIPLCALATPT

SEQ ID NO: 6636 - protein, 347 aa, Rhizobium leguminosarum bv. viciae 3841
MKAMFYEAFEQAPEIRTVADPTPTEDGVVISVGASGLCRSDWHGWMGHDPDIRLPHVPGHELAGRIVATGRGVMRFKVGDRVTVPFVSGCGHCGECHSGNQQVCPNQFQPGFTHWGSFAEYVAIDYADTNLVHLPDTIDDATAASLGCRFATSFRAVADQARTRPGEWISVHGCGGVGLSAIMIATALGANAIGIDISEEKLAFARECGAVATVNASGVADVAEAVREITKGGAHVSIDALGHPVTCFNSIKNLRRRGRHVQVGLMLGEHATPQIPMAQVIGQELEIYGSHGMQAWRYDAMLSMLSAGKIAPQKLIGRRISLEEAVPALMALDKAESTGISVITRFS

SEQ ID NO: 6637 - protein, 516 aa, Clarkia similis
RQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 6638 - protein, 532 aa, Bacillus sp. SG-1
MIQVSDVSLRFGDRKLFEDVNIKFTAGNCYGLIGANGAGKSTFLKILSGEIESQTGNVSMTPGERMAVLKQNHFEFEEHEVLKVVIMGHARLFEVMQEKDAIYMKADFSDEDGMRAAELEGEFAELNGWEAESEAAILLKGLGIGEELHTKKMEDLTGGDKVKVLLAQALFGKPDVLLLDEPTNHLDIAAIQWLEEFLINFENTVIVVSHDRHFLNKVCTHIADLDFGKIQVYVGNYDFWYESSQLATRMAQDQNKKKEEKIKELQAFIARFSANASKSKQATSRKKLLDKITLDDIRPSSRKYPYVHFKPEREIGNDLLRVEGISKTIDGVKVLDNVSFIMNKDDKIALVGSDEIAKTTLFKILAGEMEPDSGSYKWGVTTSQAYFPKDNSEYFQGNEPNLVDWLRQYSPNDQSESFLRGFLGRMLFSGEEVMKKPSVLSGGEKVRCMLSKMMLSEANVLLLDEPTNHLDLESITALNNGLVNFKGSMIFASHDHQFIQTIANRIIKLDSEGMIDKQMTYDEFLETTAVKS

SEQ ID NO: 6639 - protein, 382 aa, Haemophilus influenzae
MAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 6640 - protein, 527 aa, Clarkia similis
VEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 6641 - protein, 455 aa, Arabidopsis thaliana
MSASTVSITASPRTIRRTPVLSGEKKSNFDFPPSESHANAAIGESSAGTNKDLIRAEAAGERSNTYDVGPVTRKSGSTATGTNTTTTQRRTRKSQGNKIDRGKWKTVVRVFAKQFGALLLLVGLIQLIRKLTLKDSSLSSSNFPIETEMVLSELESRISAVDGLVKTTTKMMQVQVEFLDKKMDSESRALRQTIDSTSSVLHSELKKVESKTERLQVSVDELNAKPLVSREELERVYEELKKGKVGDSDVNIDKLRAYARDIVEKEIGKHVADGLGRVDYALASGGAFVMGHSDPFLVGNGRNWFGTSRRRVHSKAVKMLTPSFGEPGQCFPLKGSNGYVLVRLRAPIIPEAVTLEHVSKAVAYDRSSAPKDCRVSGWLGDIDMETETMPLLTEFSYDLDRSNAQTFDIADSAHSGLVNTVRLDFNSNHGSSSHTCIYRFRVHGRELDSVSVAHA

SEQ ID NO: 6642 - protein, 188 aa, Physcomitrella patens subsp. patens
GGSSGVPKKTKVASSSKHPLRQAGMKPGEGCFLCKSKDHIAKHCPTKSEKDHRKNYMCLGCRMWGHTLKNCPSEFKSADVKLCYNCGQPGHSLDKCPNPLKDGGSAFAECFLCKQRGHLSKNCPDNKNGIYPKGGSCKICEQVTHLAKDCPQKNSGKFAGNARISSGVGGKRTVFKSGDDLEDDFQDE

SEQ ID NO: 6643 - protein, 819 aa, Oryza sativa Indica Group
MAALLLWLSWLLLSLLSIYLLDLLAHSRRCLPPGPRPLPLIGSLHLLGDLPHHSLAGLAKKYGPLMSLRLGAVTTVVASSPEVAREFLQKHDAVFATRSTPDATGDHARNSVAWLPPGPRWRELRKIMATELFSTRRLDALHELRQEKVAELVDHVARLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFMPERFLERTIDYKGGDLELIPFGAGRRICPGMPLAVRMVHVLLASLLIHFKWRLPAEVEGNRIDMTEKFGVTLAKANHLCAMAAPTYTGNILTAKQLRDHELQLRTNISALTDKKTQMMEPDAIAMPVVTEDDVRHAISRWTGVPLHKVSMDESRKLLKLEEALHRRVVGQGEAVAAVSRAIRRARLGLKHPGRPVASLVFAGPTGVGKSELAKALAAYYYGSSESEEAAMVRLDMSEYMEKHAVARLVGSPPGYVWHGEGGQLTEAVRRRPHAVVLLDEVEKAHRDVFDLLLQVLDDGRLTDGKGRTVDFKNTLIVMTTNIGSSLIVNNGGDGAAAAGRIKNTVTDEMKRHFRPEFLNRLDEVIMFQPLTELESFRGRGGPLKPREPDQYSDAPKNVVGHTDKNAILDLR

SEQ ID NO: 6644 - protein, 297 aa, Helianthus annuus
AISTALANFMNRVRGNRVKFDPDRIVMSGGATGAHETLAGCLANPGEAFLVPTPYYPAFDRDLRWRTGVELFPVVCESADNFKGHREALETAYKKAKLANVKVKGVLITNPSNPLGTFLDRDTLKDIVNFVNDKSIHLVCDEIYAGTVTNGDEFVSIAEVIEEVPKCNLDLIHLVYSLSKDMGFPGFRVGVVYSYNDNVVSIARKMSSFGLVSTQTQHMLASMLSDNEFVGTFISESRIRLAHRHDMFTRGLAQVGIGSLESKAGLFFWMDLRRFLKEPTFESEMTFWRTIINEIKL

SEQ ID NO: 6645 - protein, 501 aa, Clarkia unguiculata
MASPALISETEAWKDLKAHLEGIKMTHLRELMGDTERCQSMMVEFDNIFLDYSRQQASPDTISKLYKLADAAYLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALTYGKTPEQLKKENVSEHLIPHKTFTGNRPSISILLPTLDAYRIGQLLAIYEHRVAVQGFV

SEQ ID NO: 6646 - protein, 400 aa, Mesorhizobium loti MAFF303099
MAFLADTLSRVKPSATIAVTQKARELKNAGRDIIGLGAGEPDFDTPDNIKNAAIEAIRRGETKYPPVSGIVPLREAIAKKFKRENNLDYKPEQTIVGTGGKQILFNAFMATLNPGDEVIIPRPYWVSYPEMVAICGGTSVFADTSIENGFKLTAEVLEKAITPKTKWLLMNSPSNPSGAAYTQAELRALADVLLKHPHVWTLTDDMYEHLTYGDFAFKTIAEVEPKLYERTLTMNGVSKAYAMTGWRIGYAAGPVQLIKAMDMIQGQQTSGACTIAQWASVEALNGPQDFIARNKAIFQGRRDLVVSMLNQARGITCPSPEGAFYVYPSCAQLIGKKTKAGKVIDTDEAFCSELLEAEGVAVVFGSAFGLGPNFRISYATSDALLEEACTRIQRFTASLT

SEQ ID NO: 6647 - protein, 380 aa, Clarkia unguiculata
MATPSLISETETWKDLKAHLEGIKKTHLRELMGDTERCQSMMVEFDNIFLDYSRQQASPDTINKLYKLADEAHLKQKIDRMYNGDHINSTENRSVLHVALRAPRNSAICSDGKNVVPDVWNVLDKIKDFSERVRSGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 6648 - protein, 370 aa, Idiomarina loihiensis L2TR
MSFRLIIVIVGLLVSCFSMAQNSEPTKQKNEKVATFAGGCFWCVEEAFEQMPGVREVISGFSGGDEVNPTYEEVSAGKTGHTEAAQIYYNPDVVSYAALLQKLWRISDPTDNDGQFVDRGKQYRPAVFYHNDEQKRIAMESREWLDKNGPFPDPVVIEITPFKSFYKAEEYHQDYYDKNPVRYRIYTYNSGRYDFVEKHWGDTSDVDYQQFTNDNPTGKAEQQSFVKPSDSELKKRLTDIQYAVTQEDQTEPAFDNRYWDNERKGIYVDVVSGEPLFSSADKYESGTGWPSFTKPISPDAVVEKDDSSWFYTRTEIRSRKADSHVGHVFNDGPPPTGLRYCMNSAALRFIPLEKMEEEGYGDYIPAVTDD

SEQ ID NO: 6649 - protein, 410 aa, Erwinia carotovora subsp. atroseptica SCRI1043
MPGVIESTSRTSRKVKLSLMGPAFIAAIGYIDPGNFATNIQSGAAYGYTLLWVVVWANLMAMLIQLLSAKLGIATGKNLAEHIRDRFPRPAVWAYWVQAEIIAMATDLAEFIGAAIGFKLLLGVSLLEGAILTAIATFLILMLQQRGQKPLEMVIGGLLLFVAAAYIVELVFSQPELSALAKGMAIPSLPTSDAVLLAAGVLGATIMPHVIYLHSSLTQHEGGHSRAERYSATKVDVAIAMTIAGFVNLAMMATAAAAFHFSGNQDIADLDKAYLTLEPLLGKAAAVIFGLSLVAAGLSSTVVGTLAGQVVMQGFVRFHIPLWVRRAVTMLPSFIVILSGMDPTRVLVLSQVVLSFGIALALVPLLSFTGNRELMGSMVNGKWVQRIGQLIVVLVVSLNMYLLIDTIIGI

SEQ ID NO: 6650 - protein, 540 aa, Pseudomonas putida KT2440
MGSNTLLCAKWLRGLRPRSRVNPLLNRALAAVGAGSPAKGRQAAPLAPIPRSSPVKALDQLTFDNRFARLGDAFSTQVLPEPIADPRLVVASESAMALLDLDPAQAELPVFAELFSGHKLWEEADPRAMVYSGHQFGSYNPRLGDGRGLLLAEVLNDAGEHWDLHLKGAGQTPYSRMGDGRAVLRSSIREFLASEALHALGIATSRALCVIGSSTPVWRETRESAAMLTRLAQSHVRFGHFEYFYYTKQPEQQRVLIDHVLEQHYPECREAEQPYLAMFRTIVERNAELIARWQAYGFCHGVMNTDNMSILGITFDFGPYAFLDDFDANFICNHSDDRGRYSYANQVPIAHWNLSALAQALTTVIEVEPLKEALGLFLPLYQAHYLDLMRRRLGLTTAEDDDMVLVERLLQCMQRGGVDYSLFFRKLGEQPVAEALKVARDDFIDLAGFDAWGADYLARCGREPGNAEGRRERMHAVNPLYVLRNYLAQKAIEAAEAGDYSEVRRLHQVLARPFEEQPGMQAYAERPPEWGKHLEISCSS

SEQ ID NO: 6651 - protein, 502 aa, Klebsiella pneumoniae subsp. pneumoniae MGH 78578
METKDLIVIGGGINGAGIAADAAGRGLSVLMLEARDLACATSSASSKLIHGGLRYLEHYEFRLVSEALAEREVLLKMAPHIAFPMRFRLPHRPHLRPAWMIRIGLFMYDHLGKRTSLPGSTGLRFGAESVLKPEIVRGFEYSDCWVDDARLVLANAQMVVRKGGEVRTRTRAISAKRENGLWVVEAEDIDNGEKFTWKARGLVNATGPWVKQFFDEGMHLRSPYGIRLIKGSHIVVPRVHTQKQAYILQNEDKRIVFVIPWMDEFSIIGTTDVEYKGDPKAVAIDDKEINYLLNVYNAHFKKTLSRDDIVWTYSGVRPLCDDESDSPQAITRDYTLDIHDENGQAPLLSVFGGKLTTYRKLAEHALEKLTPYYKGIGPAWTKTAVLPGGDIGGDRDDYAAKLRRRFPFISESLARHYARTYGSNSEWILKEASALSDLGEDFGHEFYEAELKYLVEHEWVRSLDDAIWRRTKQGMWLTAEQQARISEWLAQHAGKSELSLAS

SEQ ID NO: 6652 - protein, 465 aa, Burkholderia vietnamiensis G4
MNAPLDEPRPFGGSGSSSDDGDGAPFDRGRLVGDLDAGLAFFSPVSVQGRVNHAVGQILNATGIRARLGEICELRTPNQPTLLAEVVGFSRQTTLLTPLGDVAGLSPETTVVPSGREHVFAVGDALFGRVLDGLGRPLDDLGPVTGAAWVSTQQDPPNPLARKLIDTPFPTGVRVIDGLMTLGVGQRVGIFAPSGVGKSTLLGMIARGAQADVNVIALVGERGREVREFIEHSLSPEVRARSIVVVSTSDRPAMERVKSALVATAIAEHFRDAGKRVLLLVDSLTRFARAQREVGLASGEPPTRRSFPPSTFAVLPRLLERAGQGARGSITALYTVLVEGDEESDPIAEEVRSILDGHIVLSRKIALANRYPAIDVLASLSRVMPLVASRAHQQAAARVRELIAKYQEIELLVQIGEYREGSDRLGDLALRARDAIGAFCAQASHEDVRFDALLAKLTRLANDHV

SEQ ID NO: 6653 - protein, 389 aa, Rhizopus microsporus var. chinensis
MVSFISISQGVSLCLLVSSMMLGSSAVPVAGHKGSVKATNGTDFQLPPLISSRCTPPSHPETTGDPDAEAYYINKSVQWYQAHGGNYTALIKRDTETVGGMTLDLPENPPPIPATSTAPSSDSGEVVTATAAQIKELTNYAGVAATAYCRSVVPGTKWDCKQCLKYVPDGKLIKTFTSLLTDTNGFILRSDAQKTIYVTFRGTNSFRSAITDMVFTFTDYSPVKGAKVHAGFLSSYNQVVKDYFPVVQDQLTAYPDYKVIVTGHSLGGAQALLAGMDLYQREKRLSPKNLSIYTVGCPRVGNNAFAYYVDSTGIPFHRTVHKRDIVPHVPPQAFGYLHPGVESWIKEDPADVQICTSNIETKQCSNSIVPFTSIADHLTYFGINEGSCL

SEQ ID NO: 6654 - protein, 414 aa, Streptococcus pneumoniae
MSKMKIAVVGTGYVGLSISVLLAQHHHVVAVDIVKEKVELINNKISPIQDDFIERYLSESNLDLVATIDAETAYKDASFIVVATPTNYDSERNFFDTSAVESVIQQVQNVNSTATIVIKSTVPVGFTDSIRKKLGISNLLFSPEFLRESRALYDNLYPSRIIVGTDLNDQKLIEKAQVFSNLLVQGAIKKDIPILIMGFTEAEAVKLFANTYLALRVSYFNELDTYAETKGLDTQKIIEGVSLDPRIGTHYNNPSFGYGGYCLPKDTKQLLANYENIPEELIGAIVRSNATRKDFIAKQVLKMVNYNNPEDDISVRQMDKEVVIGIYRLTMKSNSDNFRQSSIQGVMKRIKDRGAKVIIFEPTLKDNGTFFGNAVINDLEEFKAKCDAIIANRYDEMLNDVKDKVYTRDIFRRD

SEQ ID NO: 6655 - protein, 431 aa, Klebsiella pneumoniae subsp. pneumoniae MGH 78578
MVRLEKNDPLMLARQLPIKSVALILAGGRGTRLKDLTIKRAKPAVHFGGKFRIIDFALSNCINSGIRRIGVITQYQSHTLVQHIQRGWSFFSEEMNEFVDLLPAQQRVHGENWYRGTADAVTQNLDIISRYKAEYVVILAGDHIYKQDYSRMLIDHVEKGARCTVACMPVPIEEASAFGVMAVDENEKIIEFVEKPANPPAMPTDPTKSLASMGIYVFDAAYLYELLEEDDRNENSSHDFGKDIIPKITEAGMAYAHPFPLSCVQSDPNAEPYWRDVGTLEAYWKANLDLASVTPELDMYDQNWPIRTHMESLPPAKFVQDRSGSHGMTLNSLVSGGCIISGSVVVQSVLFPRVRVNSFCNIDSAVLLPDVWVGRSCRLRRCVIDRACVIPEGMVIGENAEEDARRFYRSEEGIVLVTRDMLRKLGHKQER

SEQ ID NO: 6656 - protein, 379 aa, Pseudomonas putida GB-1
MKAIVYNGPRDVAVKDVPDAKIEKPTDVLVRITTTNICGSDLHMYEGRTSFEAGRVFGHENLGEVIEVGAGVDRVKVGDRVCLPFNIGCGFCENCEKGLTGFCLTANPGAAGAAYGFAEMGPYQGGQAELLRVPYADFNCLVLPEDAQEREDDYVMLSDIFPTGWHATELAGLLPGESIAIYGAGPVGLMAAHSAIIKGASQVFVIDNQPDRLQLAAQLGATPINAVEQKAVEEIMNLTHGKGTDRGCECVGYQCCDKHGHEANYLTMNNLVASTKATGGIGVVGVFVPEDPGAKNELAKEGKMAFDFGAFWFKGQQIRTGQANVKAYNRRLAELIHHGRAKPSQIISHRLKLAEGPEAYKHFDARDDGWTKVVLKPAA

SEQ ID NO: 6657 - protein, 324 aa, Candida parapsilosis
MSTATASPAVKLNSGYEIPLVGFGCWKLTNDVASDQIYRAIKSGYRLFDGAEDYANEQEVGEGIKRAIKEGIVKREELFITSKLWNSFHDKKNVEVALMKTLSDLNLDYVDLFYIHFPIAQKPVPIEKKYPPGFYCGDGDKWSIEEVPLLDTWRALEKLVDQGLAKSIGISNFSAQLIYDLIRGCTIKPVALQIEHHPYLTQPKLVEYVQLHDIQITGYSSFGPQSFLEMDLKRALDTPVLLEEPTVKSIADKHGKSPAQVLLRYQTQRGIAVIPRSNSPDRMAQNLSVIDFELTQDDLQAIAELDCNLRFNEPWDFSNIPVFV

SEQ ID NO: 6658 - protein, 582 aa, Chlamydomonas reinhardtii
MYVCMCLCVSVYGVGMAAAPTYLVDFACYRPADELKVVATEVEEAGKHWPMYSEGIKDFLWKVLLKSGLSTETTFLPKAVHPCHTRLPDSTVPTALEEARVVMVGAIDELLGRVPGGLDPAADIDILITSNSIFCSTPSLASMVVNHYKLRPDIQVSYCMYPGKDKARMVANAIFRPSQAARAKYVLQHALRVHTGASDASYTSMHWSPDEEGINGIYLDKCIIEEAGKCIEMVMRGITPKIMTWRQYGEAAAHVISTASRQLLNRRSSSKPTAAASKAAVTAAAAAKSQQQQEMMAAVAGGGKTGASKAGGKKALALTATSSSAAVLAVPSKPQAAAAATNAAAATGKNAEEQGQEQGQEAACVEAIRQEQEQRRRSDNGTAWCGPAPACSSPASASTTASTGSSSDCGSSPASLSPAPSETGAAAAGAAAGGGATSGVGKGGARSLLSTVRSAVLGALASYRPDYTACVDHFLVHAGGYAVLKGLQSELALPDAAMIPSFAALREYGNTSASTTWYALGYTEACEGVRRGQGGCNVWRALRDVDGSSHTAWRHLGGRRLSEAELPRGITRDVVRARRGVA

SEQ ID NO: 6659 - protein, 199 aa, Chlamydomonas reinhardtii
RASHAEKPLVGSVAPDFKAQAVFDQEFQEITLSKYRGKYVVLFFYPLDFTFVCPTEITAFSDRYKEFKDINTEVLGVSVDSQFTHLAWIQTDRKEGGLGDLAYPLVADLKKEISKAYGVLTEDGISLRGLFIIDKEGVVQHATINNLAFGRSVDETKRVLQAIQYVQSNPDEVCPAGWKPGDKTMKPDPKGSKEYFSAV

SEQ ID NO: 6660 - protein, 126 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 6661 - protein, 678 aa, Yarrowia lipolytica CLIB122
MTGENTPLLHKVTISEPGTPPRPGTPTLRPNLIRHISNNSVKPSSSSSNDDDHHRLVPPPTPKALRPKMKSYWAYYIPAMEWIPHYTATKFWGDFCAGVSLASFQIPLSMSYATSLAHLPAVAGLYGLVIPPLVYAIFGSVPQMIVGPEAAISLVVGHALKPYLHPDSDNVIKPIEANGIIAGATGAILLFAGLVRFGFLDSVLSRALLRGFISAVGIVMCIDQSLGLLKLNGLFAELSPNNETTFSKLVFVITHWHQAHKLTAAIGLSALVVLVILRSLKKRLREKISWMLFVPEILIVVVVCTVLTDVFDWDREGVLVLGKVKPGKLHLRFPLTPSTWTDFKATFSASFILAVLGFFESTIAAKSLGTTFDVAVSTNRELVALGLCNFFGSLFCALPAFGGYGRSKINALSGATTQMSSAVLAIITMLCTAYLMPYFFYLPSCVLSAVITVVGLSLLEEAPGDIAFYWKVGGYQELFTLFLTLSTTIFWSVETGIAVGVGLSVVRVIHHATRPRIQILARKPGTNDFFNADLSLDNEDGTHSELEDIHGCLIVKIPEPLTFANTGDLRTRLGRLELYGSMKVHPSHPRIRDDDMTQFVIFDLNGMTEIDVSAAQILMEIVSRYKDRGLEVYFTRVPNDHKIRQLLDKSGISKLVADDNAVYYNSIEEALRHIDSEA

SEQ ID NO: 6662 - protein, 535 aa, Aeropyrum pernix K1
MSARKGTEKLGFWEVFSIGVGGMIGGGIFATLGLSLELAGAAAPLAFLLAGSVALITSYSYAKLSSRYPSEGGTIEFIVRAYGDNVISGGLNIMLLASYIVMISLYAHAFGSYGASMINCCPREAYIALVVFVIAGLTVVNMLGAIMSGRVELGLVIFKLLVLILVAVVSMPLVDWNRLGVREWPSILSIVAGGMIIFLAYEGFELVANTAKDVRDTTTLRKGLYASVVTVIIVYVLIAIVAAGTLDPDTVRIARDYALAVLVEPVLGKIGFTLVVAAALASTSSAINATLYGSARVSYIIAKYGEAPQLLGRHIWRGAYEGLLVISILGLLLALYASLEQISTAGSGGFLIIFAAVNLAAYKLRRETGANPLISLVGFILNLTSLAILVYQMASMNPGELAILAVLIAGSMAAEALYRRIKGRRLPQVIDPSLKVRESLISGWRNLTARAAEIIKREIMNAEVYITGSIARGEYEKSGDIDLIVSTTKPLSPHEVKFIEERLVKELNLPPSHPLHIHTVTRDKLENFKHKVKID

SEQ ID NO: 6663 - protein, 127 aa, Glycine max
  misc_feature (117)..(117): Xaa can be any naturally occurring amino acid
MESAVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKQQIQXLKDSIEKLLI

SEQ ID NO: 6664 - protein, 131 aa, Salmonella enterica
HCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 6665 - protein, 198 aa, Prochlorococcus marinus str. NATL1A
MFLVIDNYDSFTYNLVQYLGELSSQHPIASEVRVERNDALTISEIKDLNPDAILLSPGPGDPNQSGVCLDILSELSIEIPTLGVCLGHQAITQAFGGKIIRAKELMHGKTSNVLHRGTGIFKDLPNPLVATRYHSLIAERESFPECLEVIAWLEDETIMGISHKDYPHIYGVQFHPESVLTEAGHKLLSNFLDIAKAT

SEQ ID NO: 6666 - protein, 714 aa, Burkholderia xenovorans LB400
MVTTHTEGPIGHLVIDVPGRSMNVLDPELAHALDEALTRLVDDEAVRGIVISSGKSSFVAGADLARMSDFVKPGVSQADALGLIGLYNRLLRRIETCGKPVVAAASGTALGGGLELMLCAHYRIATDDPKARFGLPEVGLGLLPGAGGTQRLPRLIGIAASLPLLTQGTSLDARAALKLGILNEVVPAGELIQAASRALLEGRVKAIAPWDEKGFRLPGGDAYSRVNSDALMAANASLHAATKGNYPAPQAILRAVYEGTRLPIDKGLKLEQQLFVKLVQGAVAQNMIRTLFFARQAADKLSRRPAGIAKQSVRRLGIVGAGFMGAGIAQVSAAAGIDVVLLDRDLATAGRGRDSIAKALQAEVDKGRLREAVRDQILSRIEVAADHSAFGNCDLVIEAVLEDFEVKASVTRATEAALPAHAIFASNTSALPINELASASARPQNFIGLHFFSPVSRMALVEVIVGSATSDETLARSLDYIQQIHKTPIVVRDGYGFYTTRCVEAYIREGVRLLADGVNPVLIENAGTALGMPVGPLTLADEVGIDVLHHIVSLFRDREHGRWADDKHGAGNAILGRLELAGRFGRKAGRGFFAYPPGEPRHLELGDLDLSVAADQPEVGQVKERLLYAQVLEAARCWTDGVIDDAREADLGAHLGWAFPSWLGGPLAFIDTVGITNFVQRSDELVARYGPRFEVPGRLREAAAGGQRFHAVAA

SEQ ID NO: 6667 - protein, 443 aa, Myxococcus xanthus DK 1622
MSFTTYRDVLPSGLRVVTIETPHLHTALLAVYVRTGSRHETLVSNGVSHYLEHLFFRGSEGWPDTVKMNAAVEEVGGNLNGVTTRDHGYYYTPIHPAHLRVGLDIIGDMLTRPRLTDMEVERQIILEEMLDEVDEKGRDIDLDNLSKHLLFPGHPLALKIAGTRESVTNMTHTQILEHFAQHYVAGNIVVTAAGRVKHSEVLEMTERAFARLPRGPSSVEAPPPLTPPGPRLHFVSHDESQTEFRLNFRGVPEQHEDYPALQIIRRVLDDGLSSRLPFEIVEKRGLAYSVSASLDAYHDAGLLEIEAASAPEKAATVITEAFRVLSTLCENEVGEEELARAKRRHRMLLEFSQDSPGELSGWFGGTELFRTPESFGHRADLVDSQSAARVREVARRYFNRENLTVVAVGQRKGLKALERVVADAPGLPGPEAAPRAVVSGGRG

SEQ ID NO: 6668 - protein, 480 aa, Myxococcus xanthus DK 1622
MEKVLNYIGGELLPARGGGWLDKPEPATAETYAHVPDSDASDVQHAVEAAARAFPAWAATPATERSRMLRRIADGIRSRLDAFARAESIDTGKPLSVASTVDIPRSILNFEFFADAVTQFSSEAHQTDDVALNYTLRAPLGVVGCISPWNLPLYLLTWKIAPALAMGNCVVAKPSEVTPMTAYLLAQVCRDVGLPPGVLNLVHGLGPKVGAAMSEHPDISAISFTGSTRTGAEIARVAAPAFKKLSLEMGGKNPNVIFADCDFDEALATTLRSSFANQGQICLCGPRIFVQRPLYERFKEALVTRTRALKVGDPLEAGTDQGALVSQQHFDKVLGYVSLAKQEGGRILTGGQRANVPGRCRNGWFVEPTLIEGLDAGCRTNQEEIFGPVASIMPFDSEDEVLAWANSTRYGLAASVWTQDVKRAHRFASRLHSGIVWVNTWMLRDLRTPFGGVKDSGVGREGGWDALRFFTEPKNVCIKL

SEQ ID NO: 6669 - protein, 339 aa, Chlamydomonas reinhardtii
MPLPQPASLRDRTPEFLAIAERLQRQPGFAPSTSGAPATNGSGPGSGPSTSASSKGQHSEFARRAADIGHGIHRTSVKLQKLAQLAKRTSAFDDPAQEIDDLTGMIKQDIQGLNNAIADLQRVSARSKGEDRGNKQVSDHSHTVVDNLRSRLKDTTATFRDVLTARTDSLKHHRERRQLFTSNTDPEAGLPLLARQRAAAAASSSGALGGAAGSSSAPSAPTPSFLAASSPAQLQQQQQMQLLAPQDTYLSSRAEALRNVENTIVELGSIFNKLSELVAEQGELAIRIDENVEDTLSNVNAAQAQLLKYLNGLQNNKWLVLKVLGVLLVFMVLFVMFIA

SEQ ID NO: 6670 - protein, 418 aa, Allium ampeloprasum
MFGRAPKKSDNTKYYEVLGVSKNATPEDLKKAYRKAAIKNHPDKGGDPEKFKEIGQAYEVLNDPEKREIYDQYGEEGLKEGMGGGGGVHDPFDIFQSFFGGGGFGGGGSSRGRRQRRGEDVVHPLKVSLEDLYNGTSKKLSLSRNVLCTKCKGKGSKSGASMNCASCQGSGMKVSIRQLGPGMIQQMQHPCNECKGTGEMISDKDRCPQCKGEKVVQQKKVLEVHVEKGMQNGQKITFPGEADEAPDTVTGDIVFVLQQKEHPKFKRKGDDLFYEHSLSLTEALCGFQFVLTHLDNRQLLIKSNPGEVIKPDQFKGINDEGMPMYQRPFMRGKLYIHFSVDFPDSLTPDQCKALESVLPSRNASRLTDMEIDECEETTMHDVNIEEEMRRKQHQQAQEAYDEDDEGHGGAQRVQCAQQ

SEQ ID NO: 6671 - protein, 417 aa, Atriplex nummularia
MFGRAPKKSDSTRYYEILGVPKDASPEDLKKAYKKAAIKNHPDKGGDPEKFKELAHAYEVLSDPEKREIYDQYGEDALKEGMGGGGGMHDPFDIFQSFFGGSPFGGVGSSRGRRQRRGEDVVHPLKVSLEDLFTGTTKKLSLSRNVICSKCTGKGSKSGASMKCSGCQGTGMKVSIRHLGPSMIQQMQHPCNECKGTGETINDKDRCPQCKGEKVVQEKKVLEVVVEKGMQHGQKITFPGEADEAPDTVTGDIVFVLQQKEHPKFKRKGEDLFYEHTLSLTEALCGFRFVLTHLDGRQLLIKSNLGEVVKPDQFKAIEDEGMPIYQRPFMKGKMYIHFTVEFPDSLNPDQVKSLEAILPPKPSMSLTYMELDECEETTLHNVNIEEEMKRKQTQAQQEAYDEDDEPAGGQRVQCAQQ

SEQ ID NO: 6672 - protein, 214 aa, Oryza sativa Japonica Group
MAGEADGKAPLGSRYPPAALNERILSSMSQKHVAAHPWHDLEIGPGAPAVFNCVVEIPRGSKVKYELDKATGLIKVDRVLYSSVVYPHNYGFIPRTLCEDGDPMDVLVLMQEQVVPGCFLRARAIGLMPMIDQGEKDDKIIAVCADDLEYRHFRDIKEIPLHRLQEIRRFFEDYKKNENKEVAVNEFLPAEDAINAIKYSMDLYGAYIIESLRK

SEQ ID NO: 6673 - protein, 472 aa, Pseudomonas putida KT2440
MAERLNNDFQFIEVGRKDPKKKLLRQRKKEFVEIYEPFKPQQSVEQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDMSKVKPTGKRVAIIGAGPAGLGCADVLVRAGVTPVVFDKNPEIGGLLTFGIPEFKLEKTVLSNRREVFTGMGIEFRLNTEVGKDVTMEQLLAEYDAVFMGMGTYTYMKGGFPGEDLPGVHDALDFLIANVNRNLGFEKSPEDFVDMQGKKVVVLGGGDTAMDCNRTSIRQGAKAVTCAYRRDEANMPGSRKEVKNAKEEGVKFLYNRQPIAIVGEDKVEGVKVVETRLGEPDARGRRSPEPIPGSEEILPADAVVIAFGFRPSPAPWFEQHGIQLDSQGRVVAPEKGKFKHQTSNPKVFAGGDMVRGSDLVVTAIFEGRTAAEGILDYLEV

SEQ ID NO: 6674 - protein, 210 aa, Serratia marcescens
MKKFLIAPSILSADFARLGEDTANVLAAGGDVVHFDVMDNHYVPNLTIGPMVCEALRNYGITAPIDVHLMVKPVDRIVPDFAKAGASYISFHPEASEHVDRTIQLIKEHGCKAGLVFNPATPLSYLDYVMDKIDVILLMSVNPGFGGQSFIHGTLDKLRQVRKLIDDSGRDIRLEVDGGVKVDNIAEIAAAGADMFVAGSAIFGQPDYRK

SEQ ID NO: 6675 - protein, 198 aa, Listeria monocytogenes EGD-e
MNLIPTVIEQTSRGERAYDIYSRLLKDRIIMLGSAIDDNVANSIVSQLLFLDAQDPEKDIFLYINSPGGSISAGMAIYDTMNFVKADVQTIGMGMAASMGSFLLTAGANGKRFALPNAEIMIHQPLGGAQGQATEIEIAARHILKIKERMNTIMAEKTGQPYEVIARDTDRDNFMTAQEAKDYGLIDDIIINKSGLKG

SEQ ID NO: 6676 - protein, 346 aa, Physcomitrella patens subsp. patens
GCDIYHGRWVYDDTYPLYRSRNCPFVDRSFRCEENGRPDTDFMKYRWQPDDCDLPRFDPKEMLNRLRNQRLVFVGDSLGRNQWESMLCMLAEGVQNKSRIYEVNGQPISKHIGELLFRFEDYNCTVEYYRDTFLVPQTRPPPDVPSNVTSILKLDQVSWSVGNWPGANIMVFNSGHWWSWEKIGRQGGRFYMGNNLTTHSIEDAFRTGVRTWASWMERNLDPETSQVFFRSFAPVHFRGGAWNKGGHCHEEVKPFTDEEVNEMQETPWTNKHIIDAIKQKIKKKRSAVEFMDITTSTNYRADGHAGLYGIDTNVHGLPPKNRQDCSHFCLPGVPDTWNELLYASLL

SEQ ID NO: 6677 - protein, 502 aa, Brucella suis 1330
MAEPETCDLFVIGGGINGAGVARDAAGRGLKVVLAEKDDLAQGTSSRSGKLVHGGLRYLEYYEFRLVREALIEREVLSNAAPHIIWPMRFVLPHSPQDRPAWLVRLGLFLYDHLGGRKKLPGTRTLDLKRDPEGTPILDQYTKGFEYSDCWVDDARLVALNAVGAAEKGATILTRTPVVSARRENGGWIVETRNSDTGETRTFRARCIVNCAGPWVTDVIHNVAASTSSRNVRLVKGSHIIVPKFWSGANAYLVQNHDKRVIFINPYEGDKALIGTTDIAYEGRAEDVAADEKEIDYLITAVNRYFKEKLRREDVLHSFSGVRPLFDDGKGNPSAVTRDYVFDLDETGGAPLLNVFGGKITTFRELAERGMHRLKHIFPQMGGDWTHDAPLPGGEIANADYETFANTLRDIYPWMPRTLVHHYGRLYGARTKDVVAGAQNLEGLGRHFGGDFHEAEVRYLVAREWAKTAEDILYRRTKHYLHLTEAERAAFVEWFDNANLVA

SEQ ID NO: 6678 - protein, 463 aa, Listeria monocytogenes EGD-e
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 6679 - protein, 256 aa, Brucella suis 1330
MTKFWIGTSWKMNKTLAEARLFAEALKAADAGRSPDIQRFVIPPFTAVREVKEILSGTSVKVGAQNMHWADQGAWTGEISPLMLKDCNLDIVELGHSERREHFGETNETVGLKVEAAVRHGLIPLICIGETLEDRESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 6680 - protein, 375 aa, Coprinopsis cinerea okayama7#130
MESLLRWSIQNSTPLDSAPSDRPPARREDLNPEIIDMILGKSDAELMKEDVAVAVDTSKSEDERLNALDHLEMLIEQIDNANNLEKLKLWEPLQSILTSDASKEIKVATLWVIGTAVQNNPAAQDVYRELKPLPTILSFLSPQTSTIEERSKAIYTLSGLLKHNAPALKDLSQSGWETLRNALQDPAISVRRKAVFLLSALLIPTDPGPHPHAAHQAPLMLSDAPANLNAQPSTAVTSIEGPSVNVLTPDNRPANPENPIHPNSHAAHLRDSSRSQTSAITLEAFGKYGLLDKVISSIVTPLPHGPDGDHVGPDHDYEEKALRLLHTYAVPCRGPFTPEEKATLKKWISDAGTQSQLEERWNFTSEEYSQLVAAL

SEQ ID NO: 6681 - protein, 121 aa, Glycine max
MGIGEHFEGVKQHWARNFAFLDYFKKVYGRDQPLPKWSDADVEEFIASDPVYGPQLKALRESRKFALGGALAGAAHLGGVAFKYSKSPHGVVLATGFGALTGAVLGSEVAEHWYELYKMDK

SEQ ID NO: 6682 - protein, 572 aa, Klebsiella pneumoniae subsp. pneumoniae MGH 78578
MVIAALLAGGSFTVAANPPPPPPVSYGVEEDVFHPVRARQGMVASVDALATRVGVDILRQGGNAVDAAVAVGYALAVTHPQAGNIGGGGFMMLRTKDGKTTAIDFREMAPEQATRDMFLDDQGNPDSKKSLTSHLASGTPGSVAGFSLALEKYGTMPLNKVIRPAIKLAEEGFIVNDALADDLKTYGSEVIPQHENSKAIFWKNGEPLKKGDRLVQKNLGKSLELIAEHGPDAFYKGAIADQIADEMKKHGGLITKADLAGYKAVERTPVSGEYRGYEVYSMPPPSSGGIHIVQILNILENFDMQKYGFGSADAMQVMAEAEKHAYADRSEYLGDPDFVNVPWQALTSKAYAKAIAAEIDVNKAKPSSQIRPGKLAPYESNQTTHFSVVDKDGNAVAVTYTLNTTFGTGIVAGNSGILLNNQMDDFSAKPGVPNVYGLVGGDANAVEPKKRPLSSMSPTIVVKDGKTWLVTGSPGGSRIITTVLQMVVNTIDFGMNVAEATNAPRFHHQWLPDELRVEKGFSPDTLKLLEAKGQKVALKEAMGSTQSIMVGPDGMLYGASDPRSPDDLTAGY

SEQ ID NO: 6683 - protein, 361 aa, Oceanobacter sp. RED65
MSKNVLILPGDGIGPEIVTEAVKVLNVINDKLSLDLDFVDGLVGGAAYDVHGTPLPDETMEKAHAADAILLGAVGGPKWDNLENRDHRPEKGLLGLRSGLELFGNLRPAILYPQLADASSLKPEVVSGLDILIVRELTGGIYFGQPRGIRMLENGEREGYNTYVYSESEIRRIAKVAFESAQKRNKKLCSVDKANVLEVTVLWREILEEMSKDYPDVELSHMYVDNAAMQLVRAPKQFDVMVTGNMFGDILSDAAAMLTGSIGMLPSASLNQSNKGMYEPCHGSAPDIAGKGLANPLATILSAAMMLRYSLEESKAADEIEAAVSRVLDQGLRTADIMSEGMQQVSTAEMGDAVVAQLTEA

SEQ ID NO: 6684 - protein, 464 aa, Aeropyrum pernix K1
MDRVLRELFLLSSRDINPWTGRVFTHVYDPGMDEVRKAASKALELYRDKTMLDFTVYPSIIELEKQLLGFAGHLFHAPEGYSGTFTYGGTESIILAVLAARERWRRAGKSGAGKIVMPITAHPAFAKAAYLLGLKVERVPVDSVTLQADPAIIEEKIDRDTVMIVASAVDYPYGSLDPVEDLGDIAAARDVWLHVDACIGGMVLAFASDAGEEVGKFDFGVEGVRSFSVDMHKYGYAPKGSSILLFRRARDKKPTIFVDSSWPGYPLVNQAILSTRSAGTLAAAWAVARTLGVEGYRELAGMVLEARRRIQKGLESLGLEVLGRPKAGILSFTDSDIDVVEVATRLGRAGWVVQLQPGNKHLGFPTSIHLTISPIHARVVDSFLAAVEESIRGAPEPESRFEPALIEEGFKAVEDLLRRIENAGFDDKAVRVVNEMIYLLKPDVVAELIKEAMLEIFKPSWPGW

SEQ ID NO: 6685 - protein, 324 aa, Hypocrea jecorina
MASPTLKLNSGYDMPQVGFGLWKVDNAVCADTVYNAIKAGYRLFDGACDYGNEKECGEGVARAIKDGLVKREDLFIVSKLWQTFHDEDKVEPITRRQLADWQIDYFDLFLVHFPAALEYVDPSVRYPPGWFYDGKSEVRWSKTTTLQQTWGAMERLVDKGLARSIGVSNYQAQSVYDALIYARIKPATLQIEHHPYLQQPDLVSLAQTEGIVVTAYSSFGPTGFMELDMPRAKSVAPLMDSPVIKALADKHRRTPAQVLLRWATQRGIAVIPKTSRPEVMAQNLDNTSFDLDSEDLAKIADMDLNIRFNKPTNYFSANKLYLFG

SEQ ID NO: 6686 - protein, 386 aa, Lentisphaera araneosa HTCC2155
MSQSWNWKVQREKQAFLALEDGTIFRGYSIGADKNCLGETVFNTGMTGYQEILSDPSYAGQFICMTYPEMGNYGTTPVDMEARKTFSNGLIIHNPNDDSNWRSDNKLSQFLKDNGIPALAGIDTRALTLKLRTDGAMKSYICSDGSVSEAEAIELAKNWEGLEGQDYAAKVSCDEVFEWDPDDSISSSWGTGDELPEAKYKLVAYDFGIKWNILRGLRRSGFKVTVVPAKTPASEVIAMNPDAVFFSNGPADPKAVTYAVDAAKELIGKYPIMGICLGHQILGLASGATTYKLKFGHHGCNHPVKNLLKGTIEISSQNHNFAIDPDSINDELIEVTHINLNDDTVAGIRHKSEKMFAVQYHPEAAPGPHDPFYLFEQFYSMVDSDK

SEQ ID NO: 6687 - protein, 335 aa, Haemophilus influenzae R2866
MITSQTPITVLGAGSYGTALAITFSRNGSPTHLWGHNPAHIAQMQTERQNYRFLPDVIFPEELHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRECKGE

SEQ ID NO: 6688 - protein, 114 aa, Triticum aestivum
  misc_feature (39)..(39): Xaa can be any naturally occurring amino acid
  misc_feature (46)..(46): Xaa can be any naturally occurring amino acid
  misc_feature (81)..(81): Xaa can be any naturally occurring amino acid
PIVRCTTWEYGWRFNYRKTHFDKCSSPDLYARVGIAGSXANTMMEXTNVIMDNWIPTWDHQFEFPVFVLELALVHDEEHQXNNHQKDHFCGQTCLPVWELRSGILYVRLYDRHG

SEQ ID NO: 6689 - protein, 150 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPN

SEQ ID NO: 6690 - protein, 1153 aa, Arabidopsis thaliana
MVDWSTLPKDLLDLISKSLESSFDLIQFRSVCSSWRSAAEPKSPLPTHHLPILPDNGGSLFPDSAVGFRLSQRSILLIKPHEPCIESDSFGWLIKVEEDLNVPRKVTLLDPLCDTRNSIPENFPRVLDMSKFKVRELGREFKLHYFNTVGDIVESLYLEKAVVKYLDCDGDYKFVLLTIHVSGKLAVFRSWDRAWTVINDMPSPYDDVMLFDGRFFAVDNNGRTVVVDYSSLKLTLVASPVFGGDKKFLIESCGEMLLIILEKHHPNLEKHVYNPKLKKIGDAMTIHGGVVVTRTLTLVYPSTFTSRHKALNQMTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTFRSVCSSWRSAAGPKRLLWAHNLPFFPSDDKPFLSNVILRVAHQSILLIKPNEPQCEADLFGWIVKVWDNIYVSRKMTLLKPLSSSRNYFPQHLPRIFDMSKFTVRELCREVKLYHPDYYCVPGHTALELELGKTVVKYLNDDKFVLLTILEYGKLAVFRSWDREWTVINDYIPSRCQDLIMFDGRFFAIDYNGRTVVVDYSSFKLTLAANPLIGGGDKKFLIESCGEMFLVDIEFCLNEKPEFTGGFYSYFNETTVSYKFKFFKLVEREKRWVEVEDLGDKMFFLGDDSTFSASTADIIPRCVGTGSFVFFYTHEESLVVMDDRNLGVFDFRSGKTELVNKLPEYAKLFWPPPPWITTSHESVENYTGETSSQSQS

SEQ ID NO: 6691 - protein, 181 aa, Arabidopsis thaliana
MILPFHVTAASTVPKRLYKYELPPITSSLSPSPLSPQPLPTKHSEKETNGRASGANSDSEAEKSSKSFWSFKRSSSLNCDIKKSLICSFPRLTRSNSTGSVTNSKRAMLRDVNNHRPSSRSSCCNAYQFRPQKHTGKKGEGGGSFSVIPVLNGPSTFGLGSILRHSNSKDKTKTKKKKNKK

SEQ ID NO: 6692 - protein, 401 aa, Prochlorococcus marinus str. NATL1A
MSKRSLSSLGAEDLCGKRVLVRVDFNVPLGDEGQITDDTRIRAALPTINDLLDKSARVILSAHFGRPKGEVNETMRLTAVAQRLSELLGKTVVKTESCIGAEAKSKVDAMSNGDVVLLENVRFISGEEKNDTEFAKELASLAEVYVNDAFGAAHRAHASTEGVTKFLSPCVAGYLMEKELKYLQGAIDQPKSPLAAIVGGSKVSSKIGVLESLIDKCDKIIVGGGMIFTFYKARGLSVGNSLVEEDKLELASALEKKAKEKGVEFLLPTDVVLADNFSPDANSKLSKVDAISEGWMGLDIGSESVELFQNALKDCKTVIWNGPMGVFEFEKFANGTNAIANTLAELSAQGCCTIIGGGDSVAAVEKAGLAKNMSHISTGGGASLELLEGKVLPGVSALDDA

SEQ ID NO: 6693 - protein, 541 aa, Oryza sativa
MEAFVPGGAGAAAPAVAAVGGFVAAAALAERAGVIAPRKRTNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQARNIVTLFQLIVGILGIINQSFLFLAFFLLSCQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 6694 - protein, 180 aa, Methanosarcina mazei Go1
MGCVQQAGSIDMTERQVECVLIEIPQGSRNKYEYDKERKVIRFDRMLFSSIVYPCDYGFFPDTLALDGDPLDAMVLMWEPTFPGCVIDVHPVAMLDMEDDKGRDEKILCVPQRDPLWNYIKTIEQVPPHLLKEITHFFETYKNLERKDVVVYGWRDLETARKVIQEAKDRYTEQKKLSNQ

SEQ ID NO: 6695 - protein, 272 aa, Oryza sativa
MGALRFELRRNLRASCPGVQLSKPLCTGATCPLRLILLNHRSTRCFPSSSPPNQNPLDPCRLRTAAAAGEAIHMAAADTDTYVTEVAFGDAVITTTVTSSGAAVEGWLREVRAAYGPGLIVGLDVEWRPSYGPAQNPVALLQLCVDRRCLIFQLLYADYVPGSLRRFLAGAADCFVGVGVDKDAERLSDDHGLTVANTADLRPLAAQRLGRPELSQAGLQAVVRAVMGADLVKPQRVTMSRWDASCLSNEQIRYACIDAYVSFEVGRRLLRA

SEQ ID NO: 6696 - protein, 496 aa, Mentha spicata
MELDLLSAIIILVATYIVSLLINQWRKSKSQQNLPPSPPKLPVIGHLHFLWGGLPQHVFRSIAQKYGPVAHVQLGEVYSVVLSSAEAAKQAMKVLDPNFADRFDGIGSRTMWYDKDDIIFSPYNDHWRQMRRICVTELLSPKNVRSFGYIRQEEIERLIRLLGSSGGAPVDVTEEVSKMSCVVVCRAAFGSVLKDQGSLAELVKESLALASGFELADLYPSSWLLNLLSLNKYRLQRMRRRLDHILDGFLEEHREKKSGEFGGEDIVDVLFRMQKGSDIKIPITSNCIKGFIFDTFSAGAETSSTTISWALSELMRNPAKMAKVQAEVREALKGKTVVDLSEVQELKYLRSVLKETLRLHPPFPLIPRQSREECEVNGYTIPAKTRIFINVWAIGRDPQYWEDPDTFRPERFDEVSRDFMGNDFEFIPFGAGRRICPGLHFGLANVEIPLAQLLYHFDWKLPQGMTDADLDMTETPGLSGPKKKNVCLVPTLYKSP

SEQ ID NO: 6697 - protein, 500 aa, Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 6698 - protein, 357 aa, Oryza sativa Japonica Group
MERPPRRPSAARPRPRSLQRAAAALFLAIFVALPFAVLYRGPVSRSLHDSWEWDPLPSLDASEEDGAARDDDLDSQDLKLEQVLQKASMGDNTVILTTLNSAWASPGSVIDLFIDSFRSGVRTSSLINHLVIIAFDWNAYKQCLKIHPYCFALGTDGVDFSEEKRFLTSGYLEMMWKRIDFLRLVLESGFSFIFSDADIMWFRSPFPYFYPDGDFQIACDHYFGNATDLRNIANGGFNYVKSNERSIEFYSFWYSSRLRYPGLHDQDVFNVIKHDPYVSDIGLKIKFLSTSYFGGFCEPSRDLNKVCTMHANCCIGLQSKVHDLRVMMEDWRSYLSLPPSLKRLSALAWRVPQNCRY

SEQ ID NO: 6699 - protein, 493 aa, Oryza sativa Indica Group
MAFFLPLAFSLFLAVISAYVLQLLADARRRLPPGPWPLPLIGNLHQLDHLPHRSLARLAARHGPLMSLRLGTVRAVVASSPEMAREVLQRHNADIAARSFGDSMRAGGHCENSVVCLPPRLSWRALRRLSTVGLFSPRRLDAMRALLEEKVAELVRRVSGHAARGEAVDVGHAAHVAALGVLSRTMFSVDLDPEAAREVSDIVDEASVLGTGPNVSDFFPAIAPADLQGVRRRMARLVKRMYAIIDEQIERRMHGRTAGEPRKNDLLDVMLEEGESKEDSNEINRDAIRGLFTDLFTGGETTSHTMECAMAELLQCPNSMRRVQEELKSVIGTKQQMDEHDITKLPYLQAVIKETLRLHPPVPLPPYEAEATVEIQGYTIPKGAKVLINLWAINRCANAWTEPDKFMPERFYDSDITFMGRDFQLIPFGAGRRICLGLPLAHRMVHLMLGSLLHRFTWTLPAEAGKNGVDMRERFGLTLSFVVPLYVIAQEIQ

SEQ ID NO: 6700 - protein, 498 aa, Mentha x piperita
MELLQLWSALIILVVTYTISLLINQWRKPKPQGKFPPGPPKLPLIGHLHLLWGKLPQHALASVAKEYGPVAHVQLGEVFSVVLSSREATKEAMKLVDPACANRFESIGTRIMWYDNEDIIFSPYSEHWRQMRKICVSELLSSRNVRSFGFIRQDEVSRLLRHLRSSAGAAVDMTERIETLTCSIICRAAFGSVIRDNAELVGLVKDALSMASGFELADMFPSSKLLNLLCWNKSKLWRMRRRVDTILEAIVDEHKFKKSGEFGGEDIIDVLFRMQKDTQIKVPITTNSIKAFIFDTFSAGTETSSTTTLWVLAELMRNPAVMAKAQAEVRAALKEKTNWDVDDVQELKYMKSVVKETMRMHPPIPLIPRSCREECVVNGYTIPNKARIMINVWSMGRNPLYWEKPDTFWPERFDQVSKDFMGNDFEFVPFGAGRRICPGLNFGLANVEVPLAQLLYHFDWKLAEGMKPSDMDMSEAEGLTGILKNNLLLVPTPYDPSS

SEQ ID NO: 6701 - protein, 422 aa, Pseudomonas putida KT2440
MSDLKTAALEYHAQPRPGKLSVELSKPTATARDLALAYSPGVAEPVREIGRDPELAYKYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEEAKIVCLGAGAAAISCMKLLVSMGAKVENIFMIDRSGVIHAGRDDLNQYKAQFAHATDKRTLADALDGADVFVGLSGPNLLSPEGLKSMAANPIVFACSNPDPEISPELAHATRNDVIMATGRSDYPNQVNNVLGFPFIFRGALDVRAKRINEEMKIAAAIALKDLAKLPVPKEVCEAYGVEGLEFGREYIIPKPLDARLITVVSDAVAKAAIESGVATLPYPKHYPLTSVDEVFNG

SEQ ID NO: 6702 - protein, 351 aa, Zea mays
LLSSGSRKQQYLVPKCGQITQNGNCNGASVLQVSMQLKAMGIGAENGNKENVPGADLPKPMSIEPPFAVDWLEISWEELELKERVGAGSFGTVYRADWHGSDVAVKVLTDQDVGEAQLKEFLREIAIMKRVRHPNVVLFMGAVTKCPQLSIVTEYLPRGSLFRLINKAANGEMLDLKRRLRMALDVVCITSMQAKGINYLHCLNPPIVHWDLKTPNMLVDRNWSVKVGDFGLSRFKANTFISSKSVAGTPEWMAPEFLRGEPSNEKCDVYSFGVILWELLTMQQPWSGLGPAQVVGAVAFQNRRLPIPKDTSPELAALVEACWDDDPRQRPSFSSIVDTLKKLLKALLGGS

SEQ ID NO: 6703 - protein, 416 aa, Idiomarina loihiensis L2TR
MSTEQNPSSFQSLGLSDDILRAVTECGYTTPTPIQQQAIPTVMAGHDLLAAAQTGTGKTAGFTLPLLHKLSQTKTDGKPVIKALILTPTRELAAQVEDNLNTYAKYTGLKSLVIFGGVGINPQISALRRGVDILVATPGRLLDHSRQGTVDLSKIDVLILDEADRMLDMGFIHDIKKVMKLIPEKRQTLLFSATFSSEIKALSQQFMQQPKLIEVARQNAAADTIEQRVYPVDKKRKRELLSYLIGSRNWRQVLVFTRTKHGANRLATQLTDDGLPAMAIHGNKSQGARTKALAQFKAGKLRVLVATDIAARGIDIDELPHVINFELPQVAEDYVHRIGRTGRAGSEGEAASLVCVDEHKLLRDIEKLTKNEIPREVIPGFEPDPSIKPEPIQKPRTGRPQNSRRAPRQKRPDTRR

SEQ ID NO: 6704 - protein, 215 aa, Leptospira interrogans serovar Lai str. 56601
MKISASILATKLTELVKTVPNYDPTAIDLMHMDVMDGNFVPQISFGEALTKEVKSLTSIPLDVHLMVAKPENHVFKYYEFNPYCITFHIETTDFPIRLAQEIKSHGTKVGVSLNPGTPVSSLENVLPYVDLILLMTVEPGFYGQKFIINGMDKIRKVKELIGSRPIEIEVDGGVNDTNIQELRKNGVDIVVVGAGLYKTGNPVENAKNLKYLARV

SEQ ID NO: 6705 - protein, 327 aa, Listeria monocytogenes EGD-e
MGIAVLGGAGYIGSHAVDELITRGYEVVVIDNLRTGHRESIHKKAKFYEGDIRDKAFLSSVFEKEKVDGVIHFAASSLVGESMEVPLDYLNNNVYGTQIVLEVMEEFDVKHIVFSSSAATYGEPERVPITEDMPTNPESTYGETKLIMEKMMKWCDKAYGMKFVALRYFNVAGAKADGSIGEDHKPESHLVPIILQVALGQREKLAIYGDDYNTPDGTCIRDYVQVEDLIDAHIRALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 6706 - protein, 506 aa, Ralstonia eutropha JMP134
MNHRTVVTGTGGTRPKPIPAPAECRARLERLARRALPVLLLAALPWTAGAQTPRTVASPMPSGQTAPVDATAQGTTEYKLSNGLRLIVKEDHRAPTVAHQIWYRVGGIDEVSGTTGVAHMLEHMMFKGTPKVGVGEFSKQVAALGGRENAMTNRDFTLYYQQIGKQYLPKMMELEADRMANLIFNKGEFDREMKVVMEERRLRTDDSARGTVYEQLLANVYVAAPYRHPVIGWMDDLVNMRLEDVQSWYRSWYVPNNATVIVTGDVNPAEVRALAERYYGKLKPRPLPLRKEQIDPPQLGIKRVWVKAPAENPYMVMAYKVPRLRDVEKDVDPYALEVLAAVLNGYDNARLTRELVREQRLADDVNVGYDSINRGNSLFVLDGTPADGHTTEQIEAALREEIQRIARNGVSPEELKRVKAQVVASQIYKRDSVFGQGMEIGVAEISDISWRKIDRILDKIKEVTPAQVQAVAAKYFTDDNLTVATLLPQPIDPNKPKAKAPEGLRH

SEQ ID NO: 6707 - protein, 378 aa, Dechloromonas aromatica RCB
MSKRDFYEILGVNRDASDDEIKKAYRKLAMKHHPDRNPDNPGAEEKFKEAKEAYEILSDSQKRAAYDQFGHAGVEQGGMGGGGFGGGGGGFADAFGGIFDEIFGGRAGGSGGGRSNIYRGADLRYNLEITLEQAAHGTETKIRIPTMEVCEPCNGSGAKAGTQPKTCPTCGGSGQVRLQQGFFSIQQTCHKCHGTGRFIADPCKSCDGAGRIKQHKTLAVKIPAGVDEGDRIRLSGEGEHGVNGGPPGDLYVQIHLKPHAVFTRDHNDLHCEMPISFTAAALGGEIEIPTLDGAAAIKIPAETQSGRVFRLRGKGIKGVRSHTHGDLMCHVVVETPVNLTERQKELLRELEESSKDNSGKHNPRSKSWMDKVKDFFAE

SEQ ID NO: 6708 - protein, 267 aa, Haemophilus influenzae R2866
MTLDVWQHIRQEAKELAENEPMLASFFHSTILKHQNLGGALSYLLANKLANPIMPAISLREIIEEAYQANPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLHPVPEYATAAGVPARIVSQDKAAKPAFDMNQYFIGIDDDMNLNI

SEQ ID NO: 6709 - protein, 269 aa, Pseudomonas putida GB-1
MNLQRRNNVKVLGRGYATLIFLHGFGCDQSMWSYLLPHFSKRFRIVVLDHVGAGRSDLSAYCVEKYSTLNGYAQDLNEIIDAFAKGPVILIGHSVSAMIAALADGACPGRIAAHVMVGPSPCYIDSEGYIGGFKEADIQSLLDTLDSNYLGWSSTMAPVIMGTPGQPELSKELTNSFCRTDPEIAKQFARVTFLSDNRKDVSGLRTPTLILQSTEDLIAPTAVGEYLNSVLLNSELCLVPNIGHCPHMSAPHACIEAMDAFLSPWISAP

SEQ ID NO: 6710 - protein, 349 aa, Agrobacterium tumefaciens
MVPIWRRKMETAMLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 6711 - protein, 407 aa, Myxococcus xanthus
MPGGRRPGATASETTWGPRAYTQKHPRSRELPETASMPTASTSSSLARRLMPLALAALAVLSACTEARGAAPAAPGPTIQDTRRYEKPSDADLRRTLSPLAYEVTQKGATEPAFRNPLWNHHEEGLYVDVVSGEPLFSSRDKFDSGTGWPSFTRPVDSARIVEKRDSTQGMERVEVRSKAAGSHLGHLFGDGPAPAKTRYCINSAALRFVAVNDLAKEGYGAWLPLFGRPAPAAATKRQDTSPFTETALLAGGCFWGMEDLLRKIPGVVQTEVGYTGGSSAFRNPTYHDVSSDKTGHAEAVRVVFDPTRLTYETLLEQWFFRMHDPTTLNRQGNDVGTQYRSAIFYLSDAQKRVAEEVKARVDASRKWPRPVVTQIVSAGAFTPAEDYHQDYLVKNPGGYTCHYMRD

SEQ ID NO: 6712 - protein, 767 aa, Zea mays
PRVRLPAGTIHVKFTGSAGQSFGAFLCPGITLELEGDSNDYVGKGLSGGKIVVYPPRNSSFSPEDNIVIGNVALYGATMGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHRRNTESVLARDILSDFDNLLPKFVKVYPRDYKRVLESMKVEKAVAKHAKEPKMANGISVTTKKVQPDQSASRPTHVANAKKYRGFITYERESISYRDPKERVRDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYGVLTKRFIGDGNGKVKALEVVRVKWEKVDRRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 6713 - protein, 317 aa, Ralstonia eutropha JMP134
MSSEGLMVFTGNANPKLAEAVVQHLGIPLGKALVGRFSDGEVQVEIQENVRGKHVIVLQSTCAPTNDNLMELMVMVDALKRASARSITAAMPYFGYARQDRRPRSARVAISAKVVANMLEVAGVERVLTMDLHADQIQGFFDIPVDNIYASPVLLGDLREKNYGNLLVVSPDVGGVVRARALAKELNCDLAIIDKRRPKANVAEVMNIIGEVDGRNCVIMDDMIDTGGTLCKAAQVLKERGAQKVFAYCTHPVLSGGAAARIADSALDEVVVCDTIPLSEEAAKCGKIRQLSTAPLLAETFTRIVKGDSIMSLFAGS

SEQ ID NO: 6714 - protein, 441 aa, Pseudomonas putida GB-1
MIDQATGMKSAERYRVENVERAHQFPGFFQDGKYYLGPELLTAVGWLEGTRFIYDSLDAEGEPVFPNREAGIIEGLTLTLVDGTALGLSRIEASEALADFDTSTSGTKEGALGDSYPIKGPLRGKVVVITGASSGIGRAAAHAFACKGARLVLAARDEEALFDVLDECTDCGTDAIAIMTDVTRNDQVQALAEQAAEFGHGRIDIWVNNAGVGAVGNFEETPLEAHEQVIQTDLIGYLRGAYVALPFFKTQGSGILINTLSLGSWVAQPYAAAYSASKFGLRGLTEALRGELTEFPDIHVCDIYPAVMDTPGFRDGGNYTGHALTPLGPIYDPELVAKAMVACAISPRAHTTVGATARLAHLASFLVPGLPQLSGWLTRWGLSRSPRAEISSGNLFEPPNGRRSVDGGWRSQRSKTPLLVTAAVLGIIAGFVITRSQRRHP

SEQ ID NO: 6715 - protein, 306 aa, Brassica napus
MGLKHSSTSSLFFLILFFLFLSSQVSSQACLKTCGQIPIKYPLGTGSGCGDPRFTRYIKCDPDQQTLTLTTHTGCYPITSVDYAKQTIYITDSSMSTCACTRPSQGFGLDWDAPFSFHDDTVFTLLDCSVDESPVFKPLSNSTGRVSLCDRQSSSICNFLYSNCRAISLINLQESTGGVYVPLDLGPSLEMDLQKLRCSSYSGFYNLGPAQESHPENWNYGIALKYKFNVFDEYPAVCGGCERSNGACGYNTQTSSFVCNCPGGINTTSDCFFLYNSASIVLPWFPREWVMYPLAWVVLWTVMSLP

SEQ ID NO: 6716 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVESRKARRIEVRFPDPAGNPYLCFAALLMAGLDGIKNKIHPGEAMDKNLYDLP

SEQ ID NO: 6717 - protein, 86 aa, Silene vulgaris
PPGLFFRHAGHRDKVVDFHWNSIDPWTLVSVSDDCSSSAGGGTLQIWRIIDLLYRPEEEVLAELDKFRSHVANCSPTPTKDANHSA

SEQ ID NO: 6718 - protein, 131 aa, Prochlorococcus marinus str. NATL1A
MSAKTDEILDSLKSLSLLEASELVKQIEEAFGVSAAASAGVVMAAPGAAAGGDGADAAEEKTEFEVVLESFDASSKIKVLKEVRNATGLGLGEAKALVEAAPKTIKEGATKEDAEALKKAIEAVGGKVTLK

SEQ ID NO: 6719 - protein, 235 aa, Nostoc punctiforme PCC 73102
MTGTDPVKLMKQEVGKAAAALVKSGSIVGLGTGSTTAYTIQFLGDRLKSGELKDIIGIPTSFQSEVLAKQYGVPLATLDSIDHIDIAIDGADEVDPQKNLIKGGGAAHTREKVVDYLAEQFIVVVDSGKLVDRLGSSFAVPVEVIPMAITPVTNAIKKLGGKPELRMGVKKAGPVITDQGNFVLDVRFDSIEDPVSLEKTLNNIPGVLENGIFVNCVDLVLIGEVKDGQPLVRQL

SEQ ID NO: 6720 - protein, 448 aa, Streptococcus pneumoniae TIGR4
MTSAKEYIQSVFETVKARNGHEAEFLQAVEEFFNTLEPVFEKHPEYIEENILARITEPERVVSFRVPWVDRDGKIQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGTVWTYAGNYDIALPCATQNEINGEAAKRLVAQGVICVSEGANMPSDLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 6721 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRMEVRFPDPAANPYLCFAALLMAGLDGIKNKIHPGEAMDKNLYDLP

SEQ ID NO: 6722 - protein, 274 aa, Chlamydomonas reinhardtii
MATSLLLNSGHHIPSVGLGVYKSTPGEETYGAVLSALRLGYRHVDTAQVYGNEADVGRAVRDSGLPRDQVYVTSKLWRDAYGYDRALAAVQDSVRRSGLPYLDLVLLHCPGEPGPREGAWRALEEAVRQGLVRSIGVSNFSQAHLEKLSRTATIQPAVNQIEVHPFLQRRELVAYCQAAGIVVEAYSPLSKGHKLSDPRVAGVAARLGVTPAQVMIRWGLQHGMVSLPKSVNPDRQAVNLDVFGFALDEGAMAQLDGCEEGLVTGWDPVAHDPV

SEQ ID NO: 6723 - protein, 486 aa, Burkholderia xenovorans LB400
MRYSIKLNDQALLRQHAYINGEWQTADNGSTFTITDPSSGDLLAQVPMMGAAEARRAIHAACIAWSVWRKKTAKDRAIVMRRWFNLVLENADDLATILTAEQGKPLAEAKGEIAYAASFIEWFAEEGKRVSGDTPATPDADKRIIVTKEPIGVCAAITPWNFPAAMITRKVAPALAAGCTIVVKPAEATPLTALALAVLAERAGIPSGVLNVITGDPRAIGAELTANPGVRKLSFTGSTAIGRMLMAQSAPTIKKVTLELGGNAPFIVFDDADIDNAVEGAVVSKYRNSGQTCVCPNRFYVHDAVYDAFVEKLSKAVFELKVGSGRDPGVSIGPLISEAAVKKVEAHIADALQKGAKLEVGGARHELGHSFFQPTVLSDVTPDMMLSREETFGPLAAVSRFSSEDEVVRLANDTEYGLAAYFYSRNIARVWRLAEALEYGMVGINTGLISNEVAPFGGVKESGIGREGSRYGIEDYLVIKYLCLAS

SEQ ID NO: 6724 - protein, 348 aa, Pycnococcus provasolii
VELRDGDKSMWMGKGCSKAVANLNDIIAPALVGKDPTQQKAIDDLMNKELDGTENKGKLGANAILAVSMAVCKAGAAEKDIPLYKYIAELAGNTKLILPVPAFNIINGGSHAGNKLAMQEFMTLPTGATSFTEAMKMGTEVYHNLKSVIKEKYGQDACNVGDEGDFAPNIESNKEGLDLVNQAIEKADSTGKVKIGMDVASSEFYTEDKMYDLDFKTKDNDGSQKKTGEEMLEMYKSFCSEYPVISIEDPYDQDDFENTAALTAEGVCQVVGDDLLVTNPTRVASAIEGKTCNALLLKVNQIGSISEAIEAVRMSKEAGWGVMTSHRSGETEDSFIADLAVGLATGQI

SEQ ID NO: 6725 - protein, 490 aa, Burkholderia xenovorans LB400
MNVTPSSRLLGDDVWHGRIFTGSWCNGASEAEVKEPASGKRLARIGMADGALVAASAKTAFEAQQEWAALPYDERAAVLRRAARLAEESVEEIVGWIVRESGSTRAKAAFETQVTVKALHEASALPSRSAGEVLPSGPGRLSLARRRPLGVVGVISPFNFPLYLAMRAVAPALSLGNAVVLKPDPRTAVCGGFVIARLFEMAGLPNGVLHVLPGDGAAGAGLTSDPHVAMIQFTGSTNAGRKVGEAAGRHLKKVSLELGGKNSLIVLDDADLDRAVANTAWGAYLHQGQICMATGRVLVQRAIYERFVEKLVAKASSLTVGDPATDDVALGPLINGTQRDHVTRVLDAAQQAGARVEAGGSFRDLFFEPTVLTGVTKENPAFSEEIFGPVAVVVPFDTDEEAIALANDTEYGLAIAIVTSNVGRALRMGERLRSGLLHINDQTVNDEVINPFGGVGASGNGTSVGGPANWEEFTQWQWLTVKGEAPLYPL

SEQ ID NO: 6726 - protein, 465 aa, Oryza sativa Indica Group
MPILNHQHRLLVLQIFFVLFLSPHIVVPGSPAAGKFSDVLANGRNVSDGDVLVSAGGSFTLGFFSPAGSGAAQPATRSRRYLGIWFSISPEAVHWVANRDRALNDTSGALKMSDAGVLLLLDGAGKVVWSSSSSSSAGSSSSSTAQLLESGNLVVHAQGSGSGSGTALWQSFDYPCNTLLPGMKIGKNRWTGAEWYLLSWRTAVDPSPGNYRYVTDADGALPENDLLDGNDTKMYRTGVWNGKRFNGVPEMASFADMFSFQLTVSPGEVTYSYVAKAGAPFSRVVVTDDGVVRRLVWDAATRAWKTFFQAPGDSCDSYAKCGAFGLCDSNAWATSICRCVKGFSPVSPAACSMREFSGGCRRNVALDCINGIGTDGFEVLHGVKLPDTHNASLDMALKLGECKVRCLANCSCVAYAAADFSGSGCIIWTNPFVDLRFVDDGQDIYLRLASSEIGIAKCKCNQLMK

SEQ ID NO: 6727 - protein, 433 aa, Prochlorococcus marinus str. NATL1A
MADSLELVIDTIMAREVLDSRGNPTVEAEVLLEGGAIGRSIVPSGASTGAHEAHELRDGGKRYLGKGVLKAVNHIEENIAPALCGLSSLDQATVDSVMKQLDDTDNKSNLGANSILAVSMATARAAANGLGLPLYRYLGGPMSSLLPVPLMNVINGGEHAANNLDFQEFMLVPHGAESFREALRMGAEVFHTLKDLLSQKGLSTAVGDEGGFAPNLESNKAAGDLLMQAIEQAGFKPGEQVSLALDVASTEFYEEGQYCYGGNSYSSEQMVEELAGLVNSFPIVSIEDGLAEDDWDGWSLLTKKLGKSVQLVGDDLFVTNTLRLQRGIDENIANSILIKVNQIGSLTETLEAIELASRSSYTTVISHRSGETEDTTIADLSVATKSGQIKTGSLSRSERVAKYNQLLRIEDELGSQATYAGLVGLGPRGSLKG

SEQ ID NO: 6728 - protein, 375 aa, Mastocarpus papillatus
VATAGGKFSAMVPSGASTGIYEALELRDGDKSSYLGKGVDKAVANVKDKISEAIMGMDASDQGAVDAKMIELDGTEGGFKKNLGANAILGVSMAVARAGANAKGVPLYKHLNNLAGNPKMLLPVPSLNVINGGTHAGNKLAMQEFMILPVGASTFREAMKMGAETYQYLKKVIKKKYGLDATSVGDEGGFAPNIQDNTEGLKLLEEAIEMAGYTGKIKVGMDVAASEFWKEDKEVYDLDFKNDDNDGSQCLTGEKLGEMYKDFISNFPMISIEDPFDQDDWESYAKLTAAVGEGVQIVGDDLLVTNPNRIQTGIDKKACNALLLKVNQIGSITEAIQASKMSRDAGWGVMVSHRSGETEDNFIADLCVGLGTAQI

SEQ ID NO: 6729 - protein, 266 aa, Bacillus sp. SG-1
MAEAMISGLVESNKIPSEQIIVSNRSNRGRLQELQAKYDVTAITKDELKFEEIDMLILAMKPKDIDPVLESIKDLVNPDTVILSVLAGITTGHMEEGLPQGQKVIRVMPNTSSMMRESATAIAAGKHTKVEDMTTAQELLECIGEVYTINEEKMDIFTGIAGSGPAYFYYLMEHIEKAGKDSGLEPEVARQIGAQTILGAAKMIMERDETPAQLRENVTSPNGTTAAGLDALAKFGGGEAIAQAVKGAEKRSKEISSQFKKVLVAN

SEQ ID NO: 6730 - protein, 347 aa, Zea mays
  misc_feature (277)..(277): Xaa can be any naturally occurring amino acid
  misc_feature (305)..(305): Xaa can be any naturally occurring amino acid
SSPPAACLNGSTRQEGGRKETVDQSLRRRPIHHRSDEREEMKIIIDTDPGIDDSVAILMAFQMPGVQVLGLTTIFGNCTTEHATRNALILCEKASHLEVPVAEGSHEPLKGGKPHVADFVHGPDGLGNVDLPDPTIKKVEESATDFLVDKVSRFPGEVSVLALGPLTNIALAIKKDPSFVKNVKKIVVLGGAFFAAGNATPSAEANIHSDPEAADMVFTSGADIYVVGLNITTQVSFTDKDLLELRNSQGKYAQFLCDVCKFYLDWHTESYGAPALXALVRPELFTFKKGVVRVETHGICVGHTXMDMLLKKWNSENPWTGYSPISVAWTVDVPKVVAFVKELVTKP

SEQ ID NO: 6731 - protein, 373 aa, Mastocarpus papillatus
VETDDGKFRAMVPSGGSTGIHEAHEMRDGDENKFSGKGVLKAIKNVNNEIAVTVIGMDPTDQEGIDQALADLDGQPDKSRLGANAILGVSMAVTRAGAAKKGIPLYKHINNLAGNPTPILPVPSFNVLNGGSHAGNPLAMQEFMILPTGAESFKEAMQVGVEVYHKLKSVIKQKYGQSSTSVGDEGGFAPNIKDSEEALELIQTAVKEAGHSDIVQIGMDVAASEFYNKETKKYNLNFKNPAGSTNPAGMKSADELLRMYKLFAANYGVISIEDPFDQDDFTSFEKMTGELNELIQIVGDDLLVTNPERIERAIERNACNALLLKLNQIGTVTEAIEANNLARNAGFGVMVSHRSGETEDSFIAALCAGLGTG

SEQ ID NO: 6732 - protein, 228 aa, Pseudomonas putida KT2440
MSTLADNLSAISARIASAAQAVGRDPASVQLLAVSKTKPASAIREIHAAGVHDFGENYLQEALTKQQALSDLPLIWHFIGPIQSNKTKAIAEHFDWVHSVDRLKIAQRLSEQRPAGLAPLNICLQVNVSGEDSKSGCTPADLPALAKAVAALPNLRLRGLMAIPEPTEDRATQEAAFASLRKLQEGLGLGLDTLSMGMSHDLEAAIAQGATWVRIGTALFGARDYGNT

SEQ ID NO: 6733 - protein, 272 aa, Pseudomonas putida KT2440
MSKTRIAFIGAGNMAASLIGGLRAQGLDASQIRASDPGAETRSRIQAEHGIEAFEDNAQAIDGADVIVLAVKPQVMKTVCQALQPNLQDGQLIVSIAAGITCASLQSWVGARPVVRCMPNTPALLRQGVSGLYATAEVSGEQRLQAEQLLSAVGTALWLEQEQQLDAVTAVSGSGPAYFFLLIEAMTAAGEKLGLPRETASQLTLQTALGAARMAVASDVDAAELRRRVTSPAGTTEAAIKSFQASGFEAIVEQALQAAATRSAELAEQLGK

SEQ ID NO: 6734 - protein, 375 aa, Prionitis lanceolata
VTTADGKFSAMVPSGASTGIYEALELRDGDKSAYLGKGVDKAVANVKDKIAPAISGMDAADQAAVDKKMIELDGTEGGFKKNLGANAILGVSMAVARAGAAAKRVPLYKHLNDLAGSPKMLLPVPSLNVINGGSHAGNKLAMQEFMILPVGATSFREAMKMGAETYQYLKKVIKKKYGLDATSVGDEGGFAPNIQDNTEGLRLLEEAIEMAGYTGKIKVGMDVAASEFWKDDTKMYDLDFKNPDNDGSQCLSGEKLGELYKEFVAKFPMISIEDPFDQDDWESYAKLTEAVGESVQIVGDDLLVTNPDRIRTGIEKKACNALLLKVNQIGSVTEATQASQISRDAGWGVMVSHRSGETEDTFIADLCVGLGTAQI

SEQ ID NO: 6735 - protein, 482 aa, Vitis vinifera
MESDLGKLFIGGISWDTDEDRLKEYFRTYGEVVEAVIMRDRTTGRARGFGFVVFADPAVAERVVMDKHMIDGRTVEAKKAVPRDDQHLLNRNTGSIHGSPGPGRTKKIFVGGLASTVTESDFKKYFDQFGTINDVVVMYDHNTQRPRGFGFITYDSEEAVERVLHKTFHELNGKMVEVKRAVPKEHSPGPSRSPLVGYNYGLGRNNNFLNNYGQGYNMSSVGSYGIRMDGRFNPVASGRSGFPPFGAPGYGMGMNLEQGLSPSYSGNSSFSNNPGYGRILNPYYSGNSNRYSTPIGYNAGNGRSDSVLNSTPRNVWGNGSLNNATNPASPGAYLGSGGGNFGVSFGNGGANWGSSPIPAQGGGSALGFTSGSLNYGSGDSSYGLGGGGYGRNSSTGVAAASSFAPSTGGYEGSYEELYRSGSVYNDSTWRTPTSELDGPGSFSYGLGNAASDVTANSAEDYIGSYSVANRQSNRGNTFCLFS

SEQ ID NO: 6736 - protein, 400 aa, Pseudomonas putida GB-1
MRALTYHGANDVRVDNVPDPIIEEADDIILRVTATAICGSDLHLYRGKIPETEAGDIFGHEFMGIVEDTGSAVTNLQIGDRVVIPFVIACGSCFFCQHDLFAACETTNTGRGSINNKKGIPPGAALFGYSHLYGGIPGGQADYVRVPKGNVGPFKVPTDLTDDKVLFLSDILPTAWQAVINAEIGQGSSVAIYGAGPVGLLSAACARMLGAQTIFMVDDNDYRLAYAQDAYGVVPINFEQDDDPADSIIRQTPGMRGVDAVIDAVGFEAKGSTAETVMTALKIEGSSGKALRQSIAAVRRGGVVSVPGVYAGFIHGFMFGDAFDKGLTFKMGQTHVQKYLPELLEHIEAGRLRPELIVTHRLALEEAAMGYKMFDQKQDNCRKVILVPGAAAGTLGPDYV

SEQ ID NO: 6737 - protein, 169 aa, Oryza sativa Indica Group
MAATADNGEKMILLISSDGERFELSEAAASQSKTLSHMIEDDCTDNGVPLPNVTAVVLAKVVEYFKKHAAVTPKTATEAVAADKAKREKELKSFDAEFVDVDRTMLLELILAANFLNAQDLLDLTCQHAADLIKDMSVEEVREVFNITNDFTPEEEAEVRKENAWAFDN

SEQ ID NO: 6738 - protein, 401 aa, Arabidopsis thaliana
MITTSSFNSQRIYTTMASSSSSSLSFSTSKKNKTFFKKPNSAFSSSRATSLIKRQQTVFKKAKELSILCDIDVCVICYGSNGELKTWPEEREKVKAIARRYGELSETKRRKGSVDLHEFLEKMNKDDPEKEEKKKIKVRRVPKVKYPVWDPRFDNYSVEQLMGLVQSLERNLTRIQHRTCAVVEAQGQRRVQYTNMANQELMMANTMNQLQQHSNQVSMYLWNHGNGAFSQIPVSALASNQTQSLAPIPPELMIYPNSDAGNYSGSLGVQGTGINGLQNMNMLTYNNINSVNDFSKQFDQNSRAESYSSLLGVHEDGNNEFENPNMSSRNNFNVQDCAGLLGMQGAGTNGLQSMNMHDYSNNNSINSNGLSHQYVQFPTYNSQHQDRVFNLDQNGNNTRSL

SEQ ID NO: 6739 - protein, 169 aa, Oryza sativa Indica Group
MAATADNGEKMILLISSDGERFELSEAAASQSKTLSHMIEDDCTDNGVPLPNVTAVVLAKVVEYFKKHAAVTPKPATEAVAADKAKREEELKSFDAEFVDVDRTMLFELILAANFLNAQDLLDLTCQHAADLIKDMSVEEVREVFNITNDFTPEEEAEVRKENAWAFDN

SEQ ID NO: 6740 - protein, 559 aa, Mycobacterium sp. KMS
MGVERSGDSDTDGDVPGAASDLTRLPDLAHGTPRAGPVRLRYPVYVDLLPPCNDACPAGENIQAWLSHVRAGRHEQAWRRLVSDNPFAAIHGRVCYHPCETHCNRGQLDSPVAIHAVERFLGDLATQNRWEFAPPAARSGKRVLVVGAGPSGLSAAYLLALRGHDVEIRDAGPEPGGMMRYGIPSYRLPREVVDAEVDRIAALGVRLTCGHQVEDLAAERDSGDFDAVFVAVGAHLAKRVDIPGRDAGALLDAVTFLRSVAAGQPPELGRHVAVYGGGDTAMDVARVARRLGAEDSVIIYRRTREQMSAHAEETEEAEREGVRINWLRTITAFDRPDLQVEVMDLDEHGQPRPTGRFEKLAADTVIMALGQKTESEFMRTLPGVRFDDDGTVQVSPTLMTGCPGVFAGGDMVPGERTVTVGVGHGKRAARHIDAWLAGRSGERPPSHPPVAFDDLHLWYFGDAPQRPQPHLDAERSVAGFDEVVGGLTEQAAVYEAARCLSCGNCFECDGCYGACPEDAIIKVAEGHHGYEFVYDRCTGCGACFEQCPVHAIEMLPETS

SEQ ID NO: 6741 - protein, 421 aa, Klebsiella pneumoniae subsp. pneumoniae MGH 78578
MKSSELNQRRQQATPRGVGVMCNYFVEKAENATLWDIEGNEVIDFAAGIAVLNTGHRHPKVVAAVADQLQAFTHTAYQIVPYESYVSLAERINDLAPIDGPAKTAFFTTGAEAVENAVKIARAYTGRPGLITFGGGFHGRTFMTMALTGKVAPYKIGFGPFPGSVYHGVYPNAAHGVTTADALKSLERIFKADIAPDQVAAIILEPIQGEGGFNVAPADFMQALRDLCDTHGILLIADEVQTGFARTGKLFAMQHYEVKPDLMTMAKSLAGGFPLSGVVGRAEVMDAPAPGGLGGTYAGNPLAVAAAHAVLDVIAEEQLCQRAEQLGSHLQEVLNQARATCPAIVDVRGRGSMVAVEFNDPQTGEPSPEFTRLVQQKAQENGLLLLSCGVYGNVIRFLYPLTIPDAQFSKALDILARVLKS

SEQ ID NO: 6742 - protein, 554 aa, Vitis vinifera
MASRKLLSSLLRTSVRRPISRSVLSNPRSPLPRPSPVGHLLARAANYASSASAAAPAASTPSAAKGAGPSGKITDEFTGAGAIGQVCQVIGAVVDVRFDEGLPPILTALEVLDNSIRLVLEVAQHLGENMVRTIAMDGTEGLVRGQRVLNTGSPITVPVGRATLGRIINVIGEPIDERGDIKTDHFLPIHREAPSFVDQATEQQILVTGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEVFTGAPGKYVELKESITSFQVSVIFKNDISSLLNNIWFLCALQGNNRRDTYTFFLGS

SEQ ID NO: 6743 - protein, 385 aa, Dechloromonas aromatica RCB
MSLLPSFTPAILALADGTVFKGQSIGADGVTSGEVVFNTAMSGYQEILTDPSYCRQIVTLTYPHIGNTGCNAEDFESNANYAAGLVIRDLPLVASNWRTQDDLSSYLKKHGIVAIAGIDTRKLTRILREKGAQAGCILAGEVDESKALAMARAFPGLNGMDLAKVVSAKEVYPWTEAEWTLKGYKAAAEPRFHVVAYDFGVKRNILRMLAERGCRLTVVPAQTPAADVLAMKPDGVFLSNGPGDPEPCDYAIAAIREFLERGVPTFGICLGHQLLALASGAKTAKMKFGHHGANHPVKDLDSGQVLITSQNHGFAADIDSLPANLRVTHVSLFDGSLQGIARTDVPAFSFQGHPEASPGPHDVAYLFDRFLDTMTRGVAALQPAK

SEQ ID NO: 6744 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 6745 - protein, 455 aa, Mycobacterium sp. JLS
MGTRTGMLAQADLERMVSEREIDTVIVAFTDMQGRLTGKRISARLFVDDVAAHGAECCNYLLAVDVDNNTVCGYAISSWETGYGDMVMTPDFDTLRLLPWLPGTALVMADLSWTDGRPVTQAPRSILNRQIDRLAERDLVPYASTELEFMVFDDSFRAAWAAGYRGLTAATDYNIDYAMLASTRMEPLLRDIRLGMEGAGMYCEGVKGECNLGQQEIGFRYDHARVTCDNHTIYKNGAKEIADQHGKSLTFMAKFDEREGNSCHIHISLRGSDGSTVFADEDAEDGMTPLFRSFIAGQIATMREFSLCYAPNINSYKRFAEGSFAPTAIAWGFDNRTCALRVVGQGAGMRMENRAPGGDVNQYLAVSALIAGGLYGIENELELPDPVKGNAYTSGAERLPTTLSEAAELFDRSEIAREAFGDDVVDHYLNYARVELNAFNAAVTDWERVRGFERL

SEQ ID NO: 6746 - protein, 144 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 6747 - protein, 491 aa, Ralstonia solanacearum GMI1000
MGTVSVEPGSYRAEPPRNPGEVIDLIRQRAVQVVDLRFTDLPGLWQHFSITLPEVNDELFEAGIGFDGSSIRGFQEIHESDMLVRPDPATAFIDPFCETTTLALICDVIDPVLHQPYSRDPRHIAKKAERHLQHSGIATTCYFGPELEFFIFDSIRFGQDQHSGYYHVESAEGEWTSGRDEGAYGGGNLGYKQRYKEGYFPVPPHDTLQDIRSEIVLALMQAGIRVEVHHHEVATAGQNEIDMRFAPLTRMADNVMMYKFICKNVARRHGKVATFMPKPLFADNASGMHCHQSLWKDGENLFYDAGGWALTSQLCRWYIGGLLKHAPALMAFCAPSTNSYKRLVPGYEAPVNLAMSQRNRSAAARIPMYSDAPAARRVEFRCPDPSANAYLAFAAMLMAGLDGIAHQTDPGEPLDRNIYELPPEEAEKIRQVPGSLEESLEALEADSYFLRKGDVFTDDVIRTWIDYKRTREIDTLKLRPHPWEFYLYFDI

SEQ ID NO: 6748 - protein, 225 aa, Clostridium tetani E88
MTKMSISENLHAIKKEIGNNVNLIAVSKTKPIEDIDKAYNLGIRDFGENKVQELVEKIDKFQKEDIRWHLIGHLQRNKVKYIVGKVYLIHSLDSIRLLKEIERKYKDEDKVAKVLIQINIGEDENKYGIKVEELEDMIKACEECSNVKIEGLMTILPMEDSEICKRYFKQMKKIFDDLKNRSFKNIEMKYLSMGMSGDYKIAIEEGSNMIRVGQGIFGKRDYNNL

SEQ ID NO: 6749 - protein, 487 aa, Oceanobacter sp. RED65
MSQPVYQSFVNGEFLGNANGETFDVIYPATGEVIYKVEQADDNVMAKAVESAIAGQKQWAAMTGIERSRILLKAVQLLRERNDELAEFEVKDTGKPWQEAVEVDVVTGADAIEFFAGLAPSIEGNQQDLGGDFYYTRREPLGVCAGIGAWNYPIQIACWKSAPALAAGNSMIFKPSEETPMGAIQLAKIFIEAGVPKGVFNVIQGDYRVGQMLTSHPDIAKVSFTGEVGTGKKVMADSASSLKEVTMELGGKSPLIVFDDADIEQAVSAAMLGNFYTQGEICTNGTRVFVHRSILNEFLEQLAERTKNNIVAGDPMNPETNFGALISEKHHKLVLDYIEKGKAENATLLAGGEAMKIEGFENGYFVAPTIFTDCTDDMTIVKEEIFGPVMSVLVFDDEEEVIKRANDTHLGLAAGVFTQNIQRAHRVIHQIEAGICWINAYGASPAEMPVGGYKQSGIGRENGTITLNHYTQVKSVYMGMNKIESPF

SEQ ID NO: 6750 - protein, 319 aa, Chlamydomonas reinhardtii
MKSEQPQQSLRGWALKLGLTCSAAMVAEGVTYPIDLLKTRLQLQGELAAASSSPKSSGPKPKGAVRLAAELIRREGMRGLYAGLAPALVRHIFYTGTRITVYEQLRRSYVGGLSSGTVGLGAKLLMGLTAGAVGQAVAVPADLVKVRLQAEGRLVASGKIPAPRYKGMGDCLRQIVAQEGGMAGLWRGGGPAVQRAALVNLGELATYDQAKQLVLASGLTGGRDNLGTHTAASMCSGLFASVVSVPADVVKTRMMSQVGDPAAPKYRSSLDCLVRSVRAEGLLALYKGFLPTWARLGPWQLVFWTSYEGTRAAFNLGGF

SEQ ID NO: 6751 - protein, 331 aa, Glycine max
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTFGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 6752 - protein, 127 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 6753 - protein, 255 aa, Burkholderia xenovorans LB400
MIVPSAGPDFGLASRRALVTGGSSGIGLAAAAALGRAGAHVTVAARRRAELEVACEALRATGVACEALVLDVTDSASVDREVNSRVPFDILVNSAGMNRPKPLTDLTDDDIDAVLRLNVKAAFYLARAVSRRLVDANLGGSIINISSQMGHVGSARRSLYCASKHAVEGMTKALAWELGAARIRVNSLCPTFIETPMTAPMFVQPGFREWVCERIALGRVGEMHEIMGPVVFLASDASSLMTGSALMLDGGWTAA

SEQ ID NO: 6754 - protein, 457 aa, Oceanobacter sp. RED65
MQFTDLALAEPIVKAIAEQGYTSPTPIQAQGIPAVLSGRDLLAAAQTGTGKTAGFTLPILQKLLDAPKGVKPNQARVLVLTPTRELAAQVQDNVATYSKYTKIRSEVVFGGVKINPQMQRLRRGVDILVATPGRLLDLHNQNAIHFDQLDTLILDEADRMLDMGFINDIRKIMRLLPKKRQNLMFSATFSDKIRALAKTIVENPVEVSVTPKNTTAKKVRQSIIAVDKKQKINLLIDLLAKEKWHQVLVFSRTKHGANKIAKQLSDADIPAAAIHGNKSQGARTRALADFKSNDIQVLVATDIAARGIDIDQLPHVINFDLPNVAENYVHRIGRTARAGSDGDALSFVSIDEIDLLADIQNFIGEPIERLDYPGFAPSKPLPELKLNLKPKKIKKPKKPKQASTDSKAAPKQKKKPANKSASAKKAKTTANSKPKRQNRKPSDQKKSPIKRPSQSPN

SEQ ID NO: 6755 - protein, 126 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGE

SEQ ID NO: 6756 - protein, 364 aa, Oryza sativa Japonica Group
MMMANAKLPKQALLPPRSPFPTAAAAAGPYAGDHGPIARPQGAPHHRHGHGHGHHQRTSSESFIEEQPSWLDDLLNEPETPVRQHGRAGHRRSSSDSFAMFDGGAAAGAYANGFEGMGGGGGGGQAAPWGGVQEYYAKPSSFGRHQGRPWEQGMNNLVNYRQSGGPPMPAKEKVGGHHGSPSVLRDHDHGMDRRSSDESGHDQKVGPERKEGVPPKHAQSEADTKRAKQQYAQRSRVRKLQYIAELERKVQALQSEGIDVSAEMEFLSQQNIMLDLENKALKQRLESLAQEQLIKRFQQEMFEREIGRLRSLYQQQQQQQKQPQPTTTLSRSNSRDLDSQFANLSLKHKDPNSGPLRTQSSSIL

SEQ ID NO: 6757 - protein, 233 aa, Aeromonas hydrophila
MSQIAEHLLQVKERIVQAASRAGRRGDHIQLLAVSKTKPLEAVCEAYAAGQRRFGESYAQEAATKIDTLREQGTCTDIEWHFIGPLQSNKSKLVAERFDWVQSVDREKLIERLNNQRPAGLAPLNVCLQINISGESSKSGTSEQEIFRLAELVSRCERLRLRGLMAIPEHTSDEAVLAAQMVRMQTLFTELARQYPGVDTLSMGMTEDLELAIGHGSTMVRVGTAIFGARDYS

SEQ ID NO: 6758 - protein, 377 aa, Prionitis lanceolata
VETDDGNFRAMVPSGASTGIYEAHELRDGDPKVFNGKGVLKAIDNVNNELAVAVTDMDPTDQGGIDQALVDCDGSSDSSKSRLGANAILGVSMAVARAGAAKKGIPLYKHINNLAGNPTLMLPVPCFNVINGGSHAGNGLAFQEFMILPTGAETFKEAMRIGVEVYHKLKRTLEESYGKASTAVGDEGGFAPDIHDNEQALKLVQSAVKESGYEGVIQIGLDVAASEFYDKESGRYNLSLKTKVNGAAAGQLRSASELLHTYKLYAANYGVTSIEDPFDQDDFPSFESMTAELGEVIQIVGDDLLATNPNRIETAVERSACNALLLKLNQIGTVTEAIEANNTARDAGFGVMVSHRSGETEDPFIAALCVGLGTGQI

SEQ ID NO: 6759 - protein, 274 aa, Francisella tularensis subsp. tularensis SCHU S4
MKICFIGGGNMAAAMIAGMTSHGYKSQDIIVFDRNEHKCLNLIKKYNINTSTSLLNTIKLADVLILAIKPQNMFELIKNIRDTVTSTQVIVTVAAGIQTSAYEELFNKEISFARTIPNTPSSLGYGATGIFFNKVIAADKKDLVIDIMQTMGVVTVVEDEKEIDIVAAIASSGPAYYFQFMEHMVEAAIKQGLDKKQAEKLVVQTCLGAAQMALNTNENMSELRKNVTSKKGITYEALNIFEQFNLGGIVDKAIQANIARAQQLAIEFTKLIDN

SEQ ID NO: 6760 - protein, 142 aa, Prionitis lanceolata
LTTDLGLFRAAVPSGASTGAYEALELRDGDKSRYNGKGVLKAISNVNELIAPAVAGADVIDQAAFDAIMLELDGTENKAKLGANAILGVSMAACMAGAAAKGIPLYRHISEIAGKGSDPVIMPVPVMNVINGGSHAGNKLAM

SEQ ID NO: 6761 - protein, 293 aa, Francisella tularensis subsp. tularensis SCHU S4
MSSENIIKDFEIFAEKVFDQLNCVSKTLLSAMHYSFFSGGKRIRAQFVYAIGEALAIDKSNCDKIAFAVESIHTYSLIHDDLPAMDNDTLRRGKPTCHIKFNEATAILAGDALQALAFEILQDINYSDIDKLKKINKLFAQYCGASGMVGGQQLDIEGENKKLKIEELQILHTNKTAKMFRACIVLPYILSQNQNSQIEDLLVRLSDLIGLCFQIKDDILDVTKTTNELGKTSAKDIDANKSTYVSLMGLKDANKYLLDKKNEITQIITKLKNNNFSSTSLENLIDLVINRNC

SEQ ID NO: 6762 - protein, 497 aa, Arabidopsis thaliana
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKKELAQLTCECERHIGTQSGGMDQAISIMAKTGFAELIDFNPVRATDVKLPDGGSFVIAHSLAESQKAVTAAKNYNNRVVECRLASDQYLVLSSEWNQKKQYQKLRLFLMWRDYVCHSAGDRGSSDPLLAVKEYLKEEPYTAEEIEKILEEKLPSIVNNDPTSLAVLNAATHFKLHQRAAHVYSEARRVHGFKDTVNSNLSDEEKLKKLGDLMNETHYSCSVLYECSCPELEELVQVCKENGALGARLTGAGWGGCAVALVKEFDVTQFIPAVKEKYHNKRVEKGVVKKEDMELYLFGSKPSSGSAIFNL

SEQ ID NO: 6763 - protein, 517 aa, Candida glabrata CBS 138
MSSSHPRIVTSRAAVLPQQTTAEQRYWRQYAATQLVKEHNSVTHVAFNPQKPHDFAVTSSTRVQVFSSRTRQAIKTFSRFKDVVYSASYRKDGKLLCAGDATGLVSVYDSYNPRTLLVSVAASQHPTHVTKFHDHDLKTLVSASDDRVTRVWDISHAYEPQLELTGAADYVRTLCFVPAAPHLVVTGSYDGALRLYDTRAGSKPQHTLVHDQPVENVVAISPTQLVSCGGPNFKVWDLTSNKKIFERANFNKTVTCLDYVNLPSDSGLASNSALLASSLDGHVKVFDPLDNFQVKFGWKFSSAVLSCAVSPSDAQGSRHLVAGLTSGLLAIRTKKKEKRNSHLAVDDYTAGSTGPKKSNNFQRMMRGSQYQGDLEHIIHDDKVKQQRRLRTFERYINQFKWAEALDCAFVPGMAKELTLTILQELRKRGKIRVALQNRDESSLEPLLNWCLKGIEDVRSVNVVVDWVTVVLEMYGQVAQESPVLNEMVVALRNKVREEVHKAEEAQRIEGMLQLLTN

SEQ ID NO: 6764 - protein, 208 aa, Zea mays
MSAANQLAALVSNMYATGLLDDQFQQLQMLQNASTPDFVSEVVTLFCQDGERIIGELAKLLEKPNVDFDRVDAFVHQLKGSSASIGAQKVKNTCIQFRESCQQKSKDGCLKTLETVKINFYDLRDKFQTMLQTSLFFREKPFYSESCLLYLGGLVDRMYMMSCSVRSMAVPPASEQDGGVELHVGMMRASFKFQNILNKLLNWLLGSL

SEQ ID NO: 6765 - protein, 161 aa, Oryza sativa Japonica Group
MSGKDQKKATTALEEKLELLRDVTKSSAANETSILVDASKYIKELKDKVSQEPEQLGSTSSSMPMPRVSVSSVELEKKIGFRINVSMEKSQPELLTSVLEAFEELGLDVLDADVSCADDTAFRLEALGSSQSEAAETSVDEQMVRHAVLQAIKKCIDGSSI

SEQ ID NO: 6766 - protein, 270 aa, Vitis vinifera
MAENGSLSQFLETAVDAAKRAGEIIRRGFYQTKNVEHKGQVDLVTETDKACEDLIFNHLQQHYPEHKFIGEETTAACGTMELTDSPTWIVDPLDGTTNFVHGFPFVCVSIGLTIGKVPAVGVVYNPILDELFTAIRGKGAFLNGKPIKVSSQTELVKSLLATEVGTKRDKSTVDATTNRINGLLFEVRSLRMSGSCALNLCGIACGRLDLFYELGFGGPWDVAGGALIVEEAGGLVYDPSGKDFDIISQRVAASNPHLKDAFVKVLGQSV

SEQ ID NO: 6767 - protein, 690 aa, Mycobacterium tuberculosis H37Rv
MADSSAIYLAAPESQTGKSTIALGLLHRLTAMVAKVGVFRPITRLSAERDYILELLLAHTSAGLPYERCVGVTYQQLHADRDDAIAEIVDSYHAMADECDAVVVVGSDYTDVTSPTELSVNGRIAVNLGAPVLLTVRAKDRTPDQVASVVEVCLAELDTQRAHTAAVVANRCELSAIPAVTDALRRFTPPSYVVPEEPLLSAPTVAELTQAVNGAVVSGDVALREREVMGVLAAGMTADHVLERLTDGMAVITPGDRSDVVLAVASAHAAEGFPSLSCIVLNGGFQLHPAIAALVSGLRLRLPVIATALGTYDTASAAASARGLVTATSQRKIDTALELMDRHVDVAGLLAQLTIPIPTVTTPQMFTYRLLQQARSDLMRIVLPEGDDDRILKSAGRLLQRGIVDLTILGDEAKVRLRAAELGVDLDGATVIEPCASELHDQFADQYAQLRKAKGITVEHAREIMNDATYFGTMLVHNCHADGMVSGAAHTTAHTVRPALEIIKTVPGISTVSSIFLMCLPDRVLAYGDCAIIPNPTVEQLADIAICSARTAAQFGIEPRVAMLSYSTGDSGKGADVDKVRAATELVRAREPQLPVEGPIQYDAAVEPSVAATKLRDSPVAGRATVLIFPDLNTGNNTYKAVQRSAGAIAIGPVLQGLRKPVNDLSRGALVDDIVNTVAITAIQAQGVHE

SEQ ID NO: 6768 - protein, 448 aa, Burkholderia vietnamiensis G4
MADVVPALVDEVRAFRHAYPEIRYVDLICLDLPGHFYGKRYPIDALEKVATGSLLKLPQNCVLLGTQGGLYKIGDYCFNDGDPDAPRRLIPGTLKPVRWERQPLAQMLISSDGTDAPIEFEPREVLARVLRRFAARGIRPVVAFELEFYLFAAQLADGMPQYPRDRLSDDADDQPNMHIERLSRFSDVLHEMVEAAREQGVDATVITAELGPGQFEINFGHSDDALRAADWSALFCRSTRGVALRHGYRASFMGKPYLHAPGSGMHVHVSLYDEAGRNVLAADDQRPLRHAVAGCLALLPHCMPVFAPNHNAFRRYGSMVNAASRASWGFEDRDACLRIPESDARNLRIEHRLASADANPYLVLAAILTGIEHGLDARLEPIAPLNDDRGSGIDFPKEMLSAVAAMQDHAAVRDGLGSEFVMVYCENKRQEELDFRNEIGAREYRWFL

SEQ ID NO: 6769 - protein, 185 aa, Oryza sativa Indica Group
MAVKYFGHRTPVIVVTKSHMYERGQIHQSLYIVWYIKIIKYTVTSDTVHFPQQQFKVTLHQKFAMSSPHVLVVDDTHVDRHVVSMALMRHNVRVTAVESVMQALMFLDSEHDVDMIVSDYCMPDMTGYNLLMEVKKSPTLAHLPVVIAFSDNIPERIRKCLDGGAKDYILKPVKIVDVPRIMNYI

SEQ ID NO: 6770 - protein, 249 aa, Dechloromonas aromatica RCB
MRKKLVAGNWKMHGSLQQNAALLELIKAGVSSLPCEVAVCPPYPYLGQVQSILSGSALAWGAQSVSEHQSGAFTGEVAASMLLEFGCRYVLVGHSERRALYGETDTVVSAKFEAVQRAGLVPVLCVGETLAERESGMTSVVVARQLSAVLGRVGVAAMASAVVAYEPVWAIGTGVTASPAQAQEVHAAIRAKVAELDLGVANGLRILYGGSVKPQNAMELFGQDDIDGGLIGGAALVADDFLAICRAAN

SEQ ID NO: 6771 - protein, 214 aa, Zea mays
  misc_feature (159)..(159): Xaa can be any naturally occurring amino acid
MSGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGGKDDKIIAVCADDPEYRHFKDISEXPPHRLQEIRRFFEDYKKNENKEVAVNDFLPAEDAIKAIKYSMDLYGSYVMESLRR

SEQ ID NO: 6772 - protein, 167 aa, Oryza sativa Indica Group
MGEKTEYRDRLVENAFMGLFARKIKKYAIISSSGGKEKKKSSSRSSSCRHVGQLGLRVQRRPHRSLFPLARRSIRVTAVESVMQALMFLDSEHDVNMIVSDYCMPDMTGYDLLMEVKKSPKLAHLPVVIASSDNIPERIRKCLDGGAKDYILKPVKIVDLPRILNYI

SEQ ID NO: 6773 - protein, 205 aa, Ralstonia eutropha JMP134
MRCAGAWRNLHFKISMADSLIQSPDLGDVTGYLRDRIRTVPDWPMPGVQFRDITPLLQNPKTLRVLIDVFVHRYMDAQLDLVAGIDARGFILGAIVAYELNLGFVPIRKKGKLPFQTVAEEYELEYGSATVEIHADACKPGDRVLLIDDLIATGGTMMAGRKLLERLGATVVEGAAIVDLPELGGSKLLQNAGLPLFTVCRFDGH

SEQ ID NO: 6774 - protein, 488 aa, Ralstonia solanacearum GMI1000
MIQNFINGAYREGRAGKRFRDLDPCTGRLVAEVSEAGKEDVDDAVQAARAALNGPWGKLTLAQRCDLLYAVADEIDRRKEDFLAAEVADTGKPRALASHLDIPRGAANFRVFADAVRNVATECFTGTAPDGKPSLNYALRRPKGVIAVVCPWNLPLLLMTWKVGPALACGNTVVVKPSEETPATAALLGEVMNAVGVPAGVYNVVHGFGPDSAGEFLTRHPDVDAITFTGETRTGAAIIKASADGIKPVSMELGGKNPALVFADADLDAVIAGLKRSVFENTGQVCLGTERVYVERPMFDKVVRALAEIAGTLRPGLPGDPHANFGPLISGEHQRKVLGYYALARDEGATVHYGGGVPDMPPDLREGAWIEPTVWTGLPRDSRVLTEEIFGPCCHVEPFDSEEEAVRLANGTPYGLATSLYTGDVNRAHRVSAKLKVGVVWVNTWFLRDLRTAFGGSGKSGIGREGGVHSLEFYTELSNVCLKLEPQA

SEQ ID NO: 6775 - protein, 483 aa, Rhodococcus sp. RHA1
MTENVLLPGAESPGDTAEGTSVPVRIAVVAALGGLLFGYDSAVINGAVSAIEGKFQVDSALLGFAIASALLGAAAGAMLAGRIADRYGRLVTMRAAAVMFLLSAIGTGFAANVEMLVTFRIVGGIGVGLASVIAPAYIAEISPARVRGRLGSLQQLAIVTGIFVSLLVDYALAAIAGGSQEELWFGLEAWRWMFLAMCVPALAYGLLSLTIPESPRYLIAQGRLGEARGILAVLLGEKGLDLKIESIRSTLARETQPSIRDLKGSAFGLMPIVWIGIGLSVFQQFVGINVIFYYSSVLWQAVGFDEGSSLQITVITSVVNIATTLIAIAYIDRVGRRPLLIIGSAGMAVTLATMAFIFGTASTTVVDGVTTPQLTGLQGPIALVAANLFVVAFGMSWGPVVWVLLGEAFPNRIRAAALSLAAGAQWAANWLITVTFPSMKDFSLGISYGFYAVCAVLSLVFVLRWVKETKGVELEAMHSDSVA

SEQ ID NO: 6776 - protein, 454 aa, Streptomyces parvulus
MEKTDVDRLRTLDREHMWYPWTPMTEWMARDQLVVERAEGCWLIDADGKRYLDGRSSMGMNLHGHGRSEIVEALVAQARKAGETTLYRVSHPAAVELAARLASMAPAGLQRVFFAESGSTAVETALKAAYAYWVAKGEPQRSTFVSMEGGYHGETLGTVSLRGTNGEQVDMIRKTYEPLLFPSLSFHQPHCYRCPVGQSSDSDCGLECTDSLENLLTREKGRIAAVIVEPRVQALAGVITAPEGHLAKVAEITRRHGVLLIVDEVLTGWARTGPTFSCEAEGVTPDLMTVGKALTGGYLPLSATLATEEIFGAFRESVFLSGSTYSGYALGAAVALASLDLFEKEDVPARAKALADVLTTALEPFRALTHVGDVRQLGLIAGVELVADRETRAPYPPQERVVDRICTLARDNGVLVNAVPGDVITMLPSPSMSPDDLRFLTGTLYTAVREVTEE

SEQ ID NO: 6777 - protein, 102 aa, Acidovorax sp. JS42
MNNRLYVGNLAYSVRDESLHQQFSQFGSVTSAKVMMERDTGRSKGFGFVEMGSDSEAQDAINGLNGRSVDGRALTVNVARPMEARPSFGGGADRGGYRGGRY

SEQ ID NO: 6778 - protein, 330 aa, Streptomyces parvulus
MKGLMRAAVIRAWGGPERLTLDRVERPSPPPGWIAVRVEACALNHLDIHVRNGLPGVRLELPHVSGGDVVGVVEQATDEAGERLLGSRVLLDPMIGRGILGEHYWGGLAEYVVAPAHNALPVPDQDADPARYAALPISYGTAQRMLFSRARLRPGESVLLFGATGGVGVACAQLALRAGARIIACSGSPAKLARLRRLGVIDTIDTGTEDVRRRVRELTDGGADLVVDYQGKDTWPVSLRSARAGGRIVTCGATTGYEATTDLRYVWSRQLDILGSNAWHRDDLHTLVDLVATDALEPVVHADFPLSRAPEAVAELEERRAFGKVVIRTA

SEQ ID NO: 6779 - protein, 424 aa, Fusarium proliferatum
IRQNGTMEMDGVNGVTQCPIAPEDTFTYEFRALQYGSSWYHSHYSLQYADGLAGPITIFGPSSAHYDEAKDPILITDWNHRSAFQEWERELTGVPTRPEMNSILMNGIGNFAGSFPRERYNITVTKGKKYLLRIINTSVDTTFVFGIDNHYFEVMSSDFVPIHPYTVDHILVGIGQRYHVVLHAKPRNDTKFPASDNGNYWIRTVAADGCKGFEDGNEPDERQGILRYQPVSTEVPQTWRDNWTKDCTDEKYENLKPILPWSIPTVKLDERDRSKDLELGIEKVKDRPHAGDRFSWWAFGERPLWLDFSNPTITLLEERKEWPDDYVIVPAENRDGWVYLVITAPSLDRIGTNKTFRSLAHPLHLHGHDFALLAQGTNSSQINDPNNPVTLKFDNPPRRDVALIPAGGYLIVAFKADNPGSWLF

SEQ ID NO: 6780 - protein, 335 aa, Azoarcus sp. EbN1
MKVLITGAAGFIGMHVCQVLLARGDEVVGLDNLNDYYDPRLKEDRLARLAPHPRFRFIKLDVADRDAMERLFAAERFERVVHLAAQAGVRYSLQNPHAYVDSNLVGFMNVLEGCRHGGVRHLVYASSSSVYGGNTKMPFSEHDSVDHPVSIYAATKKANELMAHTYSHLYGLPTTGLRFFTVYGPWGRPDMALFLFTRAILEGRPIDVFNHGRMMRDFTYIDDIVEGVVRTLDRVAEPDPGFDALQPDPARSNAPYRVFNIGNHDPVELMAFIEAIEDAIGRKAEKNFLPLQDGDVPATYADTAELNAWTGFKPGTSVRDGVGQFVAWYRDYYRS

SEQ ID NO: 6781 - protein, 437 aa, Fusarium proliferatum
VSIHWHGIRQNGTMEMDGVNGVTQCPIAPEDTFTYEFRALQYGSSWYHSHYSLQYADGLAGPITIFGPSSAHYDEAKDPILITDWNHRSAFQEWERELTGVPTRPEMNSILMNGIGNFAGSFPRERYNITVTKGKKYLLRIINTSVDTTFVFGIDNHYFEVMSSDFVPIHPYTVDHILVGIGQRYHVVLHAKPRNDTKFPASDNGNYWIRTVAADGCKGFEDGNEPDERQGILRYQPVSTEVPQTWRDNWTKDCTDEKYENLKPILPWSIPTVKLDERDRSKDLELGIEKVKDRPHAGDRFSWWAFGERPLWLDFSNPTITLLEERKEWPDDYVIVPAENRDGWVYLVITAPSLDRIGTNKTFRSLAHPLHLHGHDFALLAQGTNSSQINDPNNPVTLKFDNPPRRDVALIPAGGYLIVAFKADNPGSWLFHCHIAS

SEQ ID NO: 6782 - protein, 1033 aa, Burkholderia xenovorans LB400
MSRVLIANRGEVAVRIVRAAKSVGLQTVGIHTPEEANALHVRDSDIAVALAGVGTAAYLDIASIIAAAVRTNCSFIHPGYGFLSESAAFARACEQAGVTFIGPSPDTLDVFGDKASTRELAIRLDVPVLPATAGLADDASALSFMQSLAAPVIVKAVAGGGGRGMRIVTDPTDLPAALSRCRSEAERGFGRDDVYVERYLPRSRHIEVQVIGDGSSVVHLGTRDCSLQSRHQKVIEIAPAPWLPVEIEEALLEHALQLARAVQYRGAGTMEFLIDVDNPSHYYFIEGNPRLQVEHGITELVTGLDIVALQFAIARGRSLADEGITQDNVVTSGVAVEARVTLTTPGTIARFVSPGKGRVDSGAYDGLAVGSGFDPLLAKVMVHEPDYPRCICALADSLGELVVEGPATNRDGLLSLLADPRVRAGDITTTLIDDLPAASATALVSKVAGSVIAVLARPGEPLRRGQPIVVVEAMKMEHEVVAPAAGRLEEMLVAVGQQITTGQRVASMGYSGAEAEHDAAPGEPAARADLAENLRRHSITLDEARPEAVASRHARHKRTARENVADLVDPGSFVEYGALVIAAQRRRRTVEDLELNTPADGLVAGFGTVNGQQIAVLAYDYSVLAGTQGVQSHKKAERLFELARRRHAPVVIFAEGGGGRPGDIDNAAKATGMDLGTFVALGRLNGRVPTVAIASGRCFAGNAALVGACDLVIATADANIGMGGPAMIEGGGLGRVESRDIGPAARQFENGVVDVLVADEAEATASAKKYLSYFHAAKRNWTAGEQQHLRTIVPEARSRPFDVLRVIQVLSDDDAVLELRAGFGRGIITCLVRIEGVAIGIVANNGLHLGGAIDSDSADKMARFLALCDTYSLPIVSLCDTPGFMVGPASEETAAVRHFGRLLVAGPNLSVPLCTVVIRKAWGLGGQAMAGGGFRVPDAIVAWPTAEFGAMGPEGAVRLGFRRELEAIADPVARDAEFDRLVKDYVRDGRGYNAASAFEIDDVIDPADTRRWILATVNRAEPIPPTRRHLDTW

SEQ ID NO: 6783 - protein, 478 aa, Clostridium tetani E88
MEQAISFQSILIISLLAFVTPIIVSSFKRVKIPYVVGEILVGIVVGKSLFNIVQDDIWIIFLSNLGLAYLMFLSGLEVEVEDLKISDGNNKGFKNLILCFSMFLISLVISFLISKFLVSINLIRNVTFFTFLFASSAPGFIVPFLKERDLLNTEYGQIILIFNLIAEFICLIGITIISSTATRGFSYKNFLFIIVILVSFLLYIITRKLFKHFDFSIAAFRNLHIEVRAAFALILLLVTLSQVVHSEIVLGSFLAGLIFSFLFQREREDLKYKLDIIGYGFLIPIFFIGVGVNLDISSMFQNPKTLFMIPVLLLIFYLVKLIPSLLLSKYFGIKKAISSSFILSTQLSLIIVGSQIAYSLDLIDSSTYSLFIITTIISCLLFPVIFDRSFNYDDIERKKKPLIDKVCIRETVVTNEEVFNKPLKEIPFPKNCIVFLLIRDELEIVPSGNTILLEGDILILAGMHEHEEEMLRVVNIYS

SEQ ID NO: 6784 - protein, 258 aa, Oryza sativa Japonica Group
MAAATVSVRFHPAASAARSAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 6785 - protein, 403 aa, Oryza sativa Indica Group
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQEIQTPETKICPRNCVDYLPSYINNKIICSTQDLGGISVDHSSAVIYLFLFITLPYQQSYPQKQQQAQPQQPKQSLPQQQQKQSLPQQQQQQMPHEKPTTLRRAASAAARTAGIMQQSEDTKIAYSNPKTRRLLPTKSAPTASTRSTVAATKPVEDLKSSGMKLATEEAPSPSSNVAMPGSEPSALPLPKSAEDDMSIDEVDIPIEDMDEPVATPEETPMEEAIRVTRGRLRKRIAAVSTADGGAAN

SEQ ID NO: 6786 - protein, 347 aa, Rhodomonas salina
CELRDGDDKRYLGKGVLKAVENVKSVIAPALAGMNPVEQDAVDNKMIQELDGTPNKTKLGANAILAVSLACCKAGAAQKGVPLYKHIADLAGTKKICLPVPWMNVINGGSHAGNRLAMQEFMIGPVGAKTFKEAMQMGCEVYHTLKKVIKKKYGQDACNVGDEGGFAPNIQANDEGLKLLTEAIEMAGFTGKIKIGMDVAASEFCKDKKYDLDFKNDASKPEDYLSPDALTDMYKGFCKDFPVVTIEDPFDQDDWEAYTKMTGEMECQIVGDDLLVTNPTRITTALEKKACNALLLKVNQIGSVSESIKAAKMSMDSNWGVMCSHRSGETEDCFIADLVVGLGTGQI

SEQ ID NO: 6787 - protein, 192 aa, Zea mays
MGASLGSAASKDRQQEHGGEAPRPDPCKKTRLSSPLCTIHGSHGHPRLIPGLPDEVSLQILARMPRMGYLKAKMVSRSWKAAVTGAELYRLRKELGVAEEWLYILTKAAAGGQKLVWHALDPVSNQWQRLPLMPGIECRSGGVYGLGLRDLVSVGVGIFDVIRGWLGQKELSGGVPPFCGCAVGAAGGCLYV

SEQ ID NO: 6788 - protein, 360 aa, Gibberella zeae PH-1
MFDLFPMLLSSVASFLFPIFASYKALKTSDPTQLTPWLMYWVVLSCCLLVESWVWFIISWIPFYGYFRLMFLLYLILPQTQGAAFLYDEYVHPYLEKNETQIDDFIASAHERLTAAGISYLKLAIEQFRVKVLGLPPSEPEAPPPETNQGYTQSLLSRFNVPAARWAGNNNNNNGGTGTDFYSLLSSAVAAATNAGAAQSAGTRTVGGEPTNPGALIPPHLRESGARMDFISTQRDRLNVLLSALDREAQDLRSDAQRAQANTGPQRDPMAYGGYDNTRNDDEEPTQRPPSGLSGWSGISKSRSETDFERIDADVSSDEDHKMRRRNMGAGTRNTSGSWVPWSWGGDAAQGGASASGRER

SEQ ID NO: 6789 - protein, 517 aa, Magnaporthe grisea 70-15
MVHLTSIPSHEEADDKIVSGVKKVHLQLANDEDKFTTSVYGSRFAIDDLPKHEMAENEMPKEVAYRMIKDELSLDGNPMLNLASFVTTYMEEEAEKLMADSFSKNFIDYEEYPQSADIQNRCVAMIGRLFNAPVGASEGVGAVGTSCVGSSEAIMLAVLAMKKRWKNKRLAEGKSVDKPNLIMSSAVQVCWEKATRYFEVEEKLVYCSPDRYVIDPKETVDLVDENTIGICVILGTTYTGEYEDVRAVNDLLNERGLETPIHVDAASGGFVAPFVVPDLEWDFRCDRVVSINVSGHKYGLVYPGVGWVVWRSAEFLPQELVFNINYLGADQASFTLNFSKGASQVIGQYYQLIRLGKHGYRAIMSNLTRTADYLSDSLEALGFGIMSKKSGEGLPLVAFRLTPDEDRIYDEFAIAHQLRVRGWVVPAYTMAPHTENLKMLRVVVREDFTRNRCDALIADVKLSLELLNQMDKKELERHQDVIHKHGTHSGKASHNHPRFRKEKHSLQGKHGKTHAVC

SEQ ID NO: 6790 - protein, 304 aa, Brucella melitensis 16M
MGADPVYGLPGFGDHEGRTPFKRLQVSDIVAIRTPVRITPDRKAFWRKYMSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 6791 - protein, 347 aa, Guillardia theta
CELRDGDKSRYLGKGVSKAVKNVEEKIAPAIKGMDPTDQEGIDKKMIEVDGTPNKTNLGANAILAVSLAVAKAGAAQKGVPLYQHFADMAGVKKYVLPVPWMNVINGGSHAGNRLAMQEFMIGATGATSFKEAVRMSCEVYHALKAVIKKKYGMDACNVGDEGGFAPNIQDNKEGLSLLTEAIANAGYTGKIKIGMDVAASEFYQDGKYNLDFKNANADPSMVVSGDELIEVYKSFTQDFPVVTIEDPFDQDDWEHYNKFNSQMPHTQIVGDDLLVTNPNRITMAIEKKACSGLLLKVNQIGTVSESIKACKMSQEQGWGVMRSHRSGETEDTTIADLVVGLATGQI

SEQ ID NO: 6792 - protein, 468 aa, Arabidopsis thaliana
MPRVIPPENLGCPPFRALTFDSLGLIKVTEARGQERGIPTVVNTWGEMNASRSVLAASIDDRLRNPLLAVARKDGNVEVINPCNGDLHFSYSVFGDDGCSPEDNEISALHLFRKKIDDQTERSCTLLTCTKKGDVSLRSVKFPDAHGNSTDDASPKTWKACGSGEILVGKVDGSENFSLFGGKRVEANIWDLEQCTKIWSAKCPPKNNLGIFTPTWFTSATFLSKDDHRKFVTGTKSHQVRLYDISTQRRPVLSFDFRETAITSIAEDPDGHTIYVGNASADLASFDIRTGKLLGSFLGKCSGSIRSVVRHPQHQVIASCGLDRYLRVYDVKTRQLISAVFLKQHLTGLVFDSGFSGEETAVANTVAEAATEEKMTIMDQEDDETEKAPVKRKKSKKEKRSREIVFEGEDDEENEDEIEKAPVKTKKSKKEKRSREKVSEGEEKDELRSKKTREHKKKTKIVKHNQED

SEQ ID NO: 6793 - protein, 476 aa, Pseudomonas putida KT2440
MNSPSALPPVQFDLDLATTFAAQRLAFAGNPLPPAAQRRQWLKSLREALLSSQAELIEAISQDFAGRSADETLLAELLPSVQGLRHAEKHLQRWMRSRRRRVGLAFQPASAQVRYQPLGVVGVIVPWNYPLFLAIGPLTCALAAGNRVMLKLSEATPATGLALQQLLERVFPTDLVSVVLGEVEVGQAFARLPFDHLLFTGATSVGRQVMQAAAHNLTPVTLELGGKSPAIVSDDVPLDSAAERIAFGKTLNAGQTCVAPDYVLVPRERLPAFSDAYQRAVHRLYPRIADNPDYTAIINPRQLQRLQHLLDDARAKGAQVLDLYPGEAPQGRRLPPHLLLDVNDSMQVMQDEIFGPLLPLVPYDGIDQALAYINQRPHPLALYFFGYDRRTQEHVLRHTHSGGVCLNDTLLHVAQDDLPFGGIGPSGMGHYHGHDGFLTFSKAKAVLAKQRFNAARLIYPPYGKALQRLVYKLFIR

SEQ ID NO: 6794 - protein, 570 aa, Vitis vinifera
  misc_feature (283)..(283): Xaa can be any naturally occurring amino acid
  misc_feature (541)..(541): Xaa can be any naturally occurring amino acid
MNGGSLGMRSGSYGSLLQQQQQQQQLQNGGLLPVQATPLPPPLPGYSLGRKPPKMVKEKERFVHWICKFAGRKKVGMLLLCVVSAAVFVWVLYVGKGEDAREVDSVGKLGANGSPAFVYTKSFSTRSLDLYRMNNSSFVRSESVAQPPPPPPPPPAPVFLGYNLPPGHPCENFALPPPPADKKRTGPRHLQIAEFLLPYVSACPVCYLPVEEAIALMPKYPSPSPLLNNLTFVYEENLTKGDSFGGSDFGGYPSLEQRANSYDIRESMTVHCGFVRGAKPGQXTGFBMDDSDLFEMEQCHGVVVASAIFGNYDVIQQPKNISDAAKENVCFYMFVDEETEAHLKNSSGLDDNKRVGLWRIVVVHNLPYNDARRNGKVPKLLLHRMFPNARYSLWIDGKLELVVDPFQILERFLWRKNASFAISRHYRRFDVFVEAEANKAAAKYDNASIDFQVEFYKSEGLTPYSEAKLPITSDVPEGCVIVREHIPISNLFTCLWFNEVDRFTSRDQISFSTVRDKIRAKTNWTVNMFLDCERRNFVVQXSLAVLAQSLPRVEALASLGEPPLDYKLSY

SEQ ID NO: 6795 - protein, 513 aa, Haemophilus influenzae R2866
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAMLLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRAANDNERLYTFEFPEQKGALLKFLETLQNRWNISLFHYRAHGADYGNILAGFQIEEHEQAEFEQTLAQLNYVFEDVTESKSYRYFLR

SEQ ID NO: 6796 - protein, 556 aa, Streptomyces parvulus
MTGNTTSAAFLRRTQNALAMQRKICAQPEETAERVFSDILSVSRDTGFGREHGLAGVRTRQEWRRAVPIRTYDELAPYVERQFSGERRVLTTDDPRAFLRTSGSTGRAKLVPTTDHWRRVYRGPALYAQWGLYFEQIGTHRLTGDEVLDLSWEPGPIRHRLRGFPVYSITERPVSDDPDDWNPPWRHARWFTRDAGAATMADLLYGKLLRLAAHDLRLIVSVNPSKIVLLAETLKENAERLIQDLHDGHGTDRAARPDFLRRLTAAFDRTGGRPLLTDLWPGLRLLVCWNSASAALYGPWLSRLATGVAALPFSTTGTEGIVTLPVDDHLSAGPLAVDQGHFEFVPWQDLDDGSPLPEDTPTLGYDELELGADYRLVMSQANGLYRYDVGDVYRVVGAVGATPRLEFLGRAGFQSSFTGEKLTESDVHTAVMRVLGSERTDHPHFSGIPVWDTPPHYLVAIEWADAHGTLNVQDTARRIDATLQEVNVEYADKRRSGRLRPLQILPLVPGAFGQIAERRFRQGTAGAQIKHHWLQKDSAFLDTLRDLDLVRARPGT

SEQ ID NO: 6797 - protein, 492 aa, Rhodococcus sp. RHA1
MSPATTVEPCDFVVFGGTGDLAVRKLLPALYLRDRDGQLPAETRVIGASRAGLDTDGYRDKVRGELARFVSGDQLDSDTCERFLNRLEYVSVDAGDPENWAGLSECLAAREGAIRVFYLACAPGLFGPICDNLALNGLADAQSRVVLEKPIGHDLASARAVNDAVGAVFEESQIFRIDHYLGKESVQNLLVTRFANTFLEPLWNSSSIDHVQINVAESLGVGSRGGYYESAGALRDMLQNHLLQMLCLVAMEPPTYVDRETVRDEKLKVLQALKPMSPQDVERCTVAGQYGPGLADGIAVPGYQEDVENPASTTETFIAVKAEIQNWRWAGVPFYLRTGKRMDRRCSEIVVQFKPVPHPMFPGSEGHSEPNRLVIQLQPHEGMRLHMTAKEPGPGGIRLKPVSLDLNYIETFKRPSPDAYERLLMDVVRGNPTLFMRRDEVEAAWEWVEQILVGWEKSERAPRRYPAGTNGPTDATTLIERDGRAWHEGVTA

SEQ ID NO: 6798 - protein, 172 aa, Triticum aestivum
  misc_feature (89)..(89): Xaa can be any naturally occurring amino acid
MANPRVFFDMTVGGAPAGRIVMELYANEVPKTAENFRALCTGEKGVGKSGKPLHYKGSTFHRVIPEFMCQGGDFTRGNGTGGESIYGEXFPDEKFVRKHTAPGVLSMANAGPNTNGSQFFICTVATPWLDGKHVVFGQVVEGMDVVKAIEKVGTRNGSTSKEVKIADCGQLS

SEQ ID NO: 6799 - protein, 457 aa, Shigella flexneri 2a str. 301
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 6800 - protein, 626 aa, Shigella flexneri 2a str. 301
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEATPAATPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAKAEGKSEFAENDSYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 6801 - protein, 410 aa, Pyrococcus abyssi GE5
MFRLGDFNYHNKVVFLRVDLNSPMKDGKIISDARFRAVLPTIKYLLENGARVVVGTHQGKPYSEDYATTEEHARILSNLLNQHVEYVEDIFGRYAREKIQELKPGEIAMLENLRFSAEEVKNKPIEECEKTFFVKKLSKVIDYVVNDAFAAAHRSQPSLVGFARIKPMIMGFLMEREIEALMKAYYSKESPRVYVLGGAKVDDSLKVAENVLRRGFADVILTGGLVANVFTLAKGFDLGRKNIEFMKKKGLLELVKHAEKILDEFYPYVRTPVDFAIDYKGDREEIYLLSEKRELLNDYQIMDIGSRTIEKYRDIIMKAKVVVANGPMGVFEREEFALGTVEVFKAIAESEAFSVLGGGHSIASIQKYGIEGITHISTGGGAMLTFFAGEELPVLRALQISYEKFKEVKA

SEQ ID NO: 6802 - protein, 401 aa, Glycine max
MDYFNAPGRNHLFVPGPVNIPDQIIRAMNRNNEDYRSPAIPAMTKTLLEDVKKIFKTTTGTPFLIPTTGTGAWESALTNTLSPGDRIVSFLIGQFSLLWIDQQQRLKFNVDVVESEWGHGAKLDVLESKIASDTSHTIKAICIVHNETATGVTNDLAKVRQILDSYQHPALLIVDGVSSICALDFRMDEWGVDVAITGSQKALSLPTGIGIVVAGPRAIEASKHAKSLRVFFDWKDYLKFYQLGTYWPYTPSIHLLYGLRAALNLIFEEGLENVIARHSRLGKATRLAVEAWGLKNCTQKEEWYSDTVTAVLVPAYIDSTEIVRRAWKRYNLSLGLGLNKVAGKVFRIGHLGNLNELQLLGCLAGVEMILKDVGYPVKLGSGVAAASAYLQDTIPMIPSRI

SEQ ID NO: 6803 - protein, 388 aa, Oceanobacter sp. RED65
MNLHEYQAKQLFAAYGLPVSEGVVATTAQEAEQAADKIPGDKWVVKAQVHAGGRGKAGGVKLVSSKQEIADFAQSWLGKNLVTYQTDENGQPVNQILVESCTDIDQELYLGAVVDRGTRRVVFMASTEGGVEIEKVAEETPEKILKAEIDPLTGAQPYQAREIAFKLGLKDKQIKQFTQIFLGLSKLFFDKDLALLEVNPLVITKDGDLHCLDAKINVDSNALYAHKDIQAMHDPSQEDGREAEAAKWDLNYVALDGNIGCMVNGAGLAMGTMDIIKLSGGDPANFLDVGGGATKERVAEAFKIILSDDNVKAVLVNIFGGIVRCDMIAEGIIGAVKEVGVKVPVVVRLEGNNAELGSKVLAESGLDIIAAESLTDAAQQVVKAAGGK

SEQ ID NO: 6804 - protein, 394 aa, Pyrococcus abyssi GE5
MVLRCIRCGREYPEDEIRYRCECGGLLEVVVDLDKVDTKIFDGNNITLWKYESWLPVKKIVSLNEGGTPLYRLNNLEKILGVKELYAKNEGANPTGSFKDRGMTVGVSKALELGMKRVACASTGNTSASLAAYAAKAGIEAYVLVPSGKIALGKLAQAIIYGAKVIPIKGNFDDALRVVIEASEELGIYMLNSINPFRLEGQKTIAYEIYDQLQKVPDNVVLPVGNAGNISAIWKGFKELYEAGVIDKLPRMIGIQAEGASPLAKAWKEKRKFKPEKNPETLATAIRIGNPANWEKAWRAVEESGGMFEIVSDEEILKAQRILASKEGLFVEPASAASLAGLIKLLNEEKVDRDESFVLVTTGHGLKDPDIVLRNFKLPEPIEPTLDAFRRVIE

SEQ ID NO: 6805 - protein, 81 aa, Glycine max
  misc_feature (20)..(20): Xaa can be any naturally occurring amino acid
  misc_feature (23)..(23): Xaa can be any naturally occurring amino acid
  misc_feature (51)..(51): Xaa can be any naturally occurring amino acid
TAKNTAPAETTDNRAGAGRXAPXTGRKAKAGHPTRKTNNDSTTRASNGGRXQGMHFLPPVGKKKGETLSYPPDLDDAQLSK

SEQ ID NO: 6806 - protein, 352 aa, Pyrococcus abyssi GE5
MVYKLLVVKFGGSSVRYAFEEALELVKYLSERIPIVVVVSALKGVTDELIRFANGDKGALPRIERIHEEFLNYHGLNTKISISFRKDMPPEALRDEIISLGERISAKIFAEGLELLGIKSKVVDPLEFLIAKGEFGDAYINIQESKRRAGKLIRLIKSGVIPVIPGFYGNLNGFRVTFGRGGSDYSATALARILDSRCVLIMSDVEGIFTADPKLVPSARLIPYLSYEEIKVAAKLGMKALHWKAVDPVVGDIPIIFGKTKDWKFGTIVLNARSNFPIIVHRVREDFAEIFVVGRNISLPGFLVEEEREDFVKIVVAREDLPEAIREIHREVVEREEKNLRTGNNSELWARI

SEQ ID NO: 6807 - protein, 368 aa, Pyrococcus abyssi GE5
MRKMIVLKFGGSSVKNDFHEAVSLTKSIFEEKEVAVVVSALKGITDMLIKYAKTFDSKYAIKIADSYVKFARTNGVDPNILSPHIQELFNPPSLPKDALTDYILSIGELLSAVIFAEVVEGQVIYPWELFSAYGKFGDGFIDLKKSKKNAKIIYEVIDSGKIPIVPGFVGGMDGYRVTLGRGGSDYSAVALGVILNSELVAIMSNVEGIFTADPKLVPSARLIPYLSYEEALIAAKHGMKAIQWKAAELAKEKKILMLFGRTNNWRMGTVISNRTSRMPLMTYKDGLLLINVEEELEYRVIDEGPFWKLYDVPGNEGIRIIRELHKAIFGNVLSMLQEPGKHIRINRHKVGKSFEHMTFNQSFSRKFY

SEQ ID NO: 6808 - protein, 514 aa, Burkholderia xenovorans LB400
MTHETSELPSLARGSQPATIPDSRLPEPFCESARSLLKARAGFLLAWLCFIVIAWVLPTPQGLTHQGRATLAVVAWVAIVWISEAIPVGISGILLPMLLVLSHAVTPFPKAASGFAAPVVFLCLAAFLFSAIMQAAGLDRRIALVLLDKLKVRSANGVIWAMFIVNFVMSLVVPAANARAAALLPVTNGIIGLFGNSARERDARKAIVIQTLVYGSMISGMCILTAHLPNMVVSGLLEKQLGLRISYFSWLRLQWPYLGMFVLTQFWVQRYFKSRGVPVPGGRQAIIEERRKLPPVARQDLTVLLVFAFVGAMWATESLHHLQSEIVALIALALMFAPGVMRFGWKDIQERTIWGTLFLLGGALSLSSAISDSGLAQWAADHIYAVAHGYVWWMTLAIVMIGTHVIRIGMLSNVAAVTMIAPIALALAPRLGLHPVAFTMLISDTDSFAYLLPTQITAGVIAYSSGQFTTADYAKVGIVSVLIAIVYGICVMAPWYAYQGIPLWNPTAPWPFAH

SEQ ID NO: 6809 - protein, 725 aa, Myxococcus xanthus DK 1622
MSEQNTIRWDKDADGIVVLTLDDPNQSANTMNAAYLKSMRATVDRLVKEKDTVAGVILTSAKKTFFAGGDLKDLLKVRKEDAKQAFELGQEIKAQLRTLETLGKPVVAAINGAALGGGLEIALACHHRIIADVKGAQVGLPEVTLGLLPGGGGVVRTVRMLGIVDALMKVLLQGQRYRPQEAKEAGLVHEVVDSVEALLPAAKAWVKAHPTAQQPWDQKGYKIPGGTPSSPGLAANLPAFPANLRKQLKGANMPAPRAIMATAVESTQVDVDTAFTVESRYFTELVTGQVAKNMIQAFFFDMQHINSGGGRPKGYPQHTAKKVGVLGAGMMGAGIAYVCAKAGIDVVLKDVSLASAEKGKQYSVKLVEKAIQKGKSTKEKGDALLARIHPTTDAADLKGCDLVIEAVFEDVKLKHQVFQEVQDVVAPDAVLGSNTSTLPISVLAEGVKRTEDFVGMHFFSPVDKMPLLELIAGKKTSDATLAKAIDIAVQIGKTPIVVNDSRGFFTSRVIGTFLNEAIAMVGEGISPASVEQAGLQAGYPAAPLQLVDELTLTLPRKIRQETKAAILAEGKPWVEHRSYAVMDAMIDQHQRKGRSTGGGFYDYVDGKRTGLWAGLAQHFTKPGHTIPFEDMKERMLFAEAVDTVRCFDEGVLRSAADANIGSILGIGFPAWTGGVAQFINGYEGRTGNGPRGFIARARELAQRYGAHFEPPASLVEMAERGEFLK

SEQ ID NO: 6810 - protein, 145 aa, Myxococcus xanthus DK 1622
MAIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 6811 - protein, 372 aa, Candida glabrata CBS 138
MFTRVAAAARIQSRRPLRLRLQSTLSIPQSQKGVIFYEHGGKLEYKDLPVPKPKPNEILINVRYSGVCHTDLHAWHGDWPLGAKLPLVGGHEGAGVVVAKGSSVTNFEIGDYAGIKWLNGSCMSCEFCEQGNESNCAKADLSGYTHDGSFQQYATADAIQAAQIPKGTDLAQVAPILCAGVTVYKALKDSDVKPGQWVAISGAAGGLGSLAVQYAKAMGMRVLGIDAGDEKRKLFESLGGNHFVDFTKTKDLVSEIQEITEGGPHGVINVSVSEKAIGQSVEYVRPCGTVVLVGLPAGATVKSDVFNHVIKSINIKGSYVGNRADTREAIDFFAKGQVKSPIKVVGLSELPEVYKLMEANKIIGRYVVDTSR

SEQ ID NO: 6812 - protein, 347 aa, Pedinomonas minor
LELRDGDKTHYMGKSVEKAVDNINKLISPALVGMNPVNQREIDNAMMKLDGTDNKGKLGANAILAVSMAVCKAGAAEKGVPLYKHIADVAGVKKLVLPVPAFNIINGGMHAGNNMPMQEFMVLPTGAKSFKEAMKMGCEVYHTLRTLIKKKYGQDACNVGDEGGFAPNVASAEEALKMVDQAINDAGYKGKVTIGMDVAASEFYTQDKCYDLGFKMKNNDGSLKMTGKQMQELYAKFCKEFPIISIEDPFEQDDFANWTEITAANSCQIVGDDHLVTNPKRVKQAIEAKSSNALLLKVNQIGTISESIDAVRMSKEAGWGVMTSHRSGETEDSFIADLAVGLATGQI

SEQ ID NO: 6813 - protein, 466 aa, Oryza sativa Indica Group
MAVLATACWLVIRLVFVKGNTDRRPCEADGMRMVPGSRGLPIIGETLEFLALSPSLQIPAFFQRRLDRESNTKHMHINIQIRYFLVTNFVFQQEERLFQMWYPDSFIRIIGTDSLIRTHGLLHRHIKNLALRLFGPENLRREIIHDVQKTVEASLSSWLNQPSIELKEAVSSMIFKVTAKKLISYDSSTSDGKMWKQYDAFTQGLFAFPLCIPGTAFYKCMQGRKNVIKMLKEILDERKNTEEHHESVDFFDVIEEVKAENPDQMTENAALDLLFLLLFASFETTSSGITAMLIFLTDNPEALQELIEEHNNIRKRKADKNSEITWEEYKSMKFTSHVIHEALRLASIAPVMFREAIEDVHIKGFAIPKGSKIMICPYTVHLNPVVYKDPNTFNPWRWKWCLQGFHGLWRGAALVCWCSFCQAADGGFPPLPSHKSSWKAIKGGRMALSPGLRFPEGFHIQLFPKA

SEQ ID NO: 6814 - protein, 139 aa, Chlamydomonas reinhardtii
YTRKGMFRAAVPSGASTGVHEAVELRDGDKSKYLGKGVTKAVENINAIIAPALKGMDPVKQAEIDQKMKDLDGTDNKGKLGANAILAVSMAVCKAGAAEKGVPLYKHIADLAGNSKLILPVPSFNIINGGSHAGNALAM

SEQ ID NO: 6815 - protein, 140 aa, Scenedesmus rubescens
VTTYKGTFRAAVPSGASTGIHEAVELRDGDKSQWMGKGVAKAVGNVNNDIAPALLGKDPTQQKEIDDAMIALDGTENKGKLGANAILAVSMAVAKAGAAEKGVPLYKYIAQLAGNSKLVLPVPSFNVINGGEHAGNGLAM

SEQ ID NO: 6816 - protein, 486 aa, Gloeobacter violaceus PCC 7421
MKRCKVAVIGGGISGIVTAKCLRDDGHQVTLYESTDQVGGIWVYRKTSGGTFESVRFQNSKYLSAFSDYPMPEQMSDFPHHTEILAYLNSYVDHFRLRECIRLNCQVEKVSRSRDHWKVTVSTPEGAASESFDALAICSGVFREPRWPNIPGEADFKGTLLHAKDYKEPSMFANKRVVVMGNGASGVDIAVRATDFAQKVIWSFRRNSWLVPRYFAGRPLDCNLSRLYALIPAGVRKSLYSRKFAPIWEAHRQCNLEPAFGLFASIPSANEFVIDLVAKGAIETRPTIAGFSGQRVLFTDGSSTEADIVIYATGYGVSFPFFDASVVPVHNEGTDLYKHVFHPDLPNCGFIGIIRVIGALLPCAEMQARWFSKVLSEQVHLPDTESMRAEIQRMRAQQQKDWVASGYRSFQVRQVEYTEEIARLIDAVPKVWRHWQIAWQLLTGPMLPTHYRLDGPNPWKGAEEWIRQVPDLIKIPRNASGVGVGR

SEQ ID NO: 6817 - protein, 118 aa, Nephroselmis olivacea
VELRGGDKAKWMGKGVLKAVENLNSKIAPALIGKDPRNQRELDDLMNSLDGTENKGNFGANAILAVSMAACKAGAAEKGVPLYQHIADLAGNKKLILPVPAFNVINGGSHAGNKLAMQ

SEQ ID NO: 6818 - protein, 383 aa, Verpa conica
TTVHWHGQYQNGTNWMDGTTGVTNCPIPPGKSFRYEFTVRDQHGTYWYHAHFSTTRADGLFGPFVIHSPGEVKVLEYESDRVVMVHDYYHDLSSALLPTYLAPDNENAEPVPNGALINGQNIIDCAKVSAQYNCNTSNASLATFGLERDKNHRLRFINVGAFAEFDIEIDNHEFTLIEVDGITVNPYPLHRFRINVAQRYSIILTANHPEDSFWLRARMIAHCFAEIPEPLEAEVRGIVHYTSPSSSAPPSSLPTTTPWNEAMELECKDLITTELEPAVVVKAPEPDILVHLRSNFEIGGYALSRGFFNSTSWRPERGIPTLFSAIDGLGTGNSSFTNSNVNGVLDKAFDVKRQMVINVDGIKTVDVLIDNFDDGNHPFHLHG

SEQ ID NO: 6819 - protein, 639 aa, Triticum monococcum
MEYSSDDDSDISDSEIDEYGAKIQARLLSGDLKFRNGDSYSCPFCTGRKNKDYNMQSLLQHSSGVGAAPNRPAKDKASHRALAKHLKNGVAKPSDPQQAQQIAVEPQQPQQISVEPQPLPNRHEKFVWPWMGVLVNVPTEWKDGRQVGESGNRLKGELSQFCPLKVIPLWNFRGHTGNAIVEFAKNWNGFRNALAFEKYFEAGGCGRRDWKQNMNQGSKLCGWVARAEDYNFPGLIGDHLRKNADLKTIDDLENEGTRKNNKLVANLANQIEVKNKYLQELELRYNETTVSLEKMMGQREQRLQAYNEEIRKMQQLARRHSEKIIDENQNLRSELESKMSELNARSKELDDLAAKSSHDKSNLEQEKQKNAIKSNHLKLATAEQQRADEDVVKLVRDQKREKVAALNKILELEQQLEAKQTLELEIQQLKGKLEVMKHMPGHEDSVLKDKINELSEELQDKMDELDAMESLNQTLVIKESKSNTEMQEARKELENGLLNLPGGRAHIGIKRMGELDLKAVSNVLGQKLSKEDAEVTAAILCSKWEAEIKNPEWHPFRAVMVDGKEMERINADDAKLRELKDEHGEEIYSLVTKALREYNVNSTRYPVGELWNFREERKASLKEAVQVVLRQWRANRRKR

SEQ ID NO: 6820 - protein, 349 aa, Morchella conica
TSVHWHGLRQLWTTEQDGVNGITQCPIAPTDSFTYEWTATQYGTSWYHSHFSLQYAEGVAGAIVINGPTSANYDVDLGPVTLTDWYHATAFSEWHVAQTSGPPAAQNGLINGTNVFDCTGSTDTACVGGGKRFEFPAFEYGKKYKLRLINTSTDTHFRVSLDGHSLTVVAADFVPITPFTTDFLSIGIGQRYDVIIEANAPADNYWFRATIQTTCSAANTMALDVKGIVRYSTATTSGDPTTSAGTMTDSCLDEPLESLVPVVAKPVAESDLSTAQDVEVSIAITTVFKWTLNGISADIDWASPTLLKLLDGESYPTDYHVLDLPTANQMYYLVIETTLGITHPIHLHG

SEQ ID NO: 6821 - protein, 531 aa, Ralstonia eutropha JMP134
MSPVLAFKLVLLSLIAIIALELLAAKLRLPPAAAFLVGGIAMAFVPGLPAVELSPDLVLLVFLPPLLTDGAYFSVWDEFRRNLSGILMLAIGAVLFTTLVVGVAVHMVVPGLPWAACFALGAIVSPPDAVAAKAVLERVALPRRLMTLLEGESLLNDATGLVLYRFAVAAALTGAFSLEHATVDFFVLALGGVAVGIAIGFALVRVLRRLADEYLLITAAILSSWVSYIVGEWLEVSGVIATVTTGMILGWHQHQVFSASTRIRGTAFWQVMVFLLEALVFILIGLSLRGVIARHGGTADVMASLALPVGMVIVSVVLSRFAWVFGSEALKSAWQRVVRRQARADWRSATIVSWAGMRGVVTLAIALALPEQMPGRDLILVASFAVILVTVLLQGTTIGPLIRLLDIRRIEDASGRKLTEAQAWARLEAVQRDAIRPLVFDADGALRHPRLWEQVNYRAQITESFKDNIIPDEERTSHYGVILAGLAAAREELLRMHRAGQLHDELLRHLEYDLDLQEIAALHGSAGVGAD

SEQ ID NO: 6822 - protein, 586 aa, Vitis vinifera
MGSGTLVDGVRRWFQRRSSTSSTTTTTTTNNDSNNAAIHASCVFVTEVHAQSSASATQPRPHHKKRQPQDPEAAPALTLIKVPKRRPMDPHKKGMPETEFFTEYGEASRYQVQEVVGKGSYGVVGSAIDTHTGEKVAIKKINDVFEHVSDATRILREIKLLRLLRHPDIVEIKHIMLPPSRREFRDIYVVFELMESDLHQVIKANDDLTPEHYQFFLYQLLRGLKYIHTANVFHRDLKPKNILANADCKLKICDFGLARVSFNDAPSAIFWTDYVATRWYRAPELCGSFFSKYTPAIDIWSIGCIFAEMLTGKPLFPGKNVVHQLDLMTDLLGTPSAESIARIRNEKARRYLSTMRKKPSIPFSQKFPDADPLALHLVERLLAFDPKDRPTAEEALADPYFDGLANVDREPSTQPISKLEFEFERRKLTKDDVRELIYREILEYHPQMLQEYLRGGDQTSFMYPSGVDRFKRQFAHLEEHYGKGERSTPLQRQHASLPRERVCAPINEAADENKEFEKPEGLEKGNVENGPSKPNQSARSLLKSASISASKCIGVKEQKDVEEETIVEHDDEGVNGLSHDLAALNS

SEQ ID NO: 6823 - protein, 370 aa, Streptomyces parvulus
MTVSFRAAVLRGYEDPFTVEEVTLGTEPGAGEILVEIAGCGMCRTDLAVRRSAGRSPLPAVLGHEGSGVVVRTGGGPDTAIGVGDHVVLSFDSCGHCRNCRAAAPAYCDSFASLNLFGGRAEDPPRLTDGSGAALAPRWFGQSAFAEYALVSARNAVRVDPALPVELLGPLGCGFLTGAGAVLNTFAAGPGDTLVVLGAGAVGLAAVMAATAAGAPSVAVDRNPRRLELAERFGAVPLPAATAGLAERIRRLTDGGARYALDTTASVPLINEALRALRPTGALGLVARLHTALPLEPGTLDRGRSIRHVCEGDAVPGLLIPQLTRLWQAGRFPFDQLVRTYPLADINEAERDCDAGLVVKPVLLPPARSR

SEQ ID NO: 6824 - protein, 446 aa, Schizosaccharomyces pombe 972h-
MSNRIGPQRSTKTAAKLRLLPSTEEFDDFRRQDTGREVYSQIPQIEGSTAKRDAEHLGKRHREFLPRVTAYCTCDTFRVDLLFKFFQSRRSSHKTRPKQFDECIYSPYSYNNEETTDLLPDTLESSRGTLNRESSQESLQSIFEESGLDRNQPLFREVFCFTYGVVVLWGYTIDEEHRFLRELGRFEIEKLKIEDMEVEEFNYYITTLYQPRIFNDFIALRDASNYMIRLSISHAIAQSVKISLFEELVNETIDATKDTPQMIAETGRVNLKREEIMMAVGQLFILRININLQGSVLDSPELMWTEPQLEPIYTAARSYLEINQRVALLNQRVEVIGDLLSMLKEQITHTHDESLEWIVVILMGLLVLIALFSIVVRLADGFKLNDFRLVINNSNKFILLFANTLFYIGGLEAVSITTEESFLFLHYVYIIEEMGKGKKIKPYLSS

SEQ ID NO: 6825 - protein, 555 aa, Chlamydomonas reinhardtii
GGNAVLGYLLGGAIIGPYALGLISDVHSIKHLAEIGVVLLLFNIGGRGGGGRGGRGVFGMGTAQVVLTLLGVAGVAMLASGLPGPGAIILGGSLAMSSTAVAIQVLEERGEMGSRHGRAIFSVLLLQDLAVVVLLMLIPLLAPSPDGSSGGFARIAQALGLAAVKAVVAIVGIIAGGRLLVRPLYKKISEFANAEIFAATTLLMVLGTSFLTQLAGLSLALGAFLAGLLIAETEFALQVESDIAPYKGLLMGLFFMSVGMEISVQLFIAKWKEVLAAITILIVGKVAVMAAIGPMFGVPRLAAIRSGLLLAPGGEFAFVAFGEAVARGVLPAATCNLLYVVVALSMALTPYLAEFGSRLGAVMESSDLKELQPKEDEMKEMKDHVIIAGYGRVGQIIAQMLSEQLIPFVALDVSSARVSVGKKKDVPVFFGDAGSASVMHLVGAERAACAIIALDTPGANYRAVYTMSKHFPHVKTYVRAHDITNAVNLERAGATAVVPETLEPSLQLAAAVLREMDFNTEEVSSIVDEFRRKHLSDLQVLSAASGTSLGYGFEK

SEQ ID NO: 6826 - protein, 400 aa, Aeropyrum pernix K1
MVEKVLATGVGAAKAARGSSIIYRKWVRGTGGLISGDLVEVIDRNGSEIACGLWEENTPVAVRIIHWGKCLERSPEEALERALEAAYKARVRSKWAVEFDSYRLINSDGDRLSGLIADVYKDVAVVQSSSPAIDRHISYISQAIRKFTGVTHVYEKSVQRSRLDIGLEPRRRWLMGRRKEVVIEEGQARFIVDVERGQKTGFFLDQRVNRLELARVAGPGDSVLDVFSYTGGFGIHALLSGASKAVFIEEDAHAVKLLRKNLRLNGIQENKALILNTSIWKAIQAGEPRESFDIVTVDPPAFIQKPGQEAKKRGFRAYKSSYLFALERAAGNSIVYLSSCSYFLSREEFITLVTEVASALEKEYRILGDVRGASPDHVYRGEEYLSYLKGAFIHIDPSVT

SEQ ID NO: 6827 - protein, 158 aa, Brassica napus
MSITLLTINTSSSSSSYRPDSSKGYMVAFAGAKYAARSVPIMVADNDHVVTSFTLVLEFQKGRLENLFWKKDGCSKCTGDAKFVCLNKEECAIKRQSCTNQGGQVDCSLGIQLAFSGTDKHYTALNSWYEVANLKQYSLYGLYSNLKDSLSSQFSNIF

SEQ ID NO: 6828 - protein, 193 aa, Mannheimia succiniciproducens MBEL55E
MALIPMVVEQTSRGERSYDIYSRLLKERVIFLSGEVEDNMANLIVAQLLFLESENPEKDINLYINSPGGSVTAGMAIYDTMQFIKPDVRTLCVGQACSMGAFLLAGGAAGKRAALPHARVMIHQPLGGFRGQASDIQIHAQEILKIKQTLNERLAFHTGQPFEVIERDTDRDNFMSAEDAKNYGLIDSVLVKR

SEQ ID NO: 6829 - protein, 397 aa, Bordetella parapertussis
MSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 6830 - protein, 83 aa, Brassica napus
RHEGVVSDAYEATKDAHGICVLTEWDEFKSLDFKRIFESMRKPAFVFDGRNVVDAVKLREIGFIVYSIGKPLDSWLKNMPSVA

SEQ ID NO: 6831 - protein, 327 aa, Candida glabrata CBS 138
MSEVILPAIEEENQLKNFLKQDTNVAFLAGGIAGAISRTVVSPFERVKILLQVQSSTTAYNKGLFDAIGQVYKEENIKGLFRGNGLNCIRVFPYSAVQFVVFEGCKKHIFHVDTKGKGEQLNNWQRLFSGALCGGCSVVATYPLDLVRTRLSVQTANLSKLSKSRASDIAKPPGVWKLLSKAYAEEGGIMGLYRGVWPTSLGIVPYVALNFAVYEQLKEFMPSDENGNSSMRDSLYKLSMGAISGGVAQTITYPFDLLRRRFQVLAMGGNELGFHYNSVWDALVTIGKTEGFKGYYKGLTANLFKVVPSTAVSWLVYELTWDYMKRW

SEQ ID NO: 6832 - protein, 728 aa, Mycobacterium tuberculosis H37Rv
MTHPDPARQLTLTARLNTSAVDSRRGVVRLHPNAIAALGIREWDAVSLTGSRTTAAVAGLAAADTAVGTVLLDDVTLSNAGLREGTEVIVSPVTVYGARSVTLSGSTLATQSVPPVTLRQALLGKVMTVGDAVSLLPRDLGPGTSTSAASRALAAAVGISWTSELLTVTGVDPDGPVSVQPNSLVTWGAGVPAAMGTSTAGQVSISSPEIQIEELKGAQPQAAKLTEWLKLALDEPHLLQTLGAGTNLGVLVSGPAGVGKATLVRAVCDGRRLVTLDGPEIGALAAGDRVKAVASAVQAVRHEGGVLLITDADALLPAAAEPVASLILSELRTAVATAGVVLIATSARPDQLDARLRSPELCDRELGLPLPDAATRKSLLEALLNPVPTGDLNLDEIASRTPGFVVADLAALVREAALRAASRASADGRPPMLHQDDLLGALTVIRPLSRSASDEVTVGDVTLDDVGDMAAAKQALTEAVLWPLQHPDTFARLGVEPPRGVLLYGPPGCGKTFVVRALASTGQLSVHAVKGSELMDKWVGSSEKAVRELFRRARDSAPSLVFLDELDALAPRRGQSFDSGVSDRVVAALLTELDGIDPLRDVVMLGATNRPDLIDPALLRPGRLERLVFVEPPDAAARREILRTAGKSIPLSSDVDLDEVAAGLDGYSAADCVALLREAALTAMRRSIDAANVTAADLATARETVRASLDPLQVASLRKFGTKGDLRS

SEQ ID NO: 6833 - protein, 459 aa, Ralstonia eutropha JMP134
MAQGFDAIIIGTGQAGPALAARLSGAGMKLAIIERARFGGTCVNTGCIPTKTLIASAYAAQLARRAAEYGVTIGGPVAVDMKRVKARKDEISGRSSNGVEQWMRGLANITVYQGHARFENAHSVQVNGELLEATQIFVNVGGRALVPPMPGLDQVPYLTNAGMMDVDFLPEHLIVIGGSYIGLEFGQMYRRFGARVTVVEKGPRLIQREDEDVSQAVREILEAEGIDIRLNANCLSARRDGDHLAVGLDCASGAPEVHGTHLLMAVGRVPNTDDLGLDKAGVETDARGYIKVDEQLRTNVPGIWALGDCNGRGAFTHTSYNDHEIVAANLLDNDPRKVSDRIAAYAMFIDPPLGRAGMTETEARQSGRKILVGTRPMSRVGRAVERGESLGFMKVVVDADTRVILGAAILGLTGDEVIHSILDVMYAGAPYTVISRAMHIHPTVSELVPTLLQELRVPG

SEQ ID NO: 6834 - protein, 473 aa, Listeria monocytogenes EGD-e
MSKGQVIQVMGPVVDVKFEGGNLPEIYNALVIEYKSDAEEAPTSQLTLEVAIQLGDDVVRTIAMASTDGVQRGMEVIDTGSPITVPVGTVTLGRVFNVLGNTIDLDEPLPSDIKRNKIHREAPTFDQLATTTEILETGIKVVDLLAPYLKGGKIGLFGGAGVGKTVLIQELIHNIAQEHGGISVFAGVGERTREGNDLYFEMKDSGVIEKTAMVFGQMNEPPGARMRVALTGLTIAEYFRDEEHQDVLLFIDNIFRFTQAGSEVSALLGRMPSAVGYQPTLATEMGQLQERITSTNVGSVTSIQAIYVPADDYTDPAPATTFAHLDATTNLERKLTEQGIYPAVDPLASTSRALSPDIVGEEHYAVATEVQRLLQRYKELQDIIAILGMDELSDEDKQSVSRARRVQFFLSQNFHVAEQFTGQKGSYVPVKETVKGFKDLLAGKYDHIPEDAFRSVGRIEDVLEKAKDMGVEV

SEQ ID NO: 6835 - protein, 438 aa, Triticum aestivum
MYVPRPSRSDGSRDADEQPRVYQVWPGNNEFFLQGRLIFGPDARSIFLTMSLIFVPVVVFCVFVARHLINDFPDHCGISVMVVVVVFTVYDLTLLLLTSGRDPGIIPRNTHPPTPESIYGSNYIRGQTPLRLPRTRDVVVNGINVKVKYCDTCLLYRPPRCSHCSICNNCVERFDHHCPWVGQCIGQRNYRFFYMFVFSTMLICLYVFAFCWVYIIKISDAEQLSIGRAMLKTPASVVLIVYCFLCVWFVGGLSVFHFYLMSTNQTTYENFRYRYDRRANPYNRGILNNILEIFCSSIPPSKNNFRARVTVEQGVEQARSSSRDFMSPNMGKAVADLEMGKKPAPWDEPRTTADVGDLEVGLGGMLDEKEGRLTHASPDVSRDELSAELVEGRAGMHSRHSSWDPRAETSESVNSNSVQTAPTEEANGGGHVTTSGVH

SEQ ID NO: 6836 - protein, 488 aa, Zea mays
MAGLPPVARRLRLRLATAALLLVLLLAVTAAVAAREGRGLARVQGPPPRHRHAYAAMMYMGTPRDYEFYVAVRVMMRSLTRVRADADRVLIASADVPRDWVRAMTEEDGMRVVIVENLRNPYEGNLGGTNKRFKLTLNKLYAWTLVDYGRVVMIDSDNIFLQNTDELFQCGQFCAVFINPCYFHTGLFVLQPSIDVFKGMLHDLETGRENSDGADQGFLVGCYPDLLDKPMFHPPENGTKLNGTYRLPLGYQMDASYYYLKLHWHVPCGPNSVITFPSAPWFKPWYWWSWPVLPLGLSWHKQRWDDLGYASEMPVILMEVLMYIVIITVTRLARPGMTKLCYNRRPEKQSALVQWLIKLTAIVAMVAAYSIPFFVIPRTVHPIMGWSVYLFGALALSVLVINVFLLPPLDVLTTWLAIVGMLFVMAFPWYHDGVVRALAVFGYAFCSAPFLWASVVRMMDSLQTMLERDPFFSRIGEPTQETEFSKLY

SEQ ID NO: 6837 - protein, 452 aa, Klebsiella pneumoniae subsp. pneumoniae MGH 78578
MGMSKHYDYLAIGGGSGGIASINRAAMYGQKCALIEAKELGGTCVNVGCVPKKVMWHAAQIREAIHLYGPDYGFDTTINHFDWEKLVASRSAYIDRIHTSYDNVLGKNRVDVIKGFARFVDAHTVEVNGEIITADHILIATGGRPSHPDIPGVEYGIDSDGFFELPALPKRVAVVGAGYIAVELAGVINGLGAETHLFVRKHAPLRSFDPLIVETLVEVMNAEGPQLHTNAIPKAVVKNADGSLTLELEDGRSQTVDCLIWAIGREPATDNFNLAATGVKTNDKGYIIVDKFQNTNVPGIYAVGDNTGAVELTPVAVAAGRRLSERLFNNKPEEHLDYSNIPTVVFSHPPIGTVGLTEPQAREQYGDDAVKVYKSSFTAMYTAVTSHRQPCRMKLVCVGPEEKIVGIHGIGFGMDEMLQGFAVALKMGATKKDFDNTVAIHPTAAEEFVTMR

SEQ ID NO: 6838 - protein, 720 aa, Photobacterium profundum SS9
MIYQGETLSVRYLDDGIAELNLNAPGAVNKFDLKTLECLNEALNALYQQSDLKGLLITSDKDAFIVGADITEFLGLFAKPAEELSQWLTRANDIFNKLEDLPVPTLSAINGHALGGGCECVLATDFRLADITARIGLPETRLGIMPGFGGTVRLPRLLGADSAMEIITAGKDKKAQDALKLGLVDAVVAPTALKDAALSMIKDAIAGKLDWQKRRAQKKAPLTLNKIEATMSFTMAKAMVAQVAGKHYPAPMTAVIAIEAAARMSRDEALVVENKHFITLAKTDVAQSLVGIFLNDQYIKGKAKKAAKEGQPTKKGVVLGAGIMGGGIAYQSALKGVPVLMKDIAVPSLDLGMAEAAKLLNKQLERGRIDGVKMAKVLSGITPSLHYAGAEDADIVVEAVVENPKIKAAVLAEVESNVSDTTVIASNTSTIPINLLAQSLKRPENFCGMHFFNPVHRMPLVEIIRGEHTSEETISRVVAYAAKMGKSPIVVNDCPGFFVNRVLFPYFAGFSLLLRDGADFTQVDKVMEKQFGWPMGPAYLLDVVGIDTAHHAQAVMAEGFPDRMGKNYKDAVDVMFEQQRFGQKNGNGFFAYSVDRRGKPKKNVDPAVAELLAPVLGAATDFTSDEIIARMMIPMINEVVRCLEECIIATPAEADMALVYGLGFPPFRGGVFRYIDTLGLAEYVAMADKFAHLGAVYEVPTGLREKAAKGESYYTQQVNA

SEQ ID NO: 6839 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 6840 - protein, 389 aa, Azoarcus sp. EbN1
MKALCWHGKKDVRYDTVPDPRIEDPRDAIVKVTSCAICGSDLHLYDGFMMGMESGDILGHEFMGEVVEVGAADHRLKVGDRVVVPFTICCGECEQCRRGNFSVCERSNRNKALADKTFGHSTAGLFGYTHLTGGYAGGQAEYVRVPYADVAPVKITSGLSDDQVLFLGDILPTGWQAAVQCDIQPTDTVAIWGAGPVGQFAIRSAVLLGAKQVIAIDRVPERLGMAQAGGATTINCEDESVIERLNELTGGKGPEKCIDAVGMEAHATQSLDSLYDRAKQAIMLETDRPHVLREMIYVCRPAGTLSVPGVYGGLIDKLPFGALMNKGLTLRTGQTHVNRWTADLLRRIEEGQIDPTFVVTHVAALEDGPEMYKTFRDKKDGCIKVVLKP

SEQ ID NO: 6841 - protein, 335 aa, Rhodococcus sp. RHA1
MARPVRVVVLGAGSWGTTVAGLAAHNTPTLLWARNSDTADEINNEHRNSRYLGDRPLPDSMRSTADLVEAAHEADVLVVGVPSHAVRSTLAQIANEVRAWVPVLSLAKGLEPGTRLRPTEVIAECLPGHPVGLLAGPNIAREIVDGLAAASVVATQDVRVATALQPLFASAVFRVYRNTDVLGCELGGVLKNIVAIASGMADGLDVGDNTRAMVLARGLAEMTRLGEAMGANPRTFAGLTGVGDLIATCMSPSSRNRRVGEYIARGMTVDEAVAKLGQVAEGVKTAPTVMELARDYNVEMPIAAEVEAVVAGRQTPEGAYRGLRKVAAGGEHEVA

SEQ ID NO: 6842 - protein, 157 aa, Arabidopsis thaliana
MTMRSSLPSSSSSYSLASTSLSNRLETQEKRYSSWVQNKKKKKKNKGLKNPNKKRKTSLKKNKGLKNPKRKTSLNNVLKYPLADHYSPDQISQLIQSLEPHVSKTQSLNPSQFSLFMYNHGDNTLSQIPVTASNFNQDFSALLQESGLMKQELYGYD

SEQ ID NO: 6843 - protein, 134 aa, Triticum aestivum
  misc_feature (36)..(36): Xaa can be any naturally occurring amino acid
  misc_feature (65)..(65): Xaa can be any naturally occurring amino acid
  misc_feature (84)..(84): Xaa can be any naturally occurring amino acid
  misc_feature (88)..(88): Xaa can be any naturally occurring amino acid
  misc_feature (90)..(90): Xaa can be any naturally occurring amino acid
  misc_feature (97)..(97): Xaa can be any naturally occurring amino acid
  misc_feature (105)..(105): Xaa can be any naturally occurring amino acid
  misc_feature (115)..(115): Xaa can be any naturally occurring amino acid
  misc_feature (125)..(125): Xaa can be any naturally occurring amino acid
  misc_feature (128)..(130): Xaa can be any naturally occurring amino acid
MAPTVMASSATSVAPFQGLKSTAGLPVSRRSNGASXSAASSNGGRIRCMQVWPIEGIKKFETLSXWPTAQQRRASSKQVDYLIXRLQXWXACLEFKXRLGSTFRXEQQRHLPGYXRMGRYWDNVXKLXXXSGCN

SEQ ID NO: 6844 - protein, 248 aa, Vitis vinifera
MVATENGVVERRREGVGRVRRGIEKKKCKKMKKRSSLQRLFVACRDVFKGLGTVPQPIDVTKLCHILDNMRPEDVGLSKDIPFFKAKRAAQGIPKVTCATVYKCEEFSLCIFFLPPRAVIPLHNHPGMTVFSKLLLGSMHIKSYDWVDPVGSDSSSPPSKLRLARLKADSVFTAPCNTSVLYPTSGGNIHAFTAITPCAVLDVLGPPYSKKDGRDCSYYKDSPYTPFSSKKKSRGWRRRREVWMVGRG

SEQ ID NO: 6845 - protein, 218 aa, Aeropyrum pernix K1
MSQREAGQVDLEAWQPRTRVGRLVKEGKIKSIDEIFRRNLPILETEIVDYLLPGLDHEVIDVSIVQKMTDAGRITRFRAVVVVGNKDGYVGLGKGKARQFRFAIEKAIRNAKLNIIPVRRGCGSWECTCGEAHSVPFTVRGKSGSVEVILKPAPKGTGLVAGDVAKVVLRLAGISDVWTFTKGETRTSYNFARATYLALRNTYRFVTPADWAEARLRL

SEQ ID NO: 6846 - protein, 539 aa, Coccidioides immitis RS
MDSEQPPHSVFDTILVLDFGSQYSHLIIRRLRELNVYSEMVPCTQRLADLTWKPKGVILSGGPYSVYEQDAPHVDPAFLDLGVPILGICYGIQELAYRLDKANVTAGIAREYGHADLSAKRLDDQGHVDRLFSGIKDNTKVWMSHGDKLVKLPEGFHTIATTANSEYAGIAHETKPIYGIQFHPEVTHTPDGTHLLKNFAVDICGAAQNWTMAKFVDQEITRIRKLVGETDHVLGAVSGGVDSTVASKLMKEAIGDRFHAVLVNNGCMRLNECEQVHETLGKHLGINLTVVDASKQFLDALKGVTDPERKRKIIGGKFIDVFEAEALKIEAGVKHTGAKVKWFLQGTLYPDVIESLSFKGPSATIKTHHNVGGLPKRMQEGAGLKLIEPLRELFKDEVRQLGRELGIHNDLVMRHPFPGPGIAIRVLGEVTPERVEIARRADHIFISMIREAGLYDKIAQAYAALDPTKAVGVMGDKRVHAEMIVLRAVETSDFMTCTAYPFPHEFLSRVSTRIINEVHGVSRVLYDISSKPPATIEME

SEQ ID NO: 6847 - protein, 412 aa, Spiroplasma citri
MTNKKELKDVQVKGKKVLVRVDFNVPMKDGQVTDDNRIIAALPTIKYLIAQEAKVILFSHLGKVKTADDLEKRDMAPVAKVLEQKLGQPVKFINAFEGKQLEEAINEMHNKEVILFQNTRFADIINSNGQISVDSEGKAAAKRESKNDSALGKYWASLGDVFVNDAFGTAHRAHASNVGIAENITESCLGFLVEKEVKMLSQCVDNPVKPFVAIIGGAKVSDKIGVIEHLLTKADKILIGGGMAYTFFAAQGHKIGNSLLEVDKVEIAKTFLAKGQGKIILPIDALEAPEFADVPAKVTTGFDIDDGYMGLDIGPKTIELFKKELADAKTVTWNGPMGVFEFKNYSIGTKAVCEAIAELKGAFTLIGGGDSAAAAIQLGYKDKFTHISTGGGASLEYMEGKPLPGIEAVQSK

SEQ ID NO: 6848 - protein, 311 aa, Mycobacterium tuberculosis H37Rv
MTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 6849 - protein, 605 aa, Oryza sativa Japonica Group
MELALVGNPSNGVAKPSCNSVGSLPVVSSNAVINPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 6850 - protein, 314 aa, Yersinia pestis CO92
MSNAEHLASVMVEQFIKAVDNGVDLVPVVADSTSTAKIGPFITRFPDRVVNVGIAEQAMVGMAVGLSMGGKIAVTCNAAPFLISRANEQLKIDVCYNNSNVKLFGLNSGASYGPLASTHHCIDDIAILRGFGNIEIYAPADPQECRQIIDYALAHQGPVYIRLDGKALPPLHDEHYRFAPGQIDVLQEGRDIALVAMGSTVHEAVSAAAILADNNISAAVVNVSSIRPCDTQQLFAILQQSQRVITIEEHNINGGVGSLVAEVLAEAGSGTPLVRLGIPDGGYAIAADRAEMRAYHGFDAAGIVARALRFCRGE

SEQ ID NO: 6851 - protein, 73 aa, Oryza sativa Japonica Group
NRILHHTIGLPDFSQELRCFQTITCYQAVINNLDDAHEQIDTAIATALRESKPVYISVGCNLAGLSHPTFSRE

SEQ ID NO: 6852 - protein, 399 aa, Rickettsia typhi str. Wilmington
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPIFVNCGIENNFKLTVEALERSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTVIQSQSTSNPCSISQMAAIEALNGTQDYIKPNALNFQKKRDLALSILEKVIYFECYKPEGAFYLFVKCDKIFGTKTKSGKIIANSNHFSEYLLEEAKVAVVPGVAFGLDGYFRISYATSMQELKEACIRIKQACNTL

SEQ ID NO: 6853 - protein, 282 aa, Bradyrhizobium sp. ORS278
MNLFVIGFGYSAQRFVDLHGSGFAAIGGTVRGAEKRAQFARYALDLFDGTMPAAATLAKAAKADVVLISAPPGAGEDPALTHFGDAITSGRARVVYLSTVGVYGDHQGAWIDEDTPLAPEHGRVQARVRVEEDWRARIGDRLAVLRLGGIYGPGRNALVELRAGRARRIVKPGQVFNRIHVDDIAAAIQGAIRRERGGAWNIVDDEPAPPQDVIAYAARLMGIAPPPELPFDSADLSPMARSFYASNRRIRNTRAKQDLGLVFAYPTYREGLDALWAAGEGR

SEQ ID NO: 6854 - protein, 813 aa, Gloeobacter violaceus PCC 7421
MLQVERHDSQRRLHRDRALVLRLGEVGLADIDKVGGKNASLGELLRQLSAEGIRVPEGFAVTAFAYREFIAHNGLEAKLRALFAGLDTEDIEQLRRVGEQARGLVLASSLPERLQERIREGYGELCGRYGADTDVAVRSSATAEDLPEASFAGQQETYLGVQGEEAVLEACKRCYASLFTDRAISYRQLMGFDHFEVALSVCIQKMVRSDLAGAGVMFSIDPETGFANVVHIAAGWGLGELVVQGAVNPDEYVVFKPTLERGFFPILAKRPGSKERKLVYSETGPITVETSPAERSGFVLEEAEILELARWAVLIERHYSRVRGVNTPMDIEWAKDGRTGELFIVQARPETVQSHKSAQTLVHWRLKGSAPVLATGRAVGEGVGQGRARVIRDPSQLEAFEKGEVLVTDRTDPDWEPIMKKAGAIVTNQGGRTCHAAIIARELGIPAIVGTGEATRRIETGDPVTVACCEGEEGRVYAGEVPYERTEVAIDALPRPHTRILLNVGNPAEAFRLAAIPNDGVGLARLEFIIANHIQVHPLALLHFEQLPEGDEKARLSALTEGYPDRAEYFVEHLARGVATIAAAFYPQPVIVRLSDFKSNEYANLLGGRHFEPLEENPMLGWRGASRYYDERYRAAFALECRALRWVRDQMGFTNVVVMVPFCRTPEEGRRVIAEMASHGLVRGENGLEVYVMCELPSNVVLAGEFAQVFDGFSIGSNDLTQLTLGLDRDSAGVAGLFDERHPAVRKMVAMAIEGAHAARRKIGICGQAPSDYPEFARFLVERGIDSLSLNPDAALKTRLLVARVEEELSRPS

SEQ ID NO: 6855 - protein, 449 aa, Vitis vinifera
MAKTGVLETDPRVAELKKELQRLVKSIVEDDDYSVEVMDRAREALCSIKDLKVKRSMSLKLHGPHSFPEEFRCPLSREMMRDPVILATGQTYDRPFIQKWLKAGNRTCPLTQQVLSHTMLTPNHLIREMISQWCQSHGIELTDPDQYSNEDQIMDADRSRFIDLLEKMSSSALEQKEAAKELRLLTKRMPSFRALFGESLDAIPQLLNPFSQNKGGIHPDLQEDLITTLLNLSIHDNNKKLVAETPMVIPLLMDALKSGTIETRSNAAATIFTLSALDSNKALIGKSGVLKPLIDLLEEGHPSVMKDVASAIFNLCIIHENKSRAVHEGAVKVLMKKIMNQTHVDELLAILAMLSTHQKAIEEMGDLGAVSCLLTIIRESSCDRNKENCIAILHSVCLNDRTKLRELREEENTYRTISKLSQTGTARAKRKANGILERLRRALNITHTA

SEQ ID NO: 6856 - protein, 382 aa, Burkholderia vietnamiensis G4
MSNAMSAGRPADSRADIATALEIIEEARAGRMFILVDDEDRENEGDLVIPAQFATPDAVNFMATHARGLICLAMTRSRCESLGLHLMSRINGSRHETAFTVSIEARDGVSTGISAADRSRTISLAINPETGRDELVSPGHVFPLMARDGGTLVRAGHTEAAVDIARLAGLAPAGAICEIMNDDGTMARLPDLIAFSRRHQLKLGTIADLIAYRRRTERLVEAVEHGSFTEPNGRHWRIVVYRNRIDQVEHIAFVMGDLRGADPVLVRMHAMDTMNDVIGGHHLASLRGAARLLENENRGVIVVIRESRLTAVSERVRAMMHPKPAEPELRDYGIGAQILTELGVKNMILLSNHERTIVGLEGYGLNMVEQRKIERIHDYQEV

SEQ ID NO: 6857 - protein, 297 aa, Aster tripolium
MLPYSSLQEAEAAMGRSLTFAETLWFNYSANKSDYVLYCHNIPLIFFLTTFLPIVYVVIEFLFPDYAASYKIQPKIKVSLYENFKVYLGVMRTFFLLVAPILLASHPSVQMIGIRTSLPLPSLLEIASQLLVYFLIEDYTNYWIHRFFHCKWMYNNIHVVHHEYTAPTGFATQHAHWFRYWCLGIPSFLGPSIAPGHMVTFLLWLALRQFEAIENHSGYDFPWTYKKFIPFSAGAEYHDYHHYVGEKSQSNFWHPIFTYCDYLYGTDKGYRNRKKLLAQQERWSKSEGKRAKGEHMR

SEQ ID NO: 6858 - protein, 590 aa, Burkholderia vietnamiensis G4
MSLIEVKVPDIGDFSGVDVIEVNIKPGDVIEKEQTLLTLESDKASMEVPSDIAGTVKEIKVKAGDKVSQGTVIALVEASTGAAAPAPAKAPDAPKPAAAAPAPAAAAPAPAPQAGSYGGSADIECDMLVLGAGPGGYSAAFRAADLGMKTVLVERYSTLGGVCLNVGCIPSKALLHTALVVEEAAALASHGITFGKPQVDLDKLRDFKGGVVKKLTTGLAGMAKARKVEVVTGIGAFLDPFHMEVQGDNGKKVVKFKQAIIAAGSQAVKLPFMPEDPRVVDSTGALELRQLPKRMLVIGGGIIGLEMATVYSTLGAEIDVVEMMDGLMMGADRDLVKVWEKFNAKRFGNVMLKTKTVGAQAKEDGIYVKFEGEKAPAEAQRYDLVLVAVGRSPNGKKIGADKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEATHRVIGGGIVGLNAGDLISEVCLAVEMGADAEDIGKTIHPHPTLGESVGMAAELYEGVCTDLPPPRRA

SEQ ID NO: 6859 - protein, 446 aa, Burkholderia vietnamiensis G4
MRVTRIEVPDIGDYKNIPVIEVLVGVGQRVEREQSLVVLESDKATMDVPSPAAGVIREMKVAVGETVSQGTLIALLDSDSDGERQDDAAPVPAAASAARDLACPSANVATGLVPALAPAPELKSASAPLHSAPAREGEPSRASHASPSVRKFARELGVDVARVPGSGPKGRITKDDITGFVKGVMSGQCAAPGAAAAPAGGGELNLLPWPKVDFAKFGPFEAKPLSRIKKISGANLHRNWVMIPHVTNNDEADITELEALRVQLNKEHEKAGVKFTMLAFVIKAVVAALKKFTTFNASLDGDNLVFKQYYHIGFAADTPNGLVVPVIRDADKKGLVDIAKEMAELSKAARDGKLKPDQMQGGCFSISSLGGIGGTHFTPIINAPEVAILGLSRGQMKPVWDGKQFVPRLTLPLSLAFDHRVIDGAEAARFNAYLGALLGDFRRIVL

SEQ ID NO: 6860 - protein, 326 aa, Oryza sativa
  misc_feature (207)..(207): Xaa can be any naturally occurring amino acid
  misc_feature (264)..(264): Xaa can be any naturally occurring amino acid
  misc_feature (293)..(293): Xaa can be any naturally occurring amino acid
  misc_feature (304)..(304): Xaa can be any naturally occurring amino acid
  misc_feature (311)..(311): Xaa can be any naturally occurring amino acid
MAMASLARRRAAEAALLRRAPAAAWASAWRGYAAAAAGEESDVVVIGGGPGGYVAAIKAAQLGLKTTCIEKRGTLGGTCLNVGCIPSKALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALGXSEIPKKLVVIGAGYIGLEMGSVWNRLGSEVTVVEFASDIVPSMDGEIRKQFQRMLEXKQKMKFMLKTKVVGVDTSGSGVKLTVEPXAGGGAECSLSXILSLYPXGRYPYTSGSWIYRPW

SEQ ID NO: 6861 - protein, 536 aa, Listeria monocytogenes str. 4b H7858
MTIVAMNDVVKSFTGDIILEKVSLQLEEGERVGLIGRNGEGKSTILKILKGTEGVDSGIVTSKKGAKIGLLEQLSTVDPNIIVEQYLRTSFGELEELEKELRALEGEMATNSSEKLMNRYGDKMALFGELGGYEMDANLNKVVNGLGIGLLLSQRWGDLSGGEKTKAALAHLLLQKTDLLLLDEPTNHLDLMAVEWLTAFLQHYSGTVLVVSHDRYFLDEVVGKMVELENRELIVYHTNFSGYLKEREERLLREFQDYKDQQKKIKKMQQAIKRLRQWAMQANPPNDAMFRRAKNMERALERMEKVKRPVLTQKQMQLQFDEAGRSGQEVVVMENLSKSFSEKAIVQDVSLQIRQGERVAIIGENGAGKSTLLKIMEGKVVPDVGMIKVGASVKIASLSQQMEELNEKLTVLDAFRDKVAVTEGEARQMLAGFMFYGEMVFRKVGNISGGERMRLRLAQFINMPVNTLILDEPTNHLDIASREILEEAIRAFSGTIITVSHDRYFIDQLCSKVIWLENKQLTVYEGNYSYATSKRR

SEQ ID NO: 6862 - protein, 447 aa, Bordetella petrii
MKLQSLDDFLRQVAARDPQQPEFMQAVHEVMSSLWPFLQQHPHYAEYALLERLVEPERVIQFRVCWTDDQGNSRVNRAFRVQHSSAIGPFKGGMRFHPSVNLSVLKFLAFEQTLKNALTTLPMGGGKGGSDFDPKGKSDAEVMRFCQALMLELHRHLGPDTDVPAGDMGVGAREVGFMAGMMKKLSNSAASVFTGKGLTFGGSLIRPEATGYGTVYFAEEMLKREGLSFDGLRVSVSGSGNVAQYAIEKAMTLGARVVTVSDSDGTVIDEAGFTHEKLAALMHLKNDLRGRLAEYAGQFKLTYAAGKRPWHVPVDVALPCATQNELEIDDARTLIANGVKCVAEGANMPSTLEAAKTFIEAGVLYAPGKASNAGGVAVSGLEMSQNAIRLAWTRDEVDQRLHAIMRDIHESCVRHGQGRGNTVNYLDGANIAGFVKVADAMRQQGLY

SEQ ID NO: 6863 - protein, 335 aa, Staphylococcus warneri
MAVKVAINGFGRIGRLAFRRIQDVEGLEVVAVNDLTDDDMLAHLLKYDTMQGRFTGEVEVIDGGFRVNGKEVKSFDEPDASKLPWKDLDIDVVLECTGFYTDKDKAQAHDDAGAKKVLISAPATGDLKTIVYNTNHDELDGSETVVSGASCTTNSLAPVAKVLSDEFGLVEGLMTTIHAYTGDQNTQDAPHRKGDKRRARAAAENIIPNSTGAAKAIGKVIPEIDGKLDGGAQRVPVATGSLTELTVVLEKDVTVEQVNEAMKQASDESFGYTEDEIVSSDVVGMTYGSLFDATQTRVMAVGGRQLVKVAAWYDNEMSYTAQLVRTLNKLAELSK

SEQ ID NO: 6864 - protein, 393 aa, Vitis vinifera
MTMKTLIIIVTLASTLLLLLSLLYLSTQSTAFPPTIKTFNSPKYPVTFAYLISASAGDARKLKRTLRALYHPANYYLLHLDAGAPQAEREEVSRYVAEDPVYGEVGNVWVVQKSNLVTYRGPTMLATTLHAMAMLLRSCKWDWFINLSASDYPLVTQDDLIHVFSDLPRDLNFVQHSSRLGWKLNKRGRPIIIDPGLYSQNKSDIWWVIKQRSLPTAFKLYTGSAWTILSRSFAEYCILGWDNLPRTLLLYYTNFVSSPEGYFQTVICNSDDYKNTTLNNDLHYIAWDTPPKQHPRSLGLKDFKRMYSSNRPFARKFKQDDRVLDKIDRQLLKRHPGQFSYGGWCSGDGRMHGSCSGLQSQSYGVLRPGPGSRRLKTLITKTLPERKYKRQCR

SEQ ID NO: 6865 - protein, 196 aa, Oryza sativa Japonica Group
NILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 6866 - protein, 354 aa, Zea mays
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLVDGVSSICALDFRMDEWGVDVALTGSQKALSMPTGMGIVCASPRALEASKTARSVRVFFDWKDYLRFYDMGTYWPYTPSIQLLYGLRTALDLIFEEGLDNVVRRHNRLGTATRLAVEAGGLSNCCRKGGGFSDTVPAAVVPPNIDSAEVVRPAWKGYNLSFGLGLNKVAGKVFRIGHFGNLNEGQLLGFLSGGGMGLKDGGYPVKLGRGGAAGGGYLSNSPPLFPFRFWEQCKGGVLQTRPGPTRGQANEQSVVT

SEQ ID NO: 6867 - protein, 576 aa, Triticum aestivum
MRALFAWCALLLACGGLLHCAEAAKARHLKWEVGHMFWSPDCEEKVLIGINGQFPGPTIRAKAGDTIVVELKNGLHTEGVVIHWHGVRQIGTPWADGTAAISQCAINPEETFTYRFVVDKPGTYFYHGHYGMQRAAGLYGSLIVDVADGEEEPFKYDGELNLLLSDWYHDSIYNQMVGLSSSPMRWIGEPQSLLINGRGQFNCSLAAAHTPGTKQCTAGGNRHCAPVILPVQPNKTYRLRIASTTSLASLNLAIGNHKLTVVEADGNYVEPFVVDDMDIYSGDSYSVLLTTDQDPSSNYWVSIGVRGRAPKTAPALALLNYRPNRGFKLPAIAPPVTPTWNDTAHSKAFTTQIKARAGTPPPPATSDRRIELLNTQNKLDGHIKWSINNVSLVLPATPYLGSLKLGLKTALAAARPADTFGRAYDVTRPPHNPNTTTGGNVYVLRHNTTVDVVLQNANALQHNVSEVHPWHLHGHDFWVLGYGEGAYRGDAADAARLNLANPPLRNTAVIFPYGWTALRFVADNPGVWAFHCHIEPHLHMGMGVIFAEAIDRVGKVPKEAVSCGATATALMNGDHL

SEQ ID NO: 6868 - protein, 1213 aa, Oryza sativa
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRLREREMKGKGQRTDAGAQLSTNRARMSVKGRAPPPEEGKKNGEKMAAAAAIPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRARSSHNYRRRLGAMDAINEWRLPKVSEEEDEAVDQTDWQADTLSSRISSARDWNFEAGGAYEGSDHNGVQRMGRWPQGSAVKHKENFVHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLPRFPPQQGGGNIGERQGQGQFRPGTPSYVQEQRPPPQSSSSHEALQAGERQQANNNSSGSSRQQRQTDTATVASRREPMSK

SEQ ID NO: 6869 - protein, 514 aa, Oryza sativa Japonica Group
RNHTRVNDDTRAGAMGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 6870 - protein, 207 aa, Candida albicans SC5314
MPPPDKARRDVLISKALSYLLRHGAEKEKLSIDDQGYVKISDVLSHQRLKSLKTTRDDINRIVQENDKKRFTIKDDMICANQGHSLKAVKNDNLTPMTVDELNQLRIYHGTYRTKLPLIKSSGGLSKMNRNHIHFTCEQYSTCSGIRYNANVLIYINASKCIEHGIVFYKSLNNVILTSGDKDGKLSWEFIDRIVGLDGNEINKEQV

SEQ ID NO: 6871 - protein, 487 aa, Oryza sativa
MERRRGGGGGGGGFFAALREEVARGLSPARARGRSRSDAAELAAAMRMSGGGGGGGEMLAPLMEGPDPESGDGEGGGGGGGGGGGGGGGGRGARGRRGEGWGQWVRGQLSRTPSSVAAAAAGAGAARNDLRLLLGVMGAPLAPVHVSAAEPLPHLSIKDTPIETSSAQYILQQYLAASGGQKLLASVRNAYTMGKVRMVATEFETAGRLVKNRNAARCAEPGRFVLWQMAPEMWYIELAVGGSKVHAGCNGKLVWRHTPWLGAHAAKGPVRPLRRALQGLDPLTTASMFAGARCIGERKVNGEDCFILKLCTEPETLKARSEGLAEIIRHVMFGYFSQRTGLLVHIEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELSHGEKSKVGPPPGHRAKVAALEKAVDGKVAWSGTILEDHN

SEQ ID NO: 6872 - protein, 183 aa, Zea mays
  misc_feature (28)..(28): Xaa can be any naturally occurring amino acid
  misc_feature (88)..(88): Xaa can be any naturally occurring amino acid
  misc_feature (104)..(104): Xaa can be any naturally occurring amino acid
  misc_feature (117)..(117): Xaa can be any naturally occurring amino acid
  misc_feature (156)..(156): Xaa can be any naturally occurring amino acid
KRPTTRRLASSMFFSADAITSPAQATMXTPFTGLKSSAAFPDTPKRNNYITSIASNAGRVSCMKERPPVVKKNDNTLSLSFLIVTVSXIAVIECKYLLHNKRIXCVEFELEHGFVYXREHVNTPGYYDVRYWTMSNLPLIGCTDSAQVLNEVQECXIYDPNAFMTIILFYNNRQVQCISFIAY

SEQ ID NO: 6873 - protein, 507 aa, Mycobacterium tuberculosis H37Rv
MTVFSRPGSAGALMSYESRYQNFIGGQWVAPVHGRYFENPTPVTGQPFCEVPRSDAADIDKALDAAHAAAPGWGKTAPAERAAILNMIADRIDKNAAALAVAEVWDNGKPVREALAADIPLAVDHFRYFAAAIRAQEGALSQIDEDTVAYHFHEPLGVVGQIIPWNFPILMAAWKLAPALAAGNTAVLKPAEQTPASVLYLMSLIGDLLPPGVVNVVNGFGAEAGKPLASSDRIAKVAFTGETTTGRLIMQYASHNLIPVTLELGGKSPNIFFADVLAAHDDFCDKALEGFTMFALNQGEVCTCPSRSLIQADIYDEFLELAAIRTKAVRQGDPLDTETMLGSQASNDQLEKVLSYIEIGKQEGAVIIAGGERAELGGDLSGGYYMQPTIFTGTNNMRIFKEEIFGPVVAVTSFTDYDDAIGIANDTLYGLGAGVWSRDGNTAYRAGRDIQAGRVWVNCYHLYPAHAAFGGYKQSGIGREGHQMMLQHYQHTKNLLVSYSDKALGFF

SEQ ID NO: 6874 - protein, 351 aa, Listeria monocytogenes EGD-e
MYKGLLEKYKEYLPVTDKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEAKASGLPRMHGFEAEGAAAIVQGKPIDNPETIATAIRIGNPASWGLAEAARDESGGYIHSVTDDEIVNAYKKIAAQDGVFIEPGSAASLAGVIQHVANGTIKKGETVVCVFTGNGLKDPDTAMSVHEIPISHVDDIEAMRTHLRSGVKA

SEQ ID NO: 6875 - protein, 475 aa, Triticum aestivum
PIEQVCTKKQAGTGPEFPGYRRPTRPVRRWFLGYTCCDACGRLFVKGNYCPVCLKVYRDSEVIPMVCCDVCEKWVHIECDGISEEKYQQFQADQNLQYTCASCRGECSQIRDAEDAVRELWKRRNIVDHDLMVSLRAAAGLPSLEDVTPCPNSDDERLGALVLKNDGRNTLKFSFKSNSSKPPLDQSEQEKNVPKNSGTNKKHSKKKGNQGNKSVADPNEIFLERRHEVKSMSSHLGDHTVDVNHERNSFKNNENVFVLSSTRSSEKDLKSTSAKAATNSADMIPKVKIKGSKVPSLHFKDIGEENNAKGDTGKGTKLVIHLGTRHKSKSGSPKSEMSNSHKEQELGLMHGGKIDVTSHFKSSKSSLVPNSARGENYAYNMRNTIQDEKIASKLPADDKKKIEDAVDAAIQWLDANQLGEVDEFEDKMKELEGLCNPIIAKMYQGAGADMPGGMDEDAPAASGGAGPKIEEVRLS

SEQ ID NO: 6876 - protein, 381 aa, Fulvimarina pelagi HTCC2506
MKADYYETLGVSRNVDDRELKSAFRKLAMKYHPDRNPGDTDAEARFKELGEAYEVLKDPQKRSAYDRFGHAAFQNGGGGGAGGFRGDFSSSMADIFDDIFGEMMGGRGRARQSGGTSGRERGSDLRYNMEISLAEAFSGKTAEISVPTTIQCDVCTGSGAKPGTTPSSCPTCGGVGRVRAAQGFFSIERACPTCQGRGSVITDPCNKCGGDGRLPEERTLQVNIPEGIEDGTRIRLAGEGEAGLRGGPAGDLYIFLSIAPHEFFQREGADLYCSVPVSMTKAALGGAFEVQTIDNGTARVKLPEGTQTGKQFRLKGKGMPVLRSPQTGDLFIQVMVETPQNLSKRQRELLEEFDEIGSKDNSPQSNGFFSRMKDFFENLSD

SEQ ID NO: 6877 - protein, 501 aa, Gloeobacter violaceus PCC 7421
MQSSDPAIRFRAMSAVQPQLEALIDQLDTIRSHAESLKQQFAEHLQHVHPNFADSAHNLIDYLALRQFDLREIQEQLSGLGLSSLGRTEAHTMASLNAVVQVLERLAGSGGEVVSFADDYARGRDLLTAHTEVLLGPRPATRATRIMVTLPSEAEGDYRLLCALIRAGMNCARINCVHDSETVWERMVGNIRRAEREVGRACRILMDLGGPKLRTGPLAEPLTLRKGEGLVLCRDAEEGRSACEDSPARVVCAVSGIYGGVQVGEAVLFDDGKIESVVRGVAQDEIQLEITRADDKGSRLAADKGINFPESRLKLRGLSEQDLEHLDFVARRADIVGMSFANEPEDVFALQAALGERGAGHLGILLKIETRRGFEQLPRLILAAMRSYPAGVMIARGDLAVECGWERTAEVQEEILWLCEAGHMPVVWATQVLEKLAKKGLPSRAEITDAAMSQRAECVMLNKGPHIVEAVHSLADILCRMQEHQHKKTATLRSLKVSNLV

SEQ ID NO: 6878 - protein, 311 aa, Zea mays
MGLGEAAGRLLAAVDWEREAYPAYDDFLALPAFVLFFPTVRFLLDRFVFKWVAMRLIHGQGHQRANNETEEARKKIRKFKESAWKCVYFLSGELLSLSVTYNEPWFTNTRYFWVGPGEQVWPDQKIKLKLKAVYMYAAGFYTYSIFALMFWETRRSDFGVSMSHHVATVVLIVLSYVFRFARVGSIVLAIHDASDVFLEVGKMSKYSHCDWLANVSFLFFVISWVLLRLTYFPFWILRSTSYEVLLTLDKKKHNFDGPIYYYVFNSLLFSLLVLHIYWWVLIYRMLVRQIKTRNVGDDVRSDSEGEDDHED

SEQ ID NO: 6879 - protein, 354 aa, Blumeria graminis
MGCGLSTEEKEKKARNEEIENQLKRDKILQRNEIKMLLLGAGESGKSTILKQMKLIHEGGYSRDERESFKEIIFSNTEQSMRVILEAMESLELPLDDQKAEYHVQTIFMQPAQIEGDNLPPEVGTAISALWTDAGVQDCFKRSREYQLNDSARYYFDNIDRIAQPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDFEGGDDYALACDYILNRFVSLNHHETKQIYTHFTCATDTTQIRFVMAAVNLDIIIQENLRLCGLI

SEQ ID NO: 6880 - protein, 336 aa, Vibrio fischeri ES114
MKVLVTGGMGYIGSHTCIQMIEAGIEPIILDNLGNSKVAVLDCIEALTHVRPVFYQGDIRDEAFLDSIFAEHSISSVIHFAGLKAVGESVAKPLEYYDNNVNGSLVLARSMRKANVKSIVFSSSATVYGDPAIVPITESSPTGATTNPYGRSKYMVEECFSDLFDAENDWSITLLRYFNPVGAHPSGTMGEDPQGIPNNLMPFIAQVAVGRRESLSVFGNDYPTPDGTGVRDYIHVMDLADGHIAALKAVGEKSGLHIYNLGTGKGSSVLEMVEAFSQASGKSVPYTLCPRRAGDIAECWASTEKAEKELGWKATRNVMEMSADTWRWQSNNPEGY

SEQ ID NO: 6881 - protein, 384 aa, Vibrio fischeri ES114
MTNLIKNVKDAFNSVLSYAPTHIVQAPGRVNLIGEHTDYNDGFVLPCAINYQTVVAAAKRDDNIVRVVSVDYGNETDEFDITQEITFQENKMWSNYIRGVVKCLIDRGYEFKGADISVSGNVPQGAGLSSSAALEVVIGQTFKELYNLNISQAEIALNGQQAENEFVGCNCGIMDQMISAEGNENHAMLLDCRSLETTAVSMPEDMSVVIINSNKKRGLVDSEYNTRREQCEEAARIFGVKALRDVTIEEFNAKAHELDEMVAKRARHVITENDRTEEAAKVLASGDMKRMAVLMAESHASMRDDFEITVSEVDTLVDIVKNVIGAEGGVRMTGGGFGGCIVALVPPMLVDEVKAAVEELYEAKTGLKESIYVCQATNGAGLVL

SEQ ID NO: 6882 - protein, 193 aa, Bacillus cereus ATCC 14579
MNTIPYVVEQTKLGERSYDIYSRLLKDRIIIIGSEINDQVASSVVAQLLFLEAEDAEKDIYLYINSPGGSTTAGFAILDTMNLIKPDVQTLCMGFAASFGALLLLSGAKGKRFALPNSEIMIHQPLGGAQGQATEIEITAKRILKLKHDINKMIAEKTGQPIERVAHDTERDYFMTAEEAKAYGIVDDVVTKK

SEQ ID NO: 6883 - protein, 402 aa, Ralstonia solanacearum GMI1000
MTTSRIAARVRRIKPSPSTSAADRANELRRQGKSIVNLVVGEPDFDTPQHIRQAAVQAIERGATRYTLMAGTVELRQAIVDKMARENDLHYAMNEIIATNGAKSAIYSALAITLEAADEVLIPAPYWVSYPDMVLACDGTPITLPCPEHDGFKLTPARLEAAITARTRWLILNSPSNPTGASYTLDEYRALADVLARHPHVLVMTDDIYEHIRFDTVRTPHLLNAAPELRDRTLVINGVSKTYAMTGWRLGWVAGPRDLIQALDTFLSQSAGNCCSISQAAAAAALNGDQRFVAESVAVYKQRRDTTLARLNAIPGLTCRSPDGAFYLYVNCAGLIGKKTPEGKTLDTDTDVVMYLLEREGVAIVAGTAYGLSPYFRMSIATALETLEEGCRRIERAVLALA

SEQ ID NO: 6884 - protein, 122 aa, Triticum aestivum
  misc_feature (6)..(7): Xaa can be any naturally occurring amino acid
  misc_feature (11)..(11): Xaa can be any naturally occurring amino acid
  misc_feature (26)..(26): Xaa can be any naturally occurring amino acid
  misc_feature (31)..(32): Xaa can be any naturally occurring amino acid
  misc_feature (35)..(35): Xaa can be any naturally occurring amino acid
  misc_feature (37)..(37): Xaa can be any naturally occurring amino acid
  misc_feature (39)..(39): Xaa can be any naturally occurring amino acid
  misc_feature (48)..(48): Xaa can be any naturally occurring amino acid
  misc_feature (54)..(54): Xaa can be any naturally occurring amino acid
  misc_feature (58)..(58): Xaa can be any naturally occurring amino acid
  misc_feature (63)..(63): Xaa can be any naturally occurring amino acid
  misc_feature (68)..(69): Xaa can be any naturally occurring amino acid
  misc_feature (71)..(71): Xaa can be any naturally occurring amino acid
  misc_feature (76)..(76): Xaa can be any naturally occurring amino acid
  misc_feature (78)..(79): Xaa can be any naturally occurring amino acid
  misc_feature (85)..(85): Xaa can be any naturally occurring amino acid
  misc_feature (90)..(92): Xaa can be any naturally occurring amino acid
  misc_feature (94)..(94): Xaa can be any naturally occurring amino acid
  misc_feature (96)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(106): Xaa can be any naturally occurring amino acid
  misc_feature (115)..(115): Xaa can be any naturally occurring amino acid
RLKEEXXATPXTGGEMVFFPLLVGAXLDGLXXLQXRXGXDDPNYPYYXKLRCEXCGEXSAKNXCVSLXXVXQLPTXKXXANLLQXCKLCXXXGXIXXXPGXGXTXXGEQSQKGGXRPVLMGF

SEQ ID NO: 6885 - protein, 220 aa, Bacillus cereus ATCC 14579
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNMIIDCIFPNHISNPVHLHTQLKMITGVVETGLFISMTSTAIIGTKNGIKKL

SEQ ID NO: 6886 - protein, 413 aa, Arabidopsis thaliana
MGSGRYLDDPLTFTRNPPSSSSPITESSFLAESISRSGSFESGSLRGGDGDCFSDVDFALDKLAGTVQFYERHVFLCYKKPSVWPARIEASEFDRLPRLLSSVISARKSSMKKETLLTICEGHDGSETSNGDVLIFPDMIRYRRLTHFDVDTFVEEVLVKGVEWLPGNPESLSSSYVFVCCHGSRDRRCGVCGPSLVSRFREEIDSCGLRGEVSVSPCSHIGGHKYTGDVIIYGLNINQRVTGHWYGCVTLEDVPLLLEQHINKGEIVDRLWRGEMGLPEEDQKKTQEQRLQLNSEKISNREVTQESVNNSICCQSRAVPELNGSGCQQNGNSSYCLEEIHTEKNTSERVTSVKNASLRIGSSENGSSGGFKVCAVMSMWLETWEREDTYAALAVACAAASVAIAYNCYKQLK

SEQ ID NO: 6887 - protein, 152 aa, Triticum aestivum
  misc_feature (90)..(90): Xaa can be any naturally occurring amino acid
  misc_feature (113)..(113): Xaa can be any naturally occurring amino acid
  misc_feature (133)..(133): Xaa can be any naturally occurring amino acid
MDAAGARPSAPSAAAAAVAGASVADEPRDARVVRELLRSMGLGEGEYEPRVVHQFLDLAYRYVGDVLGDAQVYADHAGKAQIDADDVRLXAIHAKVNFSFSQPPPREVLLELXRSRNRMPLPKSIAPPGSIPXPPEQDTCWPTTNPAPFNRN

SEQ ID NO: 6888 - protein, 300 aa, Bordetella petrii
MTDTPDPAAVSSPAIKAAVLSEALPYIRRFHGKTIVVKYGGNAMTEERLQRSFAHDVVLLKLVGLNPVVVHGGGPQIDDALRRIGKQGTFVQGMRVTDAETMEVVEWVLGGQVQQDIVMMINEVGGKAVGLTGKDGMLIQARKKLMANKENPQEPIDIGFVGDITQVEPAVVKALQDDQFIPVISPIGYGEDGTAYNINADVVAGKMAEVLGAEKLLMMTNTPGVLDKSGKLLRSLSAQTIDELFADGTISGGMLPKIASSLDAAKNGVNSVHIVDGRVPHCLLLEILTDQGVGTMISSH

SEQ ID NO: 6889 - protein, 354 aa, Pneumocystis wakefieldiae
MGCSPLQSYKQDTSRSREIELYLRRDQEEAIHEAKILLLGAGESGKTTILKQMKLIHLSGFTLKEREYYRTIIFSNMLQAMRLIIEAMEEFDICFERRENEQYLDLLLQERELTDRENLPPEYYRPFISLWEDAGVMRAVNRGNEYALHDNCFSFFENIHRLFERKYIPTDQDILRCRLKTTGITETCFKVSRLTYRMIDVGGQRSERRKWFHCFENVTAVLFLVAISGYDQCLAEDIGANQMQEALVLFDSICNSQWFINTSIILFLNKIDLFRVKLHVSLISNYFPDFNSEHQTDYRASCLFFRQKFLKLNRNHQKTIYTHFTNATDTTLLKSVMISVTDIIFNRNLQNLML

SEQ ID NO: 6890 - protein, 624 aa, Oryza sativa Japonica Group
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERNEENATRRKLLASKQKRSQKNRMLLSGTSESPLENVTMPKSHPDNITVPHRPVAPRSSSPQPPLPSEPIPSPAPSMPSPAPSVSTTTNGTSGQENKSKTAIYASIGGVACLVVVAMSAALILCYRHRKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSCLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 6891 - protein, 76 aa, Mannheimia succiniciproducens MBEL55E
MSIEERVKKIIVDQLGVKEEEVKSEASFIEDLGADSLDTVELVMALEEEFDIEIPDEEAEKITTVQSAIDYVQNNQ

SEQ ID NO: 6892 - protein, 354 aa, Pneumocystis carinii
MGCCFSATYNQDTLRSKEIESYLRQEQEHACHEAKILLLGAGESGETTILKQMKLIHLSGFTLKEREYYRTIIFSNMLQSMRLIIEAMEEFDICFERRENEQYLDLLLQERELTNRENLPPEYYRPFISLWKDAGVTRAVNRGNEYALHDNCFYFYENIHRLFERKYIPTDQDILRCRLKTTGITETCFKVSRLTYRMIDVGGQRSERRKWIHCFENVTAVLFLVAISGYDQCLTEDIGANQMQEALVLFDSICNSQWFINTSIILFLNKIDLFKVKLHVSLISNYFPDFNNENQTDYRACCLFFRQKFLRLNRNHQKTIYTHFTNATDTTLLKNVMISVTDIIFNRNLQNLML

SEQ ID NO: 6893 - protein, 68 aa, Physcomitrella patens subsp. patens
MVDAAALIIGVILFVLLSPGLLLQIPGDDRPIEFTNQRTSIASIVVHAVVFTLVFYLLQLLFHVHGGM

SEQ ID NO: 6894 - protein, 331 aa, Zea mays
  misc_feature (148)..(149): Xaa can be any naturally occurring amino acid
  misc_feature (199)..(199): Xaa can be any naturally occurring amino acid
MRARQMTARSALDEVTDTGAFDRSPSTFRSSVSRDGRFPAVAGRYHLYVSYACPWASRCLAFLKLKGLDHAIGVTAVKPIFERTKESDEHLGWVFPAAADEEPGAEPDPLNGARSVRELYEIASSNYAGKPTVPVLWDKQLKTVVNNXXSSEIIRMLNAEFNGIARNPGLDLYPAHLRASIDEANELVYDAINNGVYKXCGFAKKQGPYDEAVTRLYEALDRCEEILGKRRYICGDQLTEADIRLFVTLIRFDEVYAVHFKCNKKLLREYPNLFNYTKDIYQIPGISSTVNMEHIRKHYYGSHPSINPYGIIPAGPNIDYNAPHDRERFSA

SEQ ID NO: 6895 - protein, 458 aa, Brassica napus
IAAMERGIFVSCSAGNAGPSPYSLSNVAPWITTVGAGTLDRDFPAIAILGNGKNYSGVSLFKGDALPDKLLPFIYAGNASNATNGNLCMTGSLIPEKVKGKIVMCDRGVNARVQKGDVVKAAGGVGMILANTAANGEELVADAHMLPATTVGEKAGDIIRRYVLTDPNPTASVLIQGTVVNVQPSPVVAAFSSRGPNSITPNILKPDLIAPGVNILAAWTGAAGPTGLPSDPRRVGFNIISGTSMSCPHVSGLAALLKSAHPEWSPAAIRSALMTTAYRSYKDGKPILDIATGKPSTAFDHGAGYVSPTIATNPGLVYDLTTVDYLGFLCALNYTSSQIRSVSRRNFTCDPSKTHSVADLNYPSFAVNVDGSGAYKYTRTVTSVGGAGSYKVKVISESTAVKISVAPAVLNFKEVNEKKSYTVTFTVDSSKASGSSFGNIEWSDGKHVVGSPVAITWT

SEQ ID NO: 6896 - protein, 446 aa, Aeropyrum pernix K1
MAGDSSSDDIGGARIIEIYRRYGGKIEVMPKVPVSGVEDFAIWYTPGVAEASIRINKDPDESFELTSRWNMVAIVTDATRVLGLGKLLPEAAYPVMEGKALIFKLFGGVDAVPIVHRRREPGAFASLVKDLEPSFGGVNLEDIESPKCFYLLDFLRMELEIPVWHDDQQGTAAASLAGLINAFKIVGKNLRESRIVLLGAGAANIALYRFLKAYGVNPRNIVVVDSKGVLHPEREDMDRLLFSNRYKYEIALETEGGGLAPGSSLEEALRGADALVAASRPGPGVVKKEWIRGMSRDPIVFALANPTPEIWPWEARDAGARVVATGRSDLPNQVNNALVFPGVFRGALDVRSRAITDGMAIAAAEEIARYTEEEIGIEEDRILPPITDWQVHYRVAAAVAWAASREKVARKPRTYAEELENARAIIETTRRKYGALLSAGLIERLV

SEQ ID NO: 6897 - protein, 779 aa, Arabidopsis thaliana
MQSSVYRDKASSIAMILETQRNVEFPHRIVDKRPRKRPRLTWDAAPPLLPPPPPPTVFQPPLYYGPEFASGLVPNFVYPNMFYNGLPRQGSPPWRPDDKDGHYVFVVGDTLTPRYQILSKMGEGTFGQVLECFDNKNKEVVAIKVIRSINKYREAAMIEIDVLQRLTRHDVGGSRCVQIRNWFDYRNHICIVFEKLGPSLYDFLRKNSYRSFPIDLVRELGRQLLESVALYSDFAHSILTDMHDLRLIHTDLKPENILLVSSEYIKIPDYKFLSRPTKDGSYFKNLPKSSAIKLIDFGSTTFEHQDHNYIVSTRHYRAPEVILGVGWNYPCDLWSIGCILVELCSGEALFQTHENLEHLAMMERVLGPLPPHMVLRADRRSEKYFRRGAKLDWPEGATSRDSLKAVWKLPRLPNLIMQHVDHSAGDLIDLLQGLLRYDPTERNERKRERFVPNFFLSVVLVFCVHFPTTTTVAPSMAIVKTQREVRPINDQNAVVVSAARREYSESKGFIFFFFTYLFTTSSGFVLQISKLYHPSPKVHTFPSLQIHMHHSNNRRGSAFGESPSQIAGDCSSHRASAVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 6898 - protein, 247 aa, Nitrosomonas europaea ATCC 19718
MLLEHKIALVTGASRGIGKAIALELGKHGATVIGTATSETGAGHISQYLSEARISGMGLIMDVSNIEHIKSGIETIQQSLGDVAILINNAGITRDNLLARMKDDEWDNVIQTDLKSVFCLSRAVLRTMMKARSGRIINISSVVGATGNPGQTNYAAAKAGMIGFSKSLAKEIGSRNITVNCVAPGFIDTDMTRSLSPDQQQSLIQHIPLGRFGRPEDVAAAVVFLASPAADYITGATLHVNGGMYME

SEQ ID NO: 6899 - protein, 81 aa, Nitrosomonas europaea ATCC 19718
MEITEIEQRIKKIVAEQLGVNESDVKNESSFVSDLGADSLDTVELVMALEEEFECEIPDEQAEKINTVQEAIDFVAANAAQ

SEQ ID NO: 6900 - protein, 136 aa, Vitis vinifera
MAGRGKSLGAGAAKKATSRSSKAGLQFPVGRIARFLKAGKYAERVGAGAPVYLAAVLEYLAAEVLELAGNAARDNKKTRIVPRHIQLAVRNDEELSKLLGSVTIANGGVMPNIHNLLLPKKSSSSKGGAAAADDDN

SEQ ID NO: 6901 - protein, 742 aa, Magnaporthe grisea 70-15
MSAASLSILGSKGESTRTLLRVIILFLIAGAAISSRLFSVILDPWFNFRATKYLVANGFYDFWDWFDDRTWHPLGRVTGGTLYPGLMVTSGAIYHALRALTVPVDIRNVCVMLAPVFSGLTAFSAYLLTNEMTTSSSAGLLAAAFMGIAPGYISRSVAGSYDNEAIAIFLLVFTFYLWIKALKLGSMLWGALCALFYGYMVASWGGYAFITCLLPLHSFVLICMGRFSTRLYISYTTWYALGTLASMQIPFVGFLPIKTSEHMPALGIFGFMQLMGFLDYVRSAIPGRQFRTFLVLFSAAIFVVGLSVLALATSAGYIAPWSGRFYSLWDTGYAKIHIPIIASVSEHQPTAWPAFFFDLNFLIWLFPAGVYLCFQNLRDEHVFIVVYAVFGSYFAGVMVRLMLTLTPVVCVAAAIAASSILDSFVSLKSPTPASDDADAKEAASKKAAKEAAKGGLRSTNKPVVGVYTNLSKGLVTTAMTIYLLIFVLHCTWVTSNAYSSPSVVLASRLPDGSQHIIDDYREAYQWLRQNTKEDARIMSWWDYGYQIGGMADRPTLVDNNTWNNTHIATVGKAMSSSEEVSYPIMRQHEVDYVLVVFGGLLGYSGDDINKFLWMVRIAEGIWPDEVKERDFFTNRGEYRVDDHATDTMKNSLMYKMSYYNYNTLFPPGQAQDRVRGSRVPDVGPVLNTIEEAFTSENWIIRIYKVKDLDTFGRDHAAAAAFDRGHKKKRVPKKKGPRVLRVD

SEQ ID NO: 6902 - protein, 566 aa, Bacteroides thetaiotaomicron
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQIKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWSKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFIKNCSNGEKETKSLPKVSSNISHRIKVSTFTNPNTVINQSLFS

SEQ ID NO: 6903 - protein, 1638 aa, Shewanella sp. MR-4
MLTHNKVAVMVATALYVGSGIASTSALNTVEPSSAWGPAPADYAPKPLAEDTFTWENQVNKTIKKQHAVFNAEADIQGVHKYIVQLSDAPISTYQGGVGQLAATQTTVAKARNTKAPLNLNQPQLKAYNNYLAEKRAAVVSQAQTLQGLDLKVGREFSVALNGFVTEMTQEQAAKLAKVPGVKRITREKIYELKTFSTPDQTGATSVWSNSALNSSNMGEGMVVGVIDTGINADHPSFAAVGGDGYKHTNPLNGKYLGDCAASPEYCNDKLIGIYSYPEITKAYTDPVFSETRPAIGLDYNSHGSHVAGTIAGNVIKDLPHTITEYTPDGKGIETGLVLPQVSGMAPHANIIAYQVCWPGGSGDPYAGCPTSAIVAAIEQSAIDNVDVINASLGGLEEDPWSEPMEQAFLNAAASGVFVAVAAGNSGPELMTADHSSPWVTTVAAHTADQIVTFKANGVENLSGGATTAPMNIIGSTKNFQSVTGLVVDAKNFKNPNETITSNIKNCDKPFPAGTFDLADNPATTDIDESQQDVIVLCSRSSLPLLNKAANVQAGGGEGIVIASLSPTQDNNLPGVPYAIPGTLVKYSDGNLLRTWLASGAGHMATLTAGGAELSAVDKERVANFSGRGPSYFGIDTLLVDIAAPGVDIFAPASDDQPFTKNPVTGQWATLSGTSMASPHVAGAATILRQSHPDWTPMQVQSALMMTASNTLTNASFLDNYSDYGDVSALQDAGAGRMHVELADKVGLLLDESMDNMAAANPNLGGRPKNLNTAYMVDTNCPNECSFVRTFTATEDGHWTVDSETWMGNFDISVQPTSFSIKAGETQSLVIKAKNKKNVSGAIYLDYTGSQGQVRLVSDNPNSPVLELPVWTYEGDSGLPNYVKINAHRKSATLNVGPFNTAEITDFTARSYGLAKGDDKTIHTYIDTTGGDPFDTVEVDGVQVNPNHIEWTEVPEGTKLLAGSVVGNDYGRVLVFMGQDSDGDGVPSMDETLCMSTNYSIANFCTISNPQAGRYFTVYMNLASLSYGQVDQGRDISISTALVTGDEGNLTVKAPAQIPGYSEYKLELAYQLPEMEVGNTYFGGFDIGSNANDAGNLGFVPVIVNQIDKDVTFTASRETAIPGEVIEFQVNVIANNEEQARDFALNASFPDAIQIIPDSVVASHATPGTPVLENNALSLTGVQETTKDVVRNYKITNNQNDPMCSLTAAKSPYPGYLELKENLGWKTLEGVEGAYYNEFQYKLKDLMNSEADISFPFFNKYFVDTIKLNPAGLVTFNTARRTPVSHVEFPSGTLGLLPMPEFIVAPFWTGDNRIPKRFDAGYGQYHLNAGITPTYTIARDWLVLEWDNVERANTPGQLVDFEMFLRMNINYEPGNYEMLFAYDNLQMVDDKGSIGFKAADGRIIVDGDTPMDLNLGDSVAYNNLGSVLSNKFVVCMDYTGPEESQFNLQFKAYVSEKAAGTTQTLKVENHLVGADSEVLELQLAVAGNIQLAAIADKMVKENESISFDVLYSDENQVSNMIEVMGDNFTTTVNGNTVTLTPTANFHGETRVTVMVKDSVNPEDAASTSFNLVVESDGIEYGCTNSSATNYDASANTDDGSCKLPAVIVEPEEKSSGGALGWLALGLLPLAYRRNRKTH

SEQ ID NO: 6904 - protein, 555 aa, Atriplex dimorphostegia
MWSQLSSLLSEKMDALATSDHASVVSMNLFVALLCGCIVIGHLLEENRWMNESITALLIGLSTGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVANDATSVVLFNAIQSFDLTRIDHRIALQFMGNFSYLFIASTILGAFTGLLSAYVIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNLAKKSHGEKVTFNQQIVIWWAGLMRGAVSMALAYNQFTRSGHTQLRGNAIMITSTISVVLFSTMVFGLLTKPLIMFLLPHPKHFTSCSTVSDVGSPKSYSLPLLEGNQDYEVDVGNGNHEETTEQRTIVRPSSLRMLLNAPTHTVHHYWRKFDDSFMRPVFGGRGFVPFVPGSPTEQSTNNLVDGT

SEQ ID NO: 6905 - protein, 471 aa, Anabaena sp.
MVTTAEKTNIGYITQIIGPVVDVKFPNGKLPQIYNALTIKGTNEAGQQLNLTVEVQQLLGDNQIRAVAMSSTDGLVRGLEVVDTGAPISVPVGKATLGRIFNVLGEPVDNRGPVNNQETLPIHRPAPKLTELETKPSVFETGIKVVDLLTPYRRGGKIGLFGGAGVGKTVIMMELINNIATQHGGVSVFAGVGERTREGNDLYNEMIDSKNALVYGQMNEPPGARMRVGLSGLTMAEYFRDVNKQDVLLFIDNIFRFVQAGSEVSALLGRMPSAVGYQPTLGTDVGQLQERITSTTEGSITSIQAVYVPADDLTDPAPATTFAHLDGTTVLSRGLASKGIYPAVDPLGSTSTMLQPNIVGDEHYNTARAVQSTLQRYKELQDIIAILGLDELSEEDRLLVARARKVERFLSQPFFVAEVFTGSPGKYVKLEDTIKGFQKILSGELDDLPEQAFYLVGDINEAIAKAEKIKG

SEQ ID NO: 6906 - protein, 1782 aa, Azoarcus sp. EbN1
MSHPDALDLGPLAWVKTEIDHALARADESLEQALGASAAAACVQFAQTHLHQACGALSIVGLDGLSQFASSLDQLLGVLARAERPIDAATVELARRALATIGNYLEELVHGTPDQPLRLLSLYEEIGAARSGGPLSPAELFFPDLSLRPARRGTAPAGLNEDVRQQQLRAHRALFQRGLLQWLRTPADAAGPHTMLAAVSEIEALHTGTPVGVLWYAAQAFLETLIHQDLPARPEIKRLCSQLDAQLKRLSDIPVVVPDRLVRELLYWTSQAPARTDHQKDVRATWQLDALLPQPGATVSAAPLAALLKTLQGLMSAAKQAWDGFAEGQAVELPRFDAHLAELAAQASRLGRPALDRLLRGIVEFIAWLRKDPLHCNDAIALEIATALLLCEAGLERGAPAAGFSAHVDATVARLEALARGEPVAAVERSPAVETARRAQERDALGQLSREILSSLAQVEQVLDDFFRNEQKRAPLASLAKPLRQIGGALALVGDAPAVALVDTAADTIARLADAGQSLDHGEHERLARRLSALGFYIEALQHGPAQLERFLDPQDVEDTPVPASASATQAAEPPPAPPAAAAAELDAELLAIFIEEAHEVLATIGERLDLSCRDADVPEHLVAIRRGFHTLKGSGRMVGLHDLGETAWEIEQTLNRWLQLEWTASGALHRLIDAARATLLEWVHDLEAGRIQARDVTALVAEAQRLRSDESAIEASPPAEPQAISEPQAISEPQAISEPQAISERPAITESPAEITLPENEPPPLFPGGSAESEALPACAPLDEATADAFAPFTSFDDDDLLAGLEIESSVFDFGDLPASDPETILLPFEPEVSDLAPDASFEAAAEASETRNPAALPPAAEREVVHIGAAEISQPLYDLYIGEARQHLTVLHAELARLDANPTLIPAEEALRAAHTLAGISGTTRLMPLHELARGLEHALERLRDTAQAPTAEQTALLKSANDTLDAMLAEVVAHRMPLAVPELVEQLDGVGHETPLETGIEAAPGVRGDASHDNIIAVRPVEPGIVPSRPGAPVQDELDAQLLPVFLDEAAELLGELHAALRQWGTDAAVDAAQATARLLHTLKGSARMAGAMTLGQHVHHLESQLVAALDGGQEPASGLIDELTAGLDQAEQMIDAIAGGDSAQPAPAPDNAAPATPAEPEGASAAATLRVRADAVDRFVNQAGEIGITRTRVTGELRTLRRSLLDLTENVIRLRNQLREVELQADVQMQSRLARSDAHDGEFDPLEMDRYTRLQELTRMMAESVGDVTTVQQSLLRNLDGAELALNSQARLSRDLQQALMQVRMVPFDSLADRLYRVVRQSAKELGKRADLDLRGGRIEIDRSVLEHLVAPLEHLLRNAVAHGIEHPDARRAAGKGEIGQITLSVSQEGNEIAITLADDGGGLDYGRIAARARATGLLGADEAADEWRLTNLIFIPGFSTADSVSPLAGRGVGMDVVKSETAAAGGRIDVHAEVGRGTEFRIHLPLTLAVTQALLVRAGSRTYAIPSSMIVQVLELKVEPLDALRREGGTEWQDRHFAYRYLPQLLGERFTQPPEQRFNWVLLLRVGAQTLALHVDALRGNQEIVVKNAGPQLARIVGISGATVLGDGEIVLILNPVALASRRVAEAATSTANAGGKAPEPLEPFEVVPVRAPTVMVVDDSLTVRKITGRLLEREGYRVVVAKDGVEALERLLEAVPDAILSDIEMPRMDGFDLLRNIRAHERTRDVPVIMITSRLADKHREYAGRLGANHYLGKPYDENELLGLLRSHTGRAAVSA

SEQ ID NO: 6907 - protein, 230 aa, Photobacterium profundum SS9
MNLVADVFHSVAAKYDIMNDMMSLGIHRVWKRFTIDCSGVRRGNRVLDLGGGTGDLTAKFSRIVGGEGQVILADINNSMLKVGRSKLRDSGIVGNVGYVQANAEELPFPDDYFDCITISFCLRNVTDKEKALRSMYRVLKPGGRLLVLEFSKPIIEPLSKVYDAYSFYLLPKIGELIANDAESYRYLAESIRMHPNQETLKSMMDDAGFEQTNYYNLTGGIVALHRGFKF

SEQ ID NO: 6908 - protein, 433 aa, Listeria monocytogenes
MNWSPKTEAWQELKNTVPYIQKGKIHTVQEQVYISKGPQVKIGDTVMVGENKVLCEVISIEKENNMLLPFNQSDKVAYGDWVYVTDTKITIPADEFLLGKVLNASGDILNEEAGMAKFKQKMPLEAPPIHAFSRAEITDTLETGIKAIDGMLTIGIGQKIGIFAGSGVGKSTLLGMIARNAKADINVIGLVGERGREVKDFLRKDLGEDGLRKSVIVAATSDESHLMQLRAAKLATSIAEHFRDQGKTVLLMMDSVTRFADARRSVDIAVKDLPIGGKTLLMESYMKKLLERSGKTQNGSITGIYTVLVDGDDMNGPVPDLARGILDGHIVLTRELATKNHYPAIDVLGSVSRVMEEIVPENQWKTASKIREWMSIYQENELYFKLGTIEQTSDNAAIFTSKEKSYFIHQFLKQLRDESVTLEETSKLMETLV

SEQ ID NO: 6909 - protein, 261 aa, Yersinia pestis CO92
MTEVKIHSPAEIEMARAAGQAAAKVLEMIKPYVLAGITTDEIDRLCHDYIVNELKVIPANIGYHGYTRTVCTSVNHVVCHGIPSDKKLKNGDIVNIDVAIIKEGWYGDTSRMYFVGEPSVRAKRLVDITYQSMVAGIKAVRPGATLGDIGASIQQLAEGAGFSVVREYCGHGVGQEYHTAPQVLHYGIAQTGMLLKPGMIFTIEPMINAGKAATSVLSDGWTVVTKDRSLSAQWEHTIAVTESGYDLLTPWPEGTGEYEAI

SEQ ID NO: 6910 - protein, 330 aa, Oryza sativa Japonica Group
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVLGRQARIFYDFPGRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 6911 - protein, 193 aa, Oceanobacillus iheyensis HTE831
MNLVPTVIEQTNRGERAYDIYSRLLKDRIILLGSGIDDNVSNSIVAQLLFLEAEDPDKDISLYINSPGGSITAGMAIYDTMNFIKPNVSTICIGMAASMGAFLLTAGEKGKRFALPNSEIMIHQPLGGTQGQATDIEIHAKRIIDIKRRMNEIMAEKTGQPIEVIERDTERDNFMTADQSVEYGLIDKILERK

SEQ ID NO: 6912 - protein, 140 aa, Rickettsia typhi str. Wilmington
MTIQYTFSMIKPDVIKRNKIGQVNTYLENAGLKIVAQKMKFLTKYEAECFYDEHRARPFFNSLVEYITSGAVVLQVLKGEDAITLNRIIMGATNPAEAKEGTIRKDLGESIEANSIHGSDSENSAKREIKFFFSKSEIIE

SEQ ID NO: 6913 - protein, 188 aa, Streptococcus agalactiae A909
MLLLVDNYDSFTYNLKQYLSVYKEVFVIKNDDPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 6914 - protein, 1725 aa, Arabidopsis thaliana
MARGRIRSKLRLSLLYTFGCLRPATLEGQDSQPIQGPGFSRTVFCNQPHMHKKKPLRYRSNYVSTTRYNLITFFPKSLYEQFHRAANLYFLVAAILSVFPLSPFNKWSMIAPLVFVVGLSMLKEALEDWRRFMQDVKINARKTCVHKSDGVFRQRKWKKVSVGDIVKVEKDEFFPADLLLLSSSYEDGICYVETMNLDGETNLKVKRSLEVSLPLDDDESFKNFMATIRCEDPNPNLYTFVGNLEFERQTFPLDPSQILLRDSKLRNTTYVYGVVVFTGFDTKVMQNSTKSPSKRSRIERTMDYIIYTLLVLLILISCISSSGFAWETEFHMPKMWYLRPGEPIDFTNPINPIYAGVVHLITALLLYGYLIPISLYVSIEVVKVWQASFINQDLHMYDDESGVPANARTSNLNEELGQVHTILSDKTGTLTCNQMDFLKCSIAGTSYGVRSSEVEVAAAKQMAVDLEEHGEISSTPQSQTKVYGTWDSSRTQEIEVEGDNNYNTPRAPIKGFGFEDNRLMNGNWLRESQPNDILQFFRILAICHTAIPELNEETGKYTYEAESPDEASFLAAAREFGFEFFKRTQSSVFIRERFSGSGQIIEREYKVLNLLEFTSKRKRMTVIVRDEEGQILLLCKGADSIIFERLAKNGKTYLGPTTRHLTEYGEAGLRTLALAYRKLDEDEYAAWNSEFLKAKTSIGSDRDELLETGADMIEKELILIGATAVEDKLQKGVPQCIDKLAQAGLKLWVLTGDKMETAINIGLESLIYLEHKLESISVICFYPVIFMHKFPFMNCRFACSLLRQGMRQICITSMNSEGGSQDSKRVVKENILNQLTKAVQMVKLEKDPHAAFALIIDGKTLTYALEDDMKYQFLALAVDCASVICCRVSPKQKALVVRLVKEGTGKTTLAIGDGANDVGMIQEADIGVGISGVEGMQAVMASDFSIAQFRFLERLLVVHGHWCYKRIAQMICYFFYKNIAFGLTLFYFEAFTGFSGQSVYNDYYLLLFNVVLTSLPVIALGVFEQDVSSEICLQFPALYQQGTKNLFFDWSRILGWMCNGVYASLVIFFLNIGIIYSQAFRDNGQTADMDAVGTTMFTCIIWAANVQIALTMSHFTWIQHVLIWGSIGMWYLFVAIYSMMPPSYSGNIYRILDEILAPAPIYWMATLLVTVAAVLPYVAHIAFQRFLNPLDHHIIQEIKYYGRDIEDARLWTRERTKAREKTKIGFTARVDAKIRHLRSKLNKKQSNLSHFSAQDAMSNSLMHQTLETAFDLMEPRVGNKFRLGRKIGGGSFGEIYLGTNIQTNEEVAIKLENVKTKHPQLLYESKLYKVLQGGRDYNVLVIDLLGPSLEDLFNFCSRKLSLKTVLMLADQMINRIEFVHQKSFLHRDIKPDNFLMGLGRRANQVYVIDFGLAKKYRDSNHQHIPYRENKNLTGTARYASMNTHLGIEQSRRDDLESLGFVLMYFLKGSLPWQGLKAGNKKQKYEKISEKKVSTSIEALCRGYPSEFASYFHYCRSLRFDDKPDYAYLKRLFRDLFIREGFQFDYVFDWTILKYQQSQISTPPPRHHGPVVGPSSALPPAITSAERPSGGDEARPSGWSSGIPRRNSGQIFNSGSLAKQKAPVSSDPAISKDVVLSSSSFLRATGSSRRAAVSSSREAAVLGTDSEPSNPQIVEAGSGSNSKIPVSRNSPIVSSEINKLSSPSRATTSVMKNYEANLKGIESLHF

SEQ ID NO: 6915 - protein, 383 aa, Nitrosomonas europaea ATCC 19718
MSNRPRAVLVLADGTVFHGDSIGAEGITIGEVAFNTAMTGYQEILTDPSYCRQIVTLTYPHIGNTGVNDEDIESTTASRIIHAAGLVVRDLSLVTSSWRSRHTLPDFLKQHGVPAIAGVDTRKLTRILRTKGAQAGCIMTGHIDETEALRQAQAFPGLTGMDLARVVSCSQPWEFSEGAWSPETGYQAAGESRCRVAVLDFGVKRAILRKLVEHGCHVTVYPAQTRIDEILAARPDGVLLSNGPGDPEACDYAIDMARALLASKIPVFGICLGHQIIALAIGARTIKMKFGHHGANHPVLDVDSGRVMITSQNHGFAVDVDTLPANVRVTHHSLFDGSLQGFELTDHPVLCFQGHPEASPGPQDVNYLFSRFISRIVKNKQSA

SEQ ID NO: 6916 - protein, 196 aa, Neisseria meningitidis Z2491
MLLFIDNYDSFTYNIVQYFTELGQEVAVRRNDDITLEEIEALNPQYLVIGPGPCSPKEAGISVAAMRHFAGRLPIMGVCLGHQTIGEAFGGRIVRAKTLMHGKVSPVYHSGKGMFKGLPNPVTCTRYHSLVIERGTLPECLEITAWTEDGEIMGVRHKEYAVEGVQFHPEALLTEYGHDMLNNFLIEFQNFKPQKI

SEQ ID NO: 6917 - protein, 266 aa, Bradyrhizobium sp. ORS278
MGRLEGKVALVVGAGSIGPGWGNGKATAVTFARQGARVFCVDRNRDAAAETAAIIAGEGGQAEAYTADVSKAVEVEAMVKACLTAYDRIDVLDNNVGIAEMGSVVDVEEAEWDRVFAVNLKSAYLAMKHVIPVMIGQGGGSIINISSVASIRQVGISYVSYGASKAAMNQMTRTTAVEFAPKHVRVNAILPGLMKTPMVEHSAGLAASYAKGDVEEMWRKRDAQVPMGHMGDAFDVANAALFLASDESKYVTGITLVVDGGLTCRS

SEQ ID NO: 6918 - protein, 716 aa, Brassica rapa
MALSAFAFPSYITTKGGLTDSCCKSNSLSSSRSLSADLPSPCLRPNTSHSNRKAKVNASLAEKGEYYSNRPPTPLLDTINYPIHMKNLSTKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLRMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPVEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 6919 - protein, 434 aa, Vibrio fischeri ES114
MVCYNQRQLLSIHRFIMSFASLGLTKQILTTVAELGFKEATPIQEQAIPLVLQGHDVLAGAQTGTGKTAAFGLPLIQRLIESPIERHEESKVVRSLILTPTRELAQQVFDSLVSYTQNTELKVVVAYGGTSINVQKENLLGGADILIATPGRLLDHLHIKTITLNQAEYLVLDEADRMLDMGFIPDIKKILRKMPDERQTLFFSATFSKKVREIAYYMLNKPKEVQVTPTNSTAETVEQMVYPVDKHRKSELLAYLIGSRNWQQVLVFTKTKQGSDELVKELKKDGIKAASINGDKSQGARLRALEEFKTGKVRALIATDVAARGLDIEQLECVINYELPFKAEDYVHRIGRTGRAGHTGKAISLMSMDEEYLLKAIETLLDTRLPQEWLQGYEPDPNAPLREDRPRQSRGRSSDKRKMKAKLKIHANRGKNKR

SEQ ID NO: 6920 - protein, 133 aa, Triticum aestivum
  misc_feature (2)..(2): Xaa can be any naturally occurring amino acid
  misc_feature (7)..(7): Xaa can be any naturally occurring amino acid
  misc_feature (28)..(28): Xaa can be any naturally occurring amino acid
  misc_feature (33)..(33): Xaa can be any naturally occurring amino acid
  misc_feature (63)..(63): Xaa can be any naturally occurring amino acid
  misc_feature (69)..(70): Xaa can be any naturally occurring amino acid
  misc_feature (72)..(72): Xaa can be any naturally occurring amino acid
  misc_feature (75)..(77): Xaa can be any naturally occurring amino acid
  misc_feature (82)..(82): Xaa can be any naturally occurring amino acid
  misc_feature (85)..(86): Xaa can be any naturally occurring amino acid
  misc_feature (91)..(91): Xaa can be any naturally occurring amino acid
  misc_feature (95)..(96): Xaa can be any naturally occurring amino acid
  misc_feature (99)..(99): Xaa can be any naturally occurring amino acid
  misc_feature (103)..(103): Xaa can be any naturally occurring amino acid
  misc_feature (110)..(110): Xaa can be any naturally occurring amino acid
MXPTVMXSSATSVAPFQGLKSTAGLPVXRRSNXASLGSVSNGGRIRCMQVWSIEGIKKFETLXYLPPLXXEXLLXXXDYLIXSEXXPCLEXSKVXXIFXEHNXSPGYYDXRNWTMWKLPMFGCTDATQVINEV

SEQ ID NO: 6921 - protein, 274 aa, Azoarcus sp. EbN1
MTERMKISFLGGGNMATALIGGLAERGFASADIQAVDLQADSRARLAERFGIRTAPAVDDEVLACDVVVLAVKPQQMKAAVAPLTGRLARQVVVSIAAGLRLADVGRWLGGYHRLVRAMPNTPALIGAGITGLYADPSVDAAGRESAERILGAVGSTVWIADEAQMDAVTAVSGSGPAYVFHFIEALEAAAVSLGFDAATARQLALDTVLGAAKLAAGADEAPAVLRERVTSKGGTTEAALASMASSGVFDAIVRAVHAANVRGRELGEQLGKD

SEQ ID NO: 6922 - protein, 334 aa, Rhizobium etli
MSFNLRNRSLLTVQDYTPREFRYLLDLARDLKRAKYARTEQEHLKGKEICLIFEKTSTRTRCAFEVACSDQGANVTYLDPSGSQIGHKESFKDTARVLGRMYDAIEYRGSAQKGVETLAKYAGVPVYNGLTDEYHPTQMIADVMTMREHSDKPIAEIKYAYVGDTRSNMGHSLLIVGCLLGMDVRICGPRSLWPSEEYMKIAKVLQQASGARLLVTEDPREAVKDVDFIHTDVWVSMGEPKEVWRERIKLLTPYQVNQDLMKATGNPQTKFMHCLPAFHDTETTLGKQIAEDYGMDNGLEVTNDVFESEANVAFEQAENRLHTIKALLVATLGD

SEQ ID NO: 6923 - protein, 233 aa, Azoarcus sp. EbN1
MTSISANLQAVRRRVAAAARASGRTPEDVALIAVSKTQPAQSVAEAAHAGQRLFGENYVREGVAKAAELHARQLEWHFIGPLQSNKTRPVATHFHWVHSVDRLKLAERLSEQRGDELPPLNVCIQVNVGGEASKSGVAPGEVPALAAAVAKLPRLALRGLMCIPEAGGDEALLRARFATLRQLRDRLNDAGLALDTLSMGMSDDLELAIAEGATMVRVGTAIFGARSVREEQA

SEQ ID NO: 6924 - protein, 219 aa, Zea mays
  misc_feature (202)..(202): Xaa can be any naturally occurring amino acid
MGHSLSSHSKSTLSSSFAPPARDYTQDLPDEILALVFASLSPTDRNACSLACSRWMEVDATTRHRLSLDARAALGNAAPALFARFTAVTKLALRWARGSGADSLSDYGAAAVATALPSGRLSRLKLRGLRQLSDAGLASLAAAAPAIRKLSVASCTFGPKAFVAVLQSCPLLEDLSVKRLRGLPDTAGATTFIAEDIKFPPXASSLRSCCLKELYSALC

SEQ ID NO: 6925 - protein, 301 aa, Vibrio sp. 2693
MENLLSVKDLSKQQILDLLALAKAVKANPAEYSQALAGKSIVTIYEKPSLRTRVTFDIGIHKLGGHAVYLDAQNGAIGERETVKDFAANISRWADAIVARVVSHKTLEGLVEHGSVPVVNSLCDLYHPCQALADFLTISEHYEDVSKVKLAYVGEGNNVTHSLMLTGAILGAEVTAVCPRGSSPDAQIVKQAMALAEISGGKINVTDNLDAIVDYDVIYGDTWVSMGDDTPLAQVKEKYMPYQINKALLMRTGIKHVLHCQPAHRELEITSEVMDGEHSLIFDQAENRMHAQNAVLLTLLK

SEQ ID NO: 6926 - protein, 295 aa, Azoarcus sp. EbN1
MKRILIVGSGDVAMRAIPWLAKRFRVYAVTRSPAACAALRSRGAIPLLADLDDRRSLARLAGIADVVLHFAPPPAHGIQDPRTAWLLAALAQRPSLPQRVIYISTTGVYGDCGGAWVGEASRCMPRTDRARRRVDAERRLRRFGRRCAVAVSILRAPGIYAAERLPLARLQRGEPVLLAAQDVHTNHIHADDLAQLACLAIFRGRPGRVYNAVDDTSMKMGDYFDFAADFFGVPRPPRMSRADIAAALSPMALSFMSESRRLSNERIRRELRARLKYPTVREGFAAARKTRGGNI

SEQ ID NO: 6927 - protein, 358 aa, Oryza sativa Japonica Group
MALLLSTSVLLVLCLLPVDPAAPPVAAIPHRRSGRHDVPFGRHAAFGPFATEVELLLHGGGAVPDIRTCRDTLDRLPDWSHFDAELGPLERYFGSDGELNVKERLLYLFPMLDRAPKDGGVSCGELEAWLRRQAADRLDAVARRELKRHDKDGDGVVTLREYLAVDHDQHIDWTDTEHGEPGWWLHKFISADRDHSGAMDFIELNDFLHPEDSSQEKVKLWLLKDKLSGMDHDRDGKLSLDEFISQFHMIDHNSIVEHSADDDTSCAEAEKKFRELDSNNDGYLTVEEARPVIQSLISGEFSYAKSHAKLLMKADDNKDNKLSLEEMLNHYLSFYNIVYMDDHYDYDDIGNNIHDELR

SEQ ID NO: 6928 - protein, 769 aa, Oryza sativa
MAPVFFLLLFSQIFLCTAVDTINSTTPLSGTQKIVSKGGRFALGFYTPPQGNNTASGTGNYYIAIWYNNIPLQTTVWTANSDVPVSDPTTASLSIGSDGNLVLLDQSKNRQLWSTNVSVASNSTVAVIQDGGSLDLMDATNSSIVYWRSIDHPTNTWLPGGKLGLNKTTGVSQRLVPWRNNANPSPGLFSLELDPNGTTQYFIQWNDSITYWTSGPWNGNIFSLVPEMTAGYNYNFRFINNVSESYFIYSMKDDSIISRFTIDVNGQIKQWTWVPASENWILFWSQPRTQCEVYGLCGAYGSCNLNVLPFCNCIKGFSQKFQSDWDLQDFTGGCKRNVPLQCQTNSSSAQTQPDKFYSMVSVRLPDNAQSAVAASSQACQVACLNNCSCNAYTYNSSGCFVWHGDLINLQDQYNGNGGGTLFLRLAASELPDSKKSKKMIIGAVVGGVAAALIILAIVLFIVFQKCRRDRTLRISKTTGGALIAFRYSDLQHVTSNFSEKLGGGAFGTVFKGKLPDSTAIAVKRLDGLSQGEKQFRAEVSTIGTIQHVNLVRLLGFCSEGSRRLLVYEYMPKGSLELQLFHGETTALNWAIRYQIALGTARGLNYLAPEWISGVPITPKADVFSYGMMLFELISGRRNADLGEEGKSSFFPTLAVNKLQEGDVQTLLDPRLNGDASADELTKACKVACWCIQDDENGRPTMGQVVQILEGFLDVNMPPVPRSLKVLDESPDVINFFSDVSSSQTSQMHNSTASSQTKSSTSGGSQFQST

SEQ ID NO: 6929 - protein, 252 aa, Vitis vinifera
MAIWLVNGLRGLFSVLGCLMLATLLYTISTDGLPFRRDLLTPWMAATLVDFYINVVALAAWVSCKESNRVSAILWTILLVCFGSITTCAYIVLQFSKLSSESVQDAIYHVLLRNQSKNGTVQKRTFSPIVTARISFSLLGLLMLGTLIYTLLTDGSPFRKELLTPWMTATLIDFYINVVALSVWVAYKESSWISAFLWIILLICFGSITTCIYIVQQLFQLSSQDPLYLVLLNNGNRGKFLTLFKYGFFLTL

SEQ ID NO: 6930 - protein, 452 aa, Thermotoga neapolitana
MKMERKNVWQHRNREEIESFSKEYMDFMGRAKTERLAVREIRKFLEKEGFVPIEDFAGDPMDMAVYAVNRGKAIAAFRVVDDLKKGLNLVVAHIDSPRLDFKPNPLVEDEQIALFKTHYYGGIKKYHWFNIPLEIHGVLFRGDGEEIEIHVGDKPEDPVFTIPDLLPHLDKEDAKISEKFKGENLMLIAGTIPLSGEEKEAVKMNVLKILNEMYGISEEDFVSGEIEVVPAFPPREVGIDRSLIGAYGQDDRICAYTALRAFLEANPKKSIGVVFLDKEEIGSDGNTGAKARFYLRVLRQILKIQGGPEIQNSHSMRYWKKSAVISGDVCAAVNPPYKDVHDLHNAPRSGYGVALVKYTGARGKYSTNDAHAEFVARVRQVLNERNVIWQVATLGKVDQGGGGTYAKFFAERGADVYDMGPALLGMHSPFEISSKADLFETYRAYRALLEDL

SEQ ID NO: 6931 - protein, 498 aa, Rickettsia typhi str. Wilmington
MSTSKSENYLSELRKIIWPIEQHENKKFLPLAFMMFCILLNYSTLRSIKDGFVVTDIGTESISFLKTYIVLPSAVIAMVIYVKLCDILKQENIFYVITSFFLGYFALFAFVLYPYPDLVHPDHKTIESLSLAYPNFKWFIKIVGKWSFASFYTIAELWGTMMLSLLFWQFANQITKITEAKRFYSMFGLLANLALPVTSVVIGYFLHEKTQIVSEHLKFIPLFVIMITSSFLIILTYRWMNKNVLTDPRLYDPTLVKEKKAKAKLSFIESFKMIFTSKYVGYIALLIIAYGVSVNLVEGVWKSKVKELYPTKEAYTIYMGQFQFYQGWVAIAFMLIGSNILRKVSWLTAAMITPLMMFITGAAFFSFIFFDSVIAMNLTGILASSPLTLAVMFGMIQNVLSKGVKYSLFDATKNMAYIPLDKDLRVKGQAAVEVIGGRLGKSGGAIIQSTFFILFPAFGFIEATPYFASIFFIIVILWIFAVKGLNKEYQVLVNKNEN

SEQ ID NO: 6932 - protein, 178 aa, Rickettsia typhi str. Wilmington
MKNLPNYLTIARIMVIPVIILLFYINNSLARKLGALLFVLASITDFFDGYIARKYNLVTSFGKMFDPIADKLLVGCVTIMLLKKDNVDEIPCLLILAREFLVSGLREFLALVKVSVPVSRLAKLKTFLQMFALSILILGSKGSGIIYLDIVGEIILWIAAFLTIITGYSYFKACKTYF

SEQ ID NO: 6933 - protein, 125 aa, Triticum aestivum
MAALGSKLAQLQAKACEATRFVARNGCAYHKTLMEKNKQFVVQPPTVEKCQELSKQLFYTRIASLPGRYEAFWKEADQVKQLWKNRKDLNVEHAGIIALFGLELYGWFCVGEIAGRGFTLTGYSV

SEQ ID NO: 6934 - protein, 648 aa, Sulfolobus tokodaii str. 7
MSERETKGARDLGISSDRQLRRSLGKFELLYLSLGGIIGSGWLFASLATATYAGASAILSWIIAGILVMFIGLVYAEIGAAIPKSGGITRYPHYTHGGLVGYLITWAYFLSAASVPAIEAAAAIEYIGSYYPQLITTGTFDGTTVTILTPLGIGLAGLLLILFFFLNYFGVNILGKVTHGAGWWKLLIPTITFLALLALDLHSANFSLGGGFLPSAEYVKGGSSGIYGFSAVLYAIPSTGVIFSYLGFRQAVEYGGEGKNPKKDIPFAVIGSLLIAIVLYTLLQVAFVGGIDWNKLYLNESGKLVPVTPGNWSALSTAVTASGVPISAGPFLVLSRLASVSGLAAAFFTALAVLLTIDAVVSPSGTGWIYTGTSTRTLYAFASNGYLPEIFLKIGKTKIPTYSLIAALIIGFIFLLPFPSWYALVGFISSATVLTYIMGGIGLTVLRKHAAELNRPFKLPAAPIIGAIATLAAGLIVYWSSFAVLFYVFTGVFLGLPLFFIFYADKMLGINKVVSIIVGVINLAINLGMGLLLFNETSGLSAANNLFFTIYIVVIAAMLIGDMIFLLKTVPSDVKKEINAGWWLIYFILAIYIVSYFGGFGLYTVIPFPYDTIVAAIVVLIGYFWAVRSGFRTQAIEDIIQATKEEAV

SEQ ID NO: 6935 - protein, 62 aa, Triticum aestivum
  misc_feature (18)..(18): Xaa can be any naturally occurring amino acid
  misc_feature (30)..(30): Xaa can be any naturally occurring amino acid
RGLTFDEGMEERLCTYSXRAVAHFPTAVKXFKRRNGWFYSLIHNALEGGKPDPCPLPQLASR

SEQ ID NO: 6936 - protein, 553 aa, Oceanobacillus iheyensis HTE831
MNQFSSYRRKDTLDALQNEKLDLLVIGGGITGAGISLDATTRGLNTGLIEMQDFAAGTSSRSTKLVHGGLRYLQQFEVKMVAEVGKERAIVYENGPHVTTPEWMLLPFHKGSTLGPFTSNIGLRVYDFLAGVKKDERRVMFKPKEVMEREPLIKQDELRGGGYYVEYKTDDARLTIEVMKKAVEEGVHAINYTKAVEFIYEDSKVVGVVAEDLITGEKRKIYAKKIINAGGPWVDDVRELDGSKKGKTLHLTKGVHLVFDHNTFPLQQAVYFDSPDGRMIFAIPRDGKTYVGTTDTTYEGDIAHPVMTEDDRDYLLKAIAYMFPSLQLKPEDVESSWAGLRPLIAQEGATSPSEISRKDEIFQSDSGLLSMAGGKLTGYRKMAQHAVDLVTKQLKEEENILYTDSQTKHLPISGGDVGGSKGFEAFKKDKQKQAIQLGLSEQEALQMIQRYGSNVEILLDIYKNQKEEANKYDIDPIVFAELVYAIEFELAYKPVDFFIRRTGALFFQRPWVEAHMDKVLPYMKEKLQYTDEQLNEYTTQLKELLYETTNPVK

SEQ ID NO: 6937 - protein, 73 aa, Vitis vinifera
MASSSDSWIKEYYEASKLADDINGMISQRISLPTSGSETQRHASAIRRKITILGTRLDSLQSLLLKLPGKQPM

SEQ ID NO: 6938 - protein, 921 aa, Symbiobacterium thermophilum IAM 14863
MSYRIAPTQVAELPNGLKVYVREVRHAPVVTSMVWYGVGSRDEGPGQTGLSHFLEHMMFKGTPRFPYGVLEEAVKRRGGMWNAFTSYDYTAYYEVLPAQHLEFSFEVEADRMASMTFDPDLTVRERGIIVSEREGGENHPSFWLNEAFMATAFRVLPYRHPIIGSKADIRATTADALAAHYRRYYRPNNAALVVVGDVEAERVLRLAERHFGPLPAGGPVPPFTAAEPEQEAERRVTVRRPGPHPMLLAGYRIPEAAHPDQPALMLLAALLSGSASPGAAMGRSSRLHRRLIDTGLAVSAGAHVRAFQYAGLFMLTATPAPTVSLSSLEEALFDEVERLRAGEVSDEEFARARKQVRASLLYTMESTLNQAVFLGSTALTQGVERFDRALEELEAVTPADVLRAARQYLDVRRRTVGHFVPGDEATPGDEPLPGGEARAAAAASAPRAASSADAPSSVAVAPGANGASPVGTPDYQQPTDRRIPRPEAGPARPLLAAERIVRRELPGGAVLLLLPTPTVPSVFVRVQMEAGAVHEPPEKAGLAQLVAGVLTRGTAAYSAQELAIITDAQGMSLRVDAGRETAVAALKCLPEDLARGVQLLAEVVRRPSFPDDEVERLRTQMLVNWRRSEDDTRSVAARRLMERIYPEGHPYRQPIGGTEATLTGLQADDLRRFHQAHYGPRGAVITVVGDVDPESAAAALEEAFAGWEGGTGRAAIPPVPVPPGGRTHVPLAGKTQTDIALGWPLVDRGHPDYLALEVLATLFGGNGTPASSRLFRDVRERHGLSYYQYAVFGGTSGPGPWTAHLGVNPSRLEFAVETVRAELRRLVAEPVPVPELQALQDFLTGYPAVQHESPERIAARLAEIERFGLGLDWLQRHPRELAALTPEVLQEVAARHLVPERLTIVTAGPAESPANVSASKE

SEQ ID NO: 6939 - protein, 411 aa, Vitis vinifera
  misc_feature (320)..(320): Xaa can be any naturally occurring amino acid
  misc_feature (404)..(404): Xaa can be any naturally occurring amino acid
MNSQHPDGSVFSNIVRAPEDPILGVTVAYNKDTSPIKLNLGVGAYRTEEGKPLVLKVVRRAEQLLVNDPSRVKEYLPIVGLAEFNKLSAKLIFGADSPAIQENRVATVQGLSGTGSLRIGAEFLARHYYQHTIYIPVPTWGNHPKIFTIAGLSVKTYRYYDPETRGLDFKGLLEDLGAAPTGAIVLLHACAHNPTGVDPTLEQWEQIRQLMRSKGLLPFFDSAYQGFASGSLDADAQSVRMFVADGGECLAAQSYAKNMGLYGERVGALSIVCKAADVASRVESQLKLVIRPMYSNPPIHGASIVATILKDSDMYNEWTXELKAMADRIISMRQLLFDTLRDRGTPGDWSHIIKQIGMFTFTGLNTEQVAFMTKEYHIYMTSDGRISMAGLSSRTVPHLADAIXAAVTRIP

SEQ ID NO: 6940 - protein, 333 aa, Clostridium perfringens ATCC 13124
MELMKQIWESAKNNRKKIVLPEGDEERTLVASQRIKEEGLADVYLVGSEQVIREKAEALGVNLEGVNIVDPETSDKLDTYINEFYELRKAKGMTVEKAGKIVRDPLYFGTMMVKMGDADGMVSGAVHTTGDLLRPGLQIIKTAPGVSVVSSFFIMMVPGSQYGEGGMLLFSDCAVNPNPNADQLAAIAIATADTAKNLCKMDPKVAMLSFSTMGSADHDLVTKVRVATEKAKELRPDLDIDGELQLDAAIVGKVASQKAPNSKVAGNANVLVFPDLQAGNIGYKLVQRFANAEAIGPVCQGFAKPINDLSRGCSSEDIVNVVAITAVQAQATK

SEQ ID NO: 6941 - protein, 340 aa, Burkholderia sp. 383
MNTPNSASPSSAAALPRIAVLATGGTIAGAAPDAASTAGYQAGALGVNFLVDAVPALASVARIDAEQIASIDSKDLALPLWNALAARIDALMADPAVDGIVITHGTDTLEETAYALHLVVNGDKPVVLTAAMRPATALSSDGPLNLLNAVTVAAHPSARGQGVLVAFNNRIHGARDVVKTSTYAVDAFQSPELGALGWVQDGRVEFARRVTRSRDTQLAIAAVWPPVEVVASYAGVTRTAVDALVAAGVRGLVVAGTGNGSIHATLQAALADAVNAGVAVVRASRVGSGHVMRNGAASDDALGFVSAGSLNPYKARVLLMLALANGIDGRDALQRMFDTL

SEQ ID NO: 6942 - protein, 295 aa, Fulvimarina pelagi HTCC2506
MKRVRKAVFPVAGLGTRFLPATKSIPKEMLTVVDRPIIQYVVDEAREAGIEHMIFVTGRSKEVIEDYFDIQMELSTSLAEKGKTDRLKILNDLQPPPGTTSFTRQQAPLGLGHAVWCARELVGNEPFALLLPDMIMQAEKGCLASMMELYQSNGGNVLSVEECDPNETDKYGIVGKGEPIGDGFRITGMVEKPAPKDAPSNFYLSGRYILQPEIFEILEKTGRGAGDEIQLTDGMQTLFKQQQFAGYPFRGRTFDCGSPEGFIEANIAFALWRADIRDKVIDDIERLMETVEPRG

SEQ ID NO: 6943 - protein, 477 aa, Photobacterium profundum SS9
MTVAENVVTKLDISAMQNTLHEQRASYSAHPMPDYAERITQLKALKKALLANKTALCEALNQDYGQRSHQDSLMADVLPCVMNINYTIKHLKKWMKPSKRHAGLLLAPAKVEVVYQPLGVIGIVVPWNFPVMLSLGPLITALAAGNRAMIKLSEFTPATNIVLRELLASAFDNKHVAVFEGEADIAAAFTALPFDHLIFTGSTTVGRHVMRAAADNLTPVTLELGGKSPTIIAPDIPLNVAVERMIYGKSLNGGQICVAPDYTLVPEDKVDDFVAEYKKQFNKMYPKGTNNKDFTSVINQRQYQRLTAWLEDAQSKGATVIPCHENSRDDQQHRMVTHVLLNTNDDMTVMQDEIFGPILPIVPYKTIDQALDYIQQRPRPLALYLMSFDAELQQRIKTTTHSGGVCINESVFHVAADDAPFGGIGPSGMGHYHGKEGFLTFSKAKTILSRGKTNTAKLVTPPYGGWIQKLMLAFFLR

SEQ ID NO: 6944 - protein, 293 aa, Rickettsiella grylli
MKKIKKITKALFPVAGLGTRFLPATKASPKEMLPIVDKPLIQYAVEEAIAAGINELIFITSSSKRAIEDHFDSNYELETKLAKTNKKELLAIVKNILPEGVSCVYLRQPDTLGLGHAILCARPLINNDAFAVLLADDLIDSKTPCLKQMLAIYQEKQNTIIAVQAIAPEESEQYGVIGYNLKEGPLSEVNSIIEKPPYQNAPSHLAVVGRYILTPTIFSYLSKISCGKNDEIQLTDAIACQLKDERVYAWEFEGTRYDCGNKLGYLKATFAHALKHPEIKDLFTNYLKNLNTM

SEQ ID NO: 6945 - protein, 522 aa, Mycobacterium tuberculosis CDC1551
MTVTEPVLHTTAEKLAELRERLELAKEPGGEKAAAKRDKKGIPSARARIYELVDPGSFMEIGALCRTPGDPNALYGDGVVTGHGLINGRPVGVFSHDQTVFGGTVGEMFGRKVARLMEWCAMVGCPIVGINDSGGARIQDAVTSLAWYAELGRRHELLSGLVPQISIILGKCAGGAVYSPIQTDLVVAVRDQGYMFVTGPDVIKDVTGEDVSLDELGGADHQASYGNIHQVVESEAAAYQYVRDFLSFLPSNCFDKPPVVNPGLEPEITGHDLELDSIVPDSDNMAYDMHEVLLRIFDDGDFLDVAAQAGQAIITGYARVDGRTVGVVANQPMHMSGAIDNEASDKAARFIRFSDAFDIPLVFVVDTPGFLPGVEQEKNGIIKRGGRFLYAVVEADVPKVTITIRKSYGGAYAVMGSKQLTADLNFAWPTARIAVIGADGAAQLLMKRFPDPNAPEAQAIRKSFVENYNLNMAIPWIAAERGFIDAVIDPHETRLLLRKSMHLLRDKQLWWRVGRKHGLIPV

SEQ ID NO: 6946 - protein, 182 aa, Bordetella petrii
MQTDTAELIRRTIRSVPDWPRPGVVFRDITPLLQDPRTFRVLIDLFVYRYMRQRLDLVAGVDARGFIIGSVLAYELNLGFVPVRKQGKLPYRTVAESYTLEYGNSSVEMHTDSVRTGQRVLLVDDLIATGGTMLAAIKLLQRLGANVVEAAAIIDLPELGGSGKVAATGTPLFTVCSYDSAE

SEQ ID NO: 6947 - protein, 311 aa, Sulfolobus tokodaii str. 7
MAKLITLGEILIEFNALSPGPLRHVSYFEKHVAGSEANYCVAFIKQGNECGIIAKVGDDEFGYNAIEWLRGQGVDVSHMKIDPSAPTGIFFIQRHYPVPLKSESIYYRKGSAGSKLSPEDVDEEYVKSADLVHSSGITLAISSTAKEAVYKAFEIASNRSFDTNIRLKLWSAEEAKREILKLLSKFHLKFLITDTDDSKIILGESDPDKAAKAFSDYAEIIVMKLGPKGAIVYYDGKKYYSSGYQVPVEDVTGAGDALGGTFLSLYYKGFEMEKALDYAIVASTLNVMIRGDQENLPTTKDIETFLREMKK

SEQ ID NO: 6948 - protein, 142 aa, Chlamydomonas reinhardtii
MIKPDGVQRGLVGDIISRFERKGYKLTALKLYQTPKEVAEEHYKDLASKPFYKDLVNYIVSGPVVCMVWEGKGVVATARKMIGATNPLASEPGTIRGDFAIEVGRNVIHGSDSPENGERETAIWFPEGITSWSQTMEPWLKE

SEQ ID NO: 6949 - protein, 113 aa, Zea mays
PVFAHLGKGVGYQVVSLFEIPRAALVFHQIAAQAELFSLGRNFFSLMAFGYSRDPVGGFVPVSLAQGILHHAPFGGFWSQRGWWLPPGFTLCSQCVVLFLFRSFSLPAAAPLW

SEQ ID NO: 6950 - protein, 425 aa, Thiomicrospira crunogena XCL-2
MTQSKTKLGFNGTWSMAVGGMIGGGIFSTLGVVVAIAGAWAWLSFLAAGLIALAAGYSYVKLATFYNEGGGAFTFLRKIHADGFAGSLAWVLIIGYVLTNAVYAFTFGQYLGNLLELNSWFPRASAVAIIALFIALNLKGVAEASGVEIFLVWFKLVVLVGLSAWGLSHWDIPMLSQGVSVPDAGLGAALFGAAAVFMAYEGFQLLTYDYNDIETPKKILPRAVLSAIIVVILVYILVALGTAMLIGADEIVKHEEVALAIAGEKAFGITGLVVVTIAAAFSTGSAINATLFATARLAHKVAKAHELPADMGHKNAAGIPDRALIWLGSLAALLAAIGNLTSLVEAASLAFLFTFTVVCGLAFKQDAGSRWITGFGALSAAAASIALIVQLIQTDLSALLFLLALIAIAVFGRPTILRYFKNSRF

SEQ ID NO: 6951 - protein, 321 aa, Oryza sativa Indica Group
MEVFENARSVRLRSHLGTYLCAADDGGGGGGEAVTHGYRRNCRGTVWAVETSGDDYVRLQGHRGLYLCATELPAALDGGCRGSAACCWVIQAGSPPSPNDGAFLWTPRREGEHLTLTGLYGRLLRARFGLTPRENAVTVDRDAAPEESSWVVEVVPESEAPPPRCRALSCDARLEAATSEPDTAFTTAFVRFYSAKELKVVKPPPPEEGEEEEEPPSEAAPGALVARTIFYNTARDDGRVDDFDQGTWRYFTFKEQSLAALRRRLEEEARREDFVVCRRRCAAPPPGLFPVVLDLPPGNRDMEFVLVLHSSRGASFLNFCV

SEQ ID NO: 6952 - protein, 197 aa, Capsicum annuum
MRFIALVFLVGALAIIAVECNSEGDALNAFKMNMLDPNNALQSWDPTLVNPCTWLHVTCNIQNSVTRVDLGGANLSGILTPQLGVLYNLQYLQVENNSISGAIPRELRNLTNLLSLGLENNKLSGTIPSSLGNLKSLRWMRLNSNRLSGEIPISVLKLVLWGNLQLMNVSDNKLAGTVPLANKTGFAITTIVQDMKA

SEQ ID NO: 6953 - protein, 181 aa, Triticum aestivum
  misc_feature (139)..(139): Xaa can be any naturally occurring amino acid
  misc_feature (166)..(166): Xaa can be any naturally occurring amino acid
AVLAETGDSWFNCQKLKLPEGCGYEFQMQYGSIGWSVGALLGYAQGASEKRVIACIGDGSFQVTAQDVSTMLRCEQNSIIFLINNGGYTIEVEIHDGPYNVIKNWNYTALVEAIHNGEGKCWTAKVKCEEELTAAIEGXWGRKKDSLCFIEVIAHKDDTSKEFSSXGSRVSAANSRPPNPK

SEQ ID NO: 6954 - protein, 466 aa, Streptococcus suis 89/1591
ESSAQKIAALITEGANVFRFNFSHGDHQEQGDRMATVRRAEEIAGKKVGFLLDTKGPEIRTELFEDDAKEYAYTTGDKLRVATKQGIKSTKEVIALNVAGGLDVFDDVEVGKQILVDDGKLGLTVVEKDAVNREFVVLVENDGVIAKQKGVNIPYTKIPFPALAERDNADIRFGLEQGLNFIAISFVRTAKDVEVVRNICKETGNDHVQLFAKIENQQGIDNIDEIIEAADGIMIARGDMGIEVPFEMVPVYQKMIITKVNAAGKAVITATNMLETMTEKPRATRSEVSDVFNAVIDGTDATMLSGESANGKYPVESVRTMATIAKNAQTLLNEYGRLNSDQFNRASKTEVIASAVKDACHSMDIKLVVTVTETGYSARSISKYRPDADILAVTFTEKVQKSLMLNWGVIPIVTNRPDSTDDMFDLAERIAKEQGLVEAGDDIIIVAGVPVGVAGSTNTMRVRTVK

SEQ ID NO: 6955 - protein, 482 aa, Clostridium perfringens ATCC 13124
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTITGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 6956 - protein, 484 aa, Fulvimarina pelagi HTCC2506
MGKVTGFLEIDRQTPKYQPASDRIRHFKEFTLPMSEPEVAKQAARCMDCGIPYCHGPTGCPIHNQIPDWNDLVYQGDWEAAIRNLHSTNNFPEFTGRICPAPCEEACTLNLEDAPVAIKTVEQALADKAYELGMIQPQPPKAKTGKSVAVVGSGPAGMAAAQQLGRAGHDVHVYERESRPGGLMRYGIPDFKMEKHYIDKRVEQMEAEGVRFFCGVNVGVEKTVDSLLSEYDAVLYCGGSEKPRDSGIPDHGLSGVYHAMPYLVQQNRRVGGENSESVGWPQEEIWAGGKHVVVVGGGDTASDCVGTAFRQGAVKVTQLDIRPQPPQRENKLTVWPYWATKMRTSSSQAEGAVREFQIATLDFVGEDGVLTGVKCAEVDEKRQPIEGTEFIIKADLAFIAIGFAGPFETSVMAELKDALKTNADRRGNISVAADDRDYRTSIDKFYAAGDIRRGQSLVVWAIREGRQAARSIDLALMGHTTLPL

SEQ ID NO: 6957 - protein, 421 aa, Bradyrhizobium sp. ORS278
MAPAARTEPLSRHALAFVLAGGRGSRLLELTDRRAKPAVYFGGKSRIIDFALSNAVNSGIRRIAVATQYKAHSLIRHLQMGWNFFRPERNESFDILPASQRVSETMWYVGTADAVYQNIDIIETYNTKYIVVLAGDHIYKMDYELMLQQHVDQRADVTVGCLEMPREESSGFGIMHVNDDDTIRDFIEKPADPPPMPGKPDKSLASMGIYVFDSKFLYDELKRDAADPNSNHDFGRDIIPYIVKNGRAVAHQFSRSCVRAASDQGSYWRDVGTVDAYWAANLDLTDVVPELDLYDRSWPIWTYSEITPPAKFVHDTDGRRGEATCSLVSGGCIVSGAQVQRSLLFTGAHLHSYAKLQNAVLLPYVNVARHARLTNVVVDRGVQIPEGLVVGEDPEFDAKRFRTTENGVTLITQPMIDGLNS

SEQ ID NO: 6958 - protein, 315 aa, Bradyrhizobium sp. ORS278
MILSCGDALIDFVPAKLADGRDVLRPVVGGSCLNVAVGLARLGAPTGFIGGISTDLFGTMIAAHAQASDVDLGYATRSPDQTTLAFVRHVGSEAQYAFYDAETAARKWSFRPGSIPFAAIDAIHVGSTTLIHYQGARETRAMIAASDGAVTISFDPNCRPNLVTDKAAYVSDMDAFAARADLIKMSDVDFDYLHGHDDYPARAAALLARGTSLVVVTRGPKGALGWHAQAGAVEVAVPNVDVVDTIGAGDTFQAGMLFALRKLGRIGRDGLKRLSAAELRKVLAFAAACAAITCTREGADPPRWAEMAATWDRLG

SEQ ID NO: 6959 - protein, 72 aa, Brassica napus
MVKICCIGAGYVGGPTMAVIALKCPSVEVAVVDISVPRITAWNSDQLPIYEPGLDDVVKQCRGKNLFFSTDV

SEQ ID NO: 6960 - protein, 257 aa, Bradyrhizobium sp. ORS278
MYLEKFKLNGKTALITGGAQGIGLACVEALAEAGAHVVIADRDAKAAADAQVAMKAKGFTTETALMDVTDSAQVTQIADDLVARHGKVDILVNNAGIARSETPAETVTDEHWLNVLDVNLNGTFWCCRAFGKHMLAAKSGTIVNIGSMSGFIVNKPQEQSFYNASKAAVHHLTKSLAAEWGARGIRVNAVAPTYIETPLNAFVKSNPRMYDAWIGGTPMARMGQVEEIASVVLFLASEAASLMTGSVVVVDGGYTCW

SEQ ID NO: 6961 - protein, 336 aa, Streptococcus suis 89/1591
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQIVSSDIVGISFGSLFDATQTKVIEVDGEQLVKVVSWYDNEMSYTAQLVRTLEYFAKIAK

SEQ ID NO: 6962 - protein, 381 aa, Shewanella sp. MR-4
MSNPAQRATKLFVQTFGTKADDLYQAPGRVNLIGEYTDYNDGFVLPAAINFHTVIAVKRRDDNKFRAVADAFPGQIKEWSFGKDTEINPEDGWVNYLKGLTVAMANTGLIAKGLDLAVVGDVPLAAGLSSSGALVVAFGTAISDSSQLHLSPMAVAQLAQRGEYRYVSSACSIMDHMICAMGEPDHALLIDCLDLDSEPIAIPENLSLIIIDAHIEKQRLAATNQQRREECAQAAEHFGLDALRHLDLRQLESAKDQLDDTLYRRAKHVVTENKRTQSAARALEQNNLSKFSLLMAQSHQSLRDDFEVTLPEFDTLVDIVGQVIGERGGIRMTDGCVVALVDHELTDAVVSAVEHAFYEQTGIDATVYLCSASAGAGRIDI

SEQ ID NO: 6963 - protein, 179 aa, Symbiobacterium thermophilum IAM 14863
MRLVGKPAPDFTMLSTKDLDKLDQKVSLSDYKGKWLILFFYPADFTFVCPTEITAFNDRVQEFQDANCEILGVSVDSVYSHRAWIKTPKEEGGLGPVNYPLASDITKEVSRAYGVLIEEEGVALRGLFIIDPDGIVRYQVVHDNNIGRNVDEVLRVLEALQAGGLCAANWKPGDALLKV

SEQ ID NO: 6964 - protein, 399 aa, Streptococcus suis 89/1591
MAKLTVKDVELKGKKVLVRVDFNVPLKDGVITNDNRITAALPTIKYILEQGGRAILFSHLGRVKEEADKEGKSLAPVAADLAAKLGQEVAFIAGATRGAELEAAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 6965 - protein, 534 aa, Triticum turgidum
MAARTRWSALAASALIQCFAGGSYCFGVYSPALKASQGYDQSALDAVAFFKDVGANVGVLSGLLAAWAPAGGRRRPWVVLLTGAALCAAGYLPMWLAVAGVVPAPLPLVCLYMLLAAQAQTFMNTADVVTAVENFPDRRGTVIGIMKGFLGLSGAILVQVQRTLHIDPGSFILMLAILPTAIALLLMYFVDVHSAHQWYNKKFLDAFSLMAVTVAGFLMVVIICDQVFMISSAGQSVCFAILLLLIMSPVTIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGLNHFGTIFNTVAVASPVGSYILSVRVVGFIYDKESPQGELACAGKHCFALSFLIMACVCVFGSAVAFVLFIRTRKFYRRVIYARLLPFVDK

SEQ ID NO: 6966 - protein, 523 aa, Triticum turgidum
MMVERWAGFGSAMATVIFLWSVVQNYVPPTFRLYLTAWAAKVAACFNPYLEITISEYGAERFQRSDFFLAVEAYLSDACARRARKLKAELVKDSKNLRVTVDDHDEVTDDFSGTTIWWYASKRQSRAQVISFYPGEDERRFYKVVFHRRHRDLVVDSYLPFVLGEGRAVTVKNRQRRLFTNNASRNWNPYSSKSVWSHVAFEHPATFDMLAMHPDEKEAIVDDLMAFQESKDYYAKVGKAWKRGYLLYGPPGTGKSTMIAAMANFLDYDVYDLELSAVKNNTELRKLFIETTGKSIIVIEDIDCSIDLTGKRRKDKKASSDKDSDDDGKPKLPMDPEKDDATKVTLSGLLNFIDGLWSACGGERIIIFTTNHKEKLDPALIRRGRMDKHIEMSYCRFEGFKVLAKNYLDVIKHELFGEIQQLLEETDMSPADVAENLMPMSKKKKRDPDLCLSGLVKALKQAKEDAAAAAAKAKEEEEAKEAEAKKAKEKEEAEVKKAKKENKGKDKAAEEANGDIKEGDKVK

SEQ ID NO: 6967 - protein, 414 aa, Clostridium perfringens ATCC 13124
MKRWTFDENTIILPNGLKVITIKKDTRLASINIGVNIGSLYEDEKELGMSHFVEHMLFKGTKNRSNEQLNRELEFLGGDYNAYTDYISTVYSITCLDEEFEKGIELLSDMVLNSSFDEKEMKKEKGVVLSEIKSDKDDIEDLSISRTHEYAFDKSALRNSIAGTEEHVKGFKRKQVYDFYKKYYTPDNCVIVTVSAFSHEQMQKIITDLFGKWEGKSHKKAKIIKEENKDIVKTTYKSQIEQGTVTYLYAFKEVCEKDKLPLKILSYKLAESSNSILFRELREERGLAYDVYSQMDLDENVNTMNIFTSVREESIDEVIEVIDKAILDIKNKDINFDEDMLCMMKKTHKTGVVSTLEDCSSLCSYVLVQSLAGKDITEFINSMEELETLTGEDIYRVCNKYLNKPTIHILKPME

SEQ ID NO: 6968 - protein, 299 aa, Chlamydomonas reinhardtii
EEVAIKLESVKTRHAQLLYESKLYKILQGGVGIPNVRWYGVEGDYNVMVIDLLGPSLEDLFNFCNRKFSLKTVLMLADQLLSRVEFVHSRSFIHRDIKPDNFLMGLGKKANQVHIIDFGLAKKYRDPKTHIHIPYRENKNLTGTARYASINTHLGIEQSRRDDMESLGYVMMYFLRGSLPWQGLKATTKRQKYEKISEKKMSTPIEVLCKGYPMEFVTYFQYCRSLRFDDKPDYSYLRKMFRDLFAREGYQWDYVFDWTILKHQQSGTVPRPAVPRVPEPAAGEGEEAADPAYGGRFDF

SEQ ID NO: 6969 - protein, 494 aa, Bacillus cereus ATCC 14579
MLKTNIELKPKVEAFLNEEIKMFINGEFVAAIGGKTFETYNPATEDVLAVVCEAQEEDIDAAVKAARSAFESGPWAEMTTAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLHYIEQGKKEGATVAAGGERALEKGYFVKPTVFTDVTDDMTIVKEEIFGPVVVVLPFDSTEEVIERANNSSYGLAAGVWTQNIKTGHQVANKLKAGTVWINDYNLENAAAPFGGYKQSGIGRELGSYALDNYTEVKSVWVNIK

SEQ ID NO: 6970 - protein, 502 aa, Bordetella petrii
MSADYLKRILTSKVYDVAVESPLESAPLLSQRISNTVLLKREDTQAVFSFKLRGAYNKMANLAPAARSRGVIAASAGNHAQGVALAAARLGCRAVIVMPTTSPQVKIDAVRRLGGEVVLAGESFSDAYAHAQTLEKKEKLTFVHPFDDPDVIAGQGTVGMEILRQHPGPIDAIFVAIGGGGLVSGVAAYVKQLRPEIKIIGVQTEDSDAMLRSVRAGRRVQLNDVGLFSDGTAVKMVGAETFRLTRQYVDDFVVVDTDAICAAIKDVFQDTRSVLEPAGAMAVAAAKQYAAQHKLKGKTLIAIACGANMNFDRLRFVAERAEVGEMREAVFAVTLPEQRGSFRRFCELVGHRSVTEFNYRISDAQRAHVFVGLQVNSPAESDKIAANFRRNGFDTLDLTHDEMAKTHLRHMVGGRSALASHELLYRFEFPERPGALMRFLNAMNPDWNISLFHYRNQGADYGRILIGIQVPPSDKKQFKTFVAELGYPHWNETDNPAYKLFL

SEQ ID NO: 6971 - protein, 170 aa, Rickettsiella grylli
MRIPLEEKNMTINFRIGYGYDVHAFKAGDHIILGGVTIPHKMGIKAHSDGDVIIHALVDALLGACALGDIGLHFPDTDDCLKNKDSRIFLQTTVQLLVKNNWRINNVDITILAETPKLQTYFNKMRINLANDMNIDLNQINVKATTTEKLGFIGREEGIAATAIALIQAK

SEQ ID NO: 6972 - protein, 319 aa, Burkholderia sp. 383
MPLNPKIAQVLDMIERAKRPSYHHQTPQQARAAYEKSAPILDVASAPMHSVEECVVPTRDGRTIGARLYLPVEPSLAEPLPALVYYHGGGFTVGSVDTHDALCRMFARDAQCAVLSVGYRLAPEHRFPTAVNDADDALQWLHREAATFGIDAARLAVGGDSAGGTLATVCAVLARDAGIRLALQMLIYPGVTGYQDTESHARLANGYLLTQDTIQWFFTQYVRDRADRDDWRFAPLDGTRDAPSFAGVAPAWIATAEYDPLSDEGAAYAEKLRAAGNVVTLVCYPGMIHEFFKMGGYVPEVRAAHADAVAALKAAFDDV

SEQ ID NO: 6973 - protein, 298 aa, Arabidopsis thaliana
MDSPFKPDVVRGQVALITGGGSGIGFEISSQFGKHGASIAIMGRRKQVLDDAVSALRSLGIQAIGLEGDVRKQEDARRVVEATFQHFGKLDILVNAAAGNFLAAAEDLSPNGFRTVLDIDAVGTFNLCHAALKYLKKGAPGRDSSSGGGSIINISATLHYTASWYQIHVSAAKAAVDATTRNLALEWGTDYDIRVNGIAPGPIGGTPGMSKLVPEEIENKTREYMPLYKVGEKWDIAMAALYLSCDSGKYVSGLTMVVDGGLWLSKPRHLPKEAVKQLSRAVEKRSRAKPVGLPTSKL

SEQ ID NO: 6974 - protein, 509 aa, Vibrio vulnificus YJ016
MGFTSLGLSAPILKAIQEKGYDTPSPIQLQAIPAILEGKDVMAAAQTGTGKTAGFTLPILERLAKGPRVRANHIRALILTPTRELAAQVQENVFMYSRHLDLNSAVVFGGVKINPQMLRLRKGADVLVATPGRLMDLYSQNAVKFDQLEVLVLDEADRMLDMGFIRDIRKILALLPAKRQNLLFSATFSDEIRELAKGLVNNPIEISVNPANSTARTVEQCIYPADVKKKPAMLAKLIKDGDWRQVLVFTRTKHGANRLAAFLTDQGLTAAAIHGNKSQGARTKALADFKSGDVRVLVATDIAARGIDIPQLPQVVNFELPKVAEDYVHRIGRTGRAGETGKAISLVCALEAPELFAIERLIQELLPRKALEGYAPTNAVPESKLDTRPIKPKKPKKPKKPKAPNAEAAGSDASSKGNQKAKAADKPQGQNRGNGKAKRQFSAPKEGNNDSANKGKRPNTKGSKPANNANGKTHGKPSHAKPNSAKTGNSKPANGKPSAQRRKPRPQSA

SEQ ID NO: 6975 - protein, 459 aa, Bordetella petrii
MIEVVNPADGSRVGVVPHMDAAQVKAAIDRTCDAFPAWSRRLAKERGDLLRRWFELVRDDKQAFAEIMVQENGKCLAEALGEIDYGLGFIEWYAEEAKRVYGDTIPSHAPHATVMVMKTPVGPTAAITPWNFPFMMITRKVATALAAGCTMIIKPSEETPLTAYKLLEYARKAGIPEGVFEMVTGNPPEIGALFTGDERIRKISFTGSTAVGRLLAQASGATLTKMTLELGGNAPFIVFDDATLEQAAAGLVAAKLRNSGQVCISPNRIYVHDGIYDRFVQEVAERVARIPVDQGMRPDFVVGPLINQAGLQKVDQLVQDSRRDGATVVLGGRPHAKGGLFYEPTVLTGLNDDMRIARTEIFGPVFPFYRFSTEDEVVRRANQTEYGLVAYAYTRDVGRAFRLARDIEAGMVILNSGSVGTASVPFGGVKQSGYGREGSHHGIEEYVDVRYVLAAGQDV

SEQ ID NO: 6976 - protein, 548 aa, Magnetospirillum magnetotacticum MS-1
MFPPTEGPLLRTFTLTLSGRAVAAVVALVLACAALAATVAYTVADSRASAAAARAEGAAAPVLAAGTAPANPLGITSARYATATATAAAEKPKVVVVATGGTMAGKATGRDTFTSYRAGTYLMEDMLDTLRPELDAVADVTAVQFGNAGSSGYSMEQFHALTLEVEKQLKTADAVVVTTGTDTQEEFAYWLDLTVRSRKPVVTSGSMRPWGSGAGPDSSLVFGTDAPANLYNAIKVAASQQTFCFGTVLMLNDEIQAAREVTKSNSYRTDTFQTREYGVLGWIDGDNVTLGRAPARVLACDTEEWFTPFDLAKVDAKTLPRVEILMSYQQAGGEAVTAFANAGVRGIVTAGTGAGGISSAMSQARTAAVRDKGVWFVSTTRTGSGSSYGGGNGIIAGGDLTAVKARLLLLLSRAFTDDFATAQGWFTTFGNASFDQSATAATVGAEPGSTTVRFSGTATPSCKAAGQQLWLTASVTNEDSVPIDVHVQTPAGEHTFSAVPAGESAEKTLAVKGKTLAAGEITLVATKDVDGRAVQTQTTAAYPETACR

SEQ ID NO: 6977 - protein, 391 aa, Oryza sativa Japonica Group
MQYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNVVQTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 6978 - protein, 302 aa, Physcomitrella patens subsp. patens
MENYKKLEKIGEGMYGKVYKAVDKRTGSLVALKKTKLENDFQGIPATTIREVALLQLLSMSIYFVRLLSVEHFSKGGRLSLYLVFEYVDTDLRRFIDLSWPGLNNPLPPLTIKSFMYQLLKGVAHCHSHGVMHRDLKPQNILIDWDRGLVKIADLGLGRVFTVPVKSYTHEVVTLWYRAPEILLGSSHYSTPVDIWSVGCIFAELCRKMPLFPGSSELQQLLHIFRLLGTPNDQIWPGVSTLRDWHLYPQWKPHNLAQVVPELDSAGIDLLKSMLQYNPASRISAKKALFHPYFNSLDKSQY

SEQ ID NO: 6979 - protein, 280 aa, Oryza sativa
MAAEGELKLLGTWASPYVSRVKLALHLKGLSYEYVVEEDHFNNKSELLLSSNPVHKKVPVMIHNGKPICESLIIMEYLDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAFLAVRLYLLLFLQPCFISSCCRTVYVSPCVAEVANWVFYNVLRPYWYVD

SEQ ID NO: 6980 - protein, 370 aa, Physcomitrella patens subsp. patens
MECAGQILPGLPDHLAMECLARVPLGSLTGVSKTWQNIIYDPYFQSFRASIGRSKLDWVYTLVQMQDKSFKWRAFDPLSSQWHDLPPTPHPMDFQLLNPGCIGVSYSVQCVSTSSKLVMVAAVKAKKDGQPRMTVEPALEHPYIFDTSTNSWKQGSPFSVPRKWCVCGVADEKVYVASGSGKDWSQELSKSAEFYNLENDKWERLQKLSTSKFSGEAMNAVLNNNKLYFVSGRGVFSKDGVVYDLGTNSWLEMSPGLKWGWRGPCVSVNGKFYLLETPAGKLKVYVPERDEWDTIMLDSRLANLEVFVGTKGKIVAIEAASGKDKETNAGSLLRVIDIASETPQIFDIPVQDGQVVSVQVLAMMNQASKQ

SEQ ID NO: 6981 - protein, 336 aa, Pseudomonas aeruginosa PAO1
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 6982 - protein, 134 aa, Triticum aestivum
MAEQTFISRFEKKGFYLKGLKLQNVEKSFAEQHYSDLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 6983 - protein, 332 aa, Shewanella sp. MR-4
MSELPHDYTHIYLEQPGEPEVMQLTRSPLPVLSAGQVLIRNCAVGVNGPDIKQRMGMYPPPPGASPIIGLEVAGEICALGDGVTQWQLGDKVCALVPGGGYGEYTLTYAVHCLPIPQGFSEVQAAALPETFFTVWGNLFMRAGLKAGETVLIHGGSGGIGSTAISLAKHLGATVITTTGQDEKRDYCSGLGAHLVVNYNTQNFVEEVMAFTQGKGVNVVFDIAGGDFINLNLQALALDGRMVSVSTQRSAKAEVNILQLMAKRIVWTGSTLRPQTVEAKAEIAKQLAEHVWPLLDSQQIVPHICATFPLAEAAKAHALMQSGEHRGKVVLTL

SEQ ID NO: 6984 - protein, 308 aa, Nitrosomonas europaea ATCC 19718
MTDISVAGDLLLKSTHLQINEVVAELRNVRTTALLDRQGHLKPPRLPSRKILAGVIEGLRTALFPNRLGPSDLAVEGVDHYVGHILNSTLRALLVQIQHELHFNSGTEELDQETYAQAAEITQAFAKRLPAVRRLLDGDVLAAYEGDPAARGIDEVLVCYPGVAAITWHRLAHELYQLNMPLIARMISEIAHSQTGIEIHPGAQIGERFFIDHGTGVVIGETSIIGRNVRLYQAVTLGAKHFPVDENGTLVKGIARHPIVEDDVVIYAGATILGRITIGHGSTIGGNVWLTRSVPPGSLITQAQTHND

SEQ ID NO: 6985 - protein, 126 aa, Oryza sativa Indica Group
MAAASAAAQAEGTVIAIHSLDEWTIQIEEANSAKKLTCSPKVVIDFTASWCGPCRIIAPVFADLAKKHTNAVFLKVDVDELKPIAEQFSVEAMPTFLFMKEGDVKDRVVGAMKDELASKLELHMAM

SEQ ID NO: 6986 - protein, 204 aa, Arabidopsis thaliana
MGLIVDDDNDGEVLIPPPNFSMVEDEIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 6987 - protein, 694 aa, Burkholderia sp. 383
MAVDYSTRDGVAVLTLNNPPVNGLGLSTRQGVMDALDRAVQDPSVTAIVLTGAGRAFSGGADITEFNTPKALQEPTLHTVIHAVEASAKPVVAALHSVVMGGGLELALGAHYRVAAPGAQVALPEVKLGLLPGAGGTQRLPRAVGLETALNMIVSGAPVPSEQLAKSGLFDEMADGDLLDAAVAFARKVGAQKGPHPRVRDRKIVHANAAGFIQFARNSARAAAPNFPAPHKCIDAIEAGVLHGFDKGSVAEREGFVALMMTPESRALRHAFFGERAASKIPDVPADTPLREIRRVGVIGAGTMGGGIAMNFVNAGLPVTLLETKQDALERGVATIRKNYDAQVKKGKLTQEKLDARMALITPTLSYDDLKDADLIVEAVFEELGVKEQVFKKLDEVAKAGAILASNTSTLDVDKIAAFTKRPQDVVGMHFFSPANVMKLLEVVRGAQTAKDVLATVMAVAKKIRKTAVVSGVCDGFIGNRMIEQYIRQALFMLEEGALPAQVDRAIEKFGFAMGPFRMSDLAGNDIGWAIRKRRYIEQPDLQYSKIADHLCEQGRFGQKTGAGWYDYVPGDRKAKPSSLVDEMVVAYSKERGVERRKIGDDEIVERLVFALANEGAKILEEKIASKASDIDMVYLTGYGFPLWRGGPMLYADAVGLYNVERAIRRYAAAPNGDAWQLAPSIAELAKAGRGFNG

SEQ ID NO: 6988 - protein, 114 aa, Brassica napus
FYFGTRAIITAVKVRQILNSRGNPTARVDGHTSTGVKVTEVVPRGVSIGFYKVLELRDGGFDYLGRGVFKVVGIVNNIIGPVLMGKDPIKKTVIDNLMVHELDGTKNKWGWCKQ

SEQ ID NO: 6989 - protein, 540 aa, Burkholderia sp. 383
MRAARRRLTISAYPEALNMSFSRSAADAADTLPDLAATLGEPAVGAFVTLGDAFHTRLPAAPLAAPYVVGFSGEVAQLLDLPPSIAAQPGFAELFAGNPTRDWPANAMPYASVYSGHQFGVWAGQLGDGRALTIGERTGTDGRRYELQLKGSGRTPYSRMGDGRAVLRSSIREFLCSEAMHHLGIPTTRALTVIGSDQPVVREEIETSAVVTRVSESFVRFGHFEHFFSNDRPDLLRQLADHVIDRFYPECRRADDPYLALLEAATLRTADLVAQWQAVGFCHGVMNTDNMSILGVTIDYGPFGFVDAFDANHICNHSDTSGRYAYRMQPRIAHWNCYCLAQALLPLIGLQHGIDDDDARAERAVEDAQAVLAKFPERFGPALERAMRAKLGLELERESDAELANKLLETMHASHADFTLTFRRLAQISKHDASRDAPVRDLFIDRDAFDAWANLYRARLSEETRDDAARAAAMNRVNPKYVLRNHLAEVAIRRAKEKDFSEVERLAQILRRPFDEQPEHEAYAALPPDWAGSLEVSCSS

SEQ ID NO: 6990 - protein, 143 aa, Burkholderia sp. 383
MSHDSDDKTFPYEKDDAELRRRLTPMQYEVTQHAATERAFTGEYTDTEDDGIYKCVVCSTPLFESGSKFHSGCGWPSYFKPLNGEVIDEKVDYSHGMVRVEVRCNHCGAHLGHVFEDGPRDQTGLRYCINSAALNFESRPENE

SEQ ID NO: 6991 - protein, 256 aa, Bordetella petrii
MQQHSTPASDSDASTTHFGFQSVPENEKARKVAEVFHSVASRYDVMNDLMSGGLHRAWKAFTIGRAAIRPGMKVLDIAGGTGDLAKAFARRAGATGEVWLTDINDSMLRVGRDRLTDAGLLLPTAVCDAERLPFPSGYFDRVSVAFGLRNMTHKDRALAEMTRVLKPGGKLLVLEFSRVAKPLAPVYDWYSFNILPWLGKKVAGDEASYRYLAESIRMHPDQDTLADMMRTAGLERVQYFNLTAGVVALHEGVRLG

SEQ ID NO: 6992 - protein, 304 aa, Triticum aestivum
  misc_feature (225)..(225): Xaa can be any naturally occurring amino acid
  misc_feature (239)..(239): Xaa can be any naturally occurring amino acid
MGGGVMRTAAKVGLAGGAAAAAGRFRNVAPSFATAPAAEAAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSTDSVESPEKFEEASPEXCTYPLPSPLADFVXNAKKTMMEMVDNITNFFQDLFHNPAEAEAGPGSSSKKPSFAEMAAGGSFMALAMAVILVVLFKRA

SEQ ID NO: 6993 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQRLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILYGGARPQHLRRGFFIEPTIITDVSTSMQIWREEVFGPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 6994 - protein, 445 aa, Nitrosomonas europaea ATCC 19718
MKIIIAALTGLIMVVTVFAMEKTVTPNSVNVKQTIDSKTDYIVLGMGCFWGAEKRMGELSGVIDVESGYAGGDHADAGYQDILNFEHALRAGKTAGRNHAEVVKVTFDPAQVALEHVLARFWESHNPTQGDRQGNDIGSNYRSAVYYHDENQKTLALTTRKIYQQALATAGYGQITTEILPLKNYITAEEYHQNYLQKNPDGYCGLGGTGVKYPAPDQHIIRGDTSSVPASPSPQSLDGKNLNFDQQLVIFESENCEFCAQFDRDILAHWQADIPMVATKNTNPPADWTLDKPLFAAPTIVLFREGKEVVRYTGYTGEKENFWQWLGFQMLTPEQQKIAFQQGTERPFTASNLDEKRPGRFVDPITGATLFFSKTKFNSGTGWPSFFEPVEGSVTYHEDHSGYMQRIEVRSASSGIHLGHVFDDGPPPSYKRYCINGNVLKFIPD

SEQ ID NO: 6995 - protein, 418 aa, Bradyrhizobium japonicum USDA 110
MSRLVMKFGGTSVANIERIRNVARHVKREVDAGHEVAVVVSAMSGKTNELVAWCTEASPMHDAREYDAVVASGEQVTSGLLAIVLQSMGIQARSWQGWQIPIKTSDAHASARIEDIDGSEIIKRFRDRKEVAVIAGFQGINPETNRITTLGRGGSDTSAVAVAAAVKADRCDIYTDVDGVYTTDPRIVPKAKRLGKIAFEDMLELASQGAKVLQVRSVELGMVHNMPIFVRSSFDKPEDIDPHANQPPGTLICSEEEIMESHVVTGIAFSKDEAQISVRQIEDKPGVAASIFGPLADANINVDMIVQGVSEDGKTTDLTFTVPAADFTRARDTITAAKGKIGYARLDTATDVAKISVIGSGMRSHAGVAAQAFSALAGRNINIRAITTSEIKFSVLIDTAYTELAVRTLHTLYGLDQA

SEQ ID NO: 6996 - protein, 128 aa, Oryza sativa Indica Group
MATIAAAAAARTAVVGRPSGVAQLRARRGERVRCGYSSRDGKEATPAAAVKGATSMLAAAVTASSSSAPAAMALVDERMSTEGTGLSLGLSNNLLGWILLGVFGLIWSLYTVYTSTLDDDDESGGLSL

SEQ ID NO: 6997 - protein, 755 aa, Bradyrhizobium japonicum USDA 110
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYDRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 6998 - protein, 147 aa, Triticum aestivum
  misc_feature (13)..(13): Xaa can be any naturally occurring amino acid
  misc_feature (113)..(113): Xaa can be any naturally occurring amino acid
  misc_feature (129)..(129): Xaa can be any naturally occurring amino acid
MEDLSVEELASNXSTYKDQLREVRKFIKEKKDDAGISEYVDMEKELQEVITLTEELLATANPSESAQNDVGLSPPNYSAGVHSEALDDLSQSHEKFAVGTCPGGRSEDGSGHXATIEGLHQSVFVLMKXWGKRKSDPANVRPLSVNL

SEQ ID NO: 6999 - protein, 495 aa, Eustrephus latifolius
MRTNPTTSGPAVSILEEKNLGRIVQIIGPVLDVVFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEGEKK

SEQ ID NO: 7000 - protein, 496 aa, Globba curtisii
MRTNPTTSSPVVSTLEEKNLGRIAQIIGPVLDVVFPPGKMPNIYNALVVKGRDTVGQQINVTCEVQQLLGNNRVRAVAMSATDGLTRGMEVIDTGAPLSIPVGGATLGRIFNVLGEPVDNLGPVDTSTTSPIHRPAPPFIELDTKFSIFETGIKVVDLLAPYRRGGKIGLFGGAGVGKTVLIMELINNIAKAHGGVSVFGGVGERTREGNDLYIEMKESGVINEKNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDSLPEQAFYLVGNIDEATAKAINLEVEGKL

SEQ ID NO: 7001 - protein, 496 aa, Hedychium flavum
MRTNPTTSSPVVSTLEEKNLGRIAQIIGPVLDVVFPPGKMPNIYNALVVKGRDTVGQQINVTCEVQQLLGNNRVRAVAMSATDGLTRGMDVIDTGAPLSIPVGGATLGRIFNVLGEPVDNLGPVDTSTTSPIHRPAPAFIELDTKFSIFETGIKVVDLLAPYRRGGKIGLFGGAGVGKTVLIMELINNIAKAHGGVSVFGGVGERTREGNDLYIEMKESGVINEKNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDSLPEQAFYLVGNIDEATAKAINLEEEGKL

SEQ ID NO: 7002 - protein, 469 aa, Symbiobacterium thermophilum IAM 14863
MRRVIIGPGAGFRTGGDHMNLKELDLRHLIHNEVRFRELARKGTTVITRAEGSTIWDIDGRAYLDAQAGMVLVNVGYGRRELGAVAAAQMERLMYYHTYFQYSNEPAVRLAAKLASLAPEGLGKVFFTLGGAESVETAVKIARLYQRARGRADGHKIICLDLGYHGNSLGALSATAFEAHRAYYGPLVPGFVHIPSPDTFEGPFRADDPEAGRKYAALLEERILAEGPETVAAFLAEPILGVGGIIVPPDDYLKHVRRICDKYGVLLILDEVMTGFGRAGTMWACGQFGVVPDLMCTAKGLTSGYLPLGAVLVGDHVIEAIAEADFPFEHGFTYAGHPVSCAVAMENIAILEREGLAERAARMGERLKEALLARDNPYIAEVRGRGLMVAAELVRDRETRERFPEGNRAFRFDVEAGCLREGVITGIAPYRDTLMITPPLVITEAEIDRLVDVYDRVIRQEGDRRRKQG

SEQ ID NO: 7003 - protein, 347 aa, Streptococcus suis 89/1591
MKTAIYEKSGKMTVAEIEKPSLQAKDDVIIKVVRACVCGSDLWGYGEDIHHDHGDTNSGHEAIGIVEEVGEDITTLVPGDFVIVPFTHGCGHCDACRAGFDGTCDNHPGYTNWGNNYQSQYIRFHYGNWALVKIPGQPSDYSEGMIKSLLTLADVMPTGYHAARVADVKPGDKVVVIGDGAVGQCAVIAAKMRGASQIVMMSRHTDRQQMALESGATAIVAERGEEGIAKVREILGGGADAALECVGTEASIDQALGVLHNGGRIGFVGVPHYNNHALGSTFAQNIIIGGGSASVTTYDKEILLDAVLKGDINPGRVFTQTYSLDNIDQAYKDMANRKTIKAMITVD

SEQ ID NO: 7004 - protein, 361 aa, Arabidopsis thaliana
QLPNEDLDALISVSTDEDVENMMDEYDRVAQNQNPRASRLRLFLFTKNVAGEEDNDSRASSISSLLDSSVNREQWFLDALNLGSSAAATAVSNGGSGRVFERVRSEVSSIVSEVPDYLFGLDNFDETAPPHELRDRDPRAKIQREVSTLSDPGSPRRDVPSPYGSTSSAPVMRISTPELPPPVFIKPESPEPVSTPKSNPQPEQVMQQSNLPVNSQWQYAPGPGQQVHYQGHTIHQSPVYYVPGSVPGNHMVQQGNHMVQPGNHMVQPVQMPGQYLQQYHHVPMGYHQPQTHQMAGPGQVYGGTVRPVMMAVDGMNRTGYYGMKTPGPVQMYQHHTGMVVPGVEEQQQYRTETDSDTGRAS

SEQ ID NO: 7005 - protein, 512 aa, Photobacterium profundum SS9
MTAENTQILDLIVVGGGINGAGIAADAAGRGLTVGLYEADDFASATSSASSKLIHGGLRYLEHYEFRLVGEALAEREVLLKKIPHIARPMRFRLPHRPHLRPAWMIRAGLFMYDNLGKRTTLPASHGLKFGQDSVLIPEITKGFEYSDCWVDDARLVILNAMEVAEKGGDVRNRCRVEKAVREGEFWLVTIRDVQTNEIFVRKSRALVNAAGPWVKAFFDNSMEEVSPRNIRLIKGSHIVVPRAHDEPQAYILQNEDNRIVFVIPYLDRFSIIGTTDVEYNGDPRNVAIDDSEIDYLLKAYNANFVKKLDRTDVVWTYSGVRPLCDDESDSPQAITRDYTLELEQQANKAPLLSIFGGKLTTYRKLAEAAMTKLSPFFSNMGPSWTADSYLPGGEANFSIPQLAKKLQQQHAWLSAFTCERMATNYGNRAVRLLEGVNGEADMGKHFGEGLYARELDYMIEQEFAQNEIDALWRRSKLGLYLNDEQIAAVAQYITDKALSIEAKKSEANVAA

SEQ ID NO: 7006 - protein, 556 aa, Burkholderia sp. 383
MSRRGIPPDSRFTRTAMTLNSLPAWTALQSHFEQIRHARLRDWFAPENDHTPTRAERFTIPGGGIAADFSKNRINDDTLRLLVQLARDAGVEARRDAMFAGEIVNPTEGRAALHTALRATDPQAPFHAQISAERAKMATFARAVRSGTWTGYTGKRIRHVINIGIGGSDLGPKMVVHALHHVATPEITTHFVSNVDGADLARVLEQVDPEETLAIIVSKTFTTLETMTNARSLRDWFVARGCPEDALAKHFVGVSANPAEVVKFGIAADNVFEMWDWVGGRYSLWSAVGLSIMIAIGPEQFDELLAGANDMDRHFREAPLERNLPVLLGLIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKVAGPGKEALAPHLTFPGNRPTTTLLVDALTPRTLGALIALYEHKVLVQATVWDINPFDQWGVELGKILGKVVEADLSAESIDPAKHDSSTTALIERARAALKR

SEQ ID NO: 7007 - protein, 257 aa, Rickettsiella grylli
MRGQYIIGNWKMNGCKTSVTSLLNALRDVEKKEQSNVTMVVCPPYIFLDKTQKMLEKSPLQWGGQNMAAEPEGPYTGEISGLMLYEFGCRYVLLGHSERRQHYAETNDQIAKKFNLAVNSGLTPILCVGETLAERQANQTQVVLQTQLEKIIAHASPLLPQAIIAYEPVWAIGTGVSAEPEQAQEIHQFLRDQIRMVDSDLAQILPILYGGSVKISNANALFQMPDIDGGLIGGASLDASEFLSIYEIMTSIERHNS

SEQ ID NO: 7008 - protein, 380 aa, Sorghum bicolor
MGSSCSRSHSLDETEAAENAKSADIDRRILQETKAEQHIHKLLLLGAGESGKSTIFKQIKLLFQTGFDEAELKSYTSVIHANMYQTIKILYEGAKELAQVEPDSSKYVLSPDSQEIGEKLSEIGVRLDYPSLNKERVQDVRKLWQDPAIQETYSRGSILQVPDCAQYFMENLDRLSEVDYVPTKEDVLHARVRTNGVVETQFSPLGESKRGGEVYRLYDVGGQRNERRKWIHLFEGVNAVIFCAAISEYDQMLCEDETKNRMMETKELFDWVLKQRCFEKTSFMLFLNKFDIFERKIQKVPLSACEWFKDYQPIAPGKQEVEHAYEFVKKKFEELYFQSSKPDRVDRVFKIYRTTALDQKLVKKTFKLIDESMRRSREGT

SEQ ID NO: 7009 - protein, 406 aa, Triticum aestivum
MASLSLSLRASASSAAAGSRAAAPIKASCVRSKVTCSLPSIRATSSPARSIEPVRATATQAPPATPQSSSGEKTKVGINGFGRIGRLVLRIAIDRDDIEVVAVNDPFIDAKYMAYMFKYDSTHGPFKGTITVLDESTLEINGKKVSVTSKRDPSDIPWGNFGAEYVVESSGVFTTVEKASAHLKGGAKKVVISAPSADAPMFVVGVNEKNYNPSMDVVSNASCTTNCLAPVAKVVHEEFGILEGLMTTVHATTSTQKTVDGPSMKDWRGGRGAGQNIIPSSTGAAKAVGKVLPALNGKLTGMAFRVPTPNVSVVDLTCRLEKNASYEDVKAAIKEASEGSLKGILGYTDEDVVSNDFVGDTRSSIFDANAGMGLSSSFMKLVSWYDNEWGYSNRVLDLIGHMSLVA

SEQ ID NO: 7010 - protein, 402 aa, Streptomyces coelicolor A3(2)
MEFRQSNKLSEVCYEIRGPVIEHANALEEAGHSVLRLNTGNPALFGFEAPEEIVQDMIRMLPRAHGYTDSRGILSARRAVAQRYQALGLEVDVDDVFLGNGVSELISMAVQALLEDGDEVLIPAPDFPLWTAVTTLAGGKAVHYLCDEQAEWYPDLADMEAKITDRTKAVVIINPNNPTGAVYPKEIVEGILDLARRHGLMVLADEIYDQILYDDAVHHSAASLAPDLVVLTFCGLSKTYRVAGFRSGWLVVTGPKQHARDYLEGLTMLASMRLCANAPAQYAIQAALGGRQSIRELTAPGGRLHEQRDVAWEKLNEIPGISCVKPKGALYAFPRIDPAVHKIHDDERFVLDLLLREKIQVVQGTGFNWPSPDHFRILTLPHAEDLEAAIGRIGRFLSGYRQ

SEQ ID NO: 7011 - protein, 208 aa, Saccharomyces cerevisiae
MSLSSKLSVQDLDLKDKRVFIRVDFNVPLDGKKITSNQRIVAALPTIKYVLEHHPRYVVLASHLGRPNGERHEKYSLAPVAKELQSLLGKDVTFLNDCVGPEVEAAVKASAPGSVILLENLCYHIEEEGSRKVDGQKVKASKEDVQQFRHELSSLADVYINDAFGTAHRAHSSMVGFDLPQRAAGFLLEKELKYFGKALENPTRPFLA

SEQ ID NO: 7012 - protein, 135 aa, Saccharomyces cerevisiae
VDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 7013 - protein, 195 aa, Synechococcus sp. CC9605
MANLDQAPSRSMPNLLHVLPAFADEAELRLNTIVELNSNTINKYELITETGHLKLDRVGYSSLAYPFAYGCIPRTWDEDGDPLDIEIVGVTEPLIPGSIVEARIIGVMTFDDGGEVDDKVIAVLADDKRMDHIKSWEDLGEHWKKETTYYWEHYKDLKKPGTCSVNGFFGTEKAVEIIKSCEARYTAEIDPKLVD

SEQ ID NO: 7014 - protein, 141 aa, Physcomitrella patens subsp. patens
MAEDRYKPWWAIDKAAWREAFEPFFKFKSISDHRDTPLPPWSEADVQEFIDSDPVYGPRLKQVRQGATIANYGALVGGLATAGVAFRYSKNIPGALGAFLGGTAMSWAVAEEGANFALGLYKFNCMDVNLKFLDWWERKQG

SEQ ID NO: 7015 - protein, 746 aa, Yarrowia lipolytica CLIB122
MQLSASTVKSINLLLKVSILLTIAGAAVSSRLFSVIRFESIIHEFDPWFNFRASKYLVNNSYYKFLNWFDDKTWYPLGRVTGGTLYPGLMVTSGVIHKLLRMVALPIDIRNICVMMAPAFSGLTAYATYLFTSEMKDQSAGLLAAAFIGIAPGYISRSVAGSYDNEAIAIFLLMITFYTWIKALKMGSAFWGAVCAAFYFYMVAAWGGYVFITNMIPLHVFVLILMGRYNDRIYVAYSTWYALGTLASMQIPFVGFLPIRSSEHMAALGVFGLVQLAAFANYIKSQVTPKQFKYTVGLSLVGLIAIAFAGLVGLTVSGVIAPWTGRFYSLWDTGYAKIHIPIIASVSEHQPTAWPAFFFDTQMLIWLFPAGVYLIFQELRDEHIFVIVYSILGSYFAGVMVRLMLTLTPVICVSAAIAISTLLDVYGDFSTKTKGDTVLVPKYQPLGHEKPGEVVEDDEDDETVDKAAKFTLGLVAKGAVIVSFLFYLGMFVYHCTWVTSNAYSSPSVVLASRMPDGSQHLIDDYREAYYWLRMNTPEDARIMSWWDYGYQIGGMADRTTLVDNNTWNNTHIATVGKAMSSSEEVAYPILRQHDVDYVLVIFGGHLGYSGDDINKFLWMVRIAEGIWPDEIKERNYFTPAGEYKVDDKASEAMKNSLMYKMSYYRFAEGTQKPDRVRNQWIPPTPIELNTLEEAYTTENWLVRLYKVKDLDNLGRDLKSAKSFDTGKAKKKGKAAYSEKRAFELRE

SEQ ID NO: 7016 - protein, 241 aa, Oryza sativa Indica Group
MAAVFHFGLGLPLFYGIYHEFSQQWITEGLEEGLRTAEKTNWWVVFHGCFKISTQFLLNFYRKSQAWSSTVSFSDIDEKSEMGGDDDYTDSRRELEPQSVDPKKGWGFRGVHRAIICGKVGQVPVQKILRNGRTVTVFTVGTGGMFDQRVVGDADLPKPAQWHRIAIHNDQLGAFAVQKLVKNSAVYVEGDIETRVYNDSINDQVKNIPEICLRRDGKIRLIKSGESAASISLDELREGLF

SEQ ID NO: 7017 - protein, 523 aa, Phragmites australis
MEVGAPGSSLHGVTGREPAFAFSTSAVPDDDAASKFDLPVDSEHKAKSIRLFSFANPHMRTFHLSWISFFTCFVSTFAAAPLVPIIRDNLNLTKADIGNAGVASVSGSIFSRLAMGAICDLLGPRYGCAFLIMLTAPTVFCMSLIDDAAGYIVVRFLIGFSLATFVSCQYWMSTMFNSKIIGTVNGLAAGWGNMGGGATQLPMPLVYDVIRKCGATPFTAWRIAYFVPGLMHVVMGILVLTLGQDLPDGNLRSLQKKGDANKDKFSKVLWYAVTNYRTWIFVLLYGYCMGVELTTDNVIAEYYYDHFDLDLRVAGIIAACFGMANIVARPLGGILSDIGARYWGMRARLWNIWILQTAGGAFCLWLGRASTLPASITAMVLFSFCAQAACGAIFGVTPFVTRRSLGIMSGMTGAGGNFGAGLTQLLFFTSSKYSTGMGLEYMGIMIMACTLPVVFVHFPQWGSMLLPPSAGAVEEHYYSSEWSEEEKSKGLHSSSLKFSENCRSERGNRNVILAAPNSTPEHV

SEQ ID NO: 7018 - protein, 515 aa, Pseudomonas aeruginosa PAO1
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAGAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFNEFPRERAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 7019 - protein, 377 aa, Zea mays
MARRSAPLLRRLVSASSPPALQSLTDHVGVLARRTVTYMPRPGDGAPRAVTLIPGDGIGPLVTGAVRQVMEAMHAPVYFETYDVHGDMPTVPPAVIESIRRNKVCIKGGLATPVGGGVSSLNMQLRKELDLYASLVHCSNLPGLPTRHEGVDIVVIRENTEGEYSGLEHEVVPGVVESLKVITKFCSERIAKYAFEYAYLNNRKKVTAVHKANIMKLADGLFLESCREVASKYPGIQYNEMIVDNCSMQLVSKPEQFDVMVTPNLYGNLVANTAAGIVGGTGIMPGGNVGQDYAIFEQGASAGNVGNENLVEQKKANPVALLLSSAMMLRHLQFPSFADRLETAVKRVVAEGTYRTKDLGGSSTTQEVTDAVVANLD

SEQ ID NO: 7020 - protein, 714 aa, Arabidopsis thaliana
MDDGTPKKLNILPDHFSAPSPTAESSQHDTPSSSQPKDDSSLRSYSQSRTRRNLKRAATMLNLFTLRRLPWVSDGQEKVELSAAELESLRSELSDMEEREAYLKAQLEHVDEVLRSARLSALPGEPPPIDDTEVDDWLPRFVVLQGPCLFFYLLSTDLSPQDSTLLADIVEIGSVPSYTREFDETHYCFYILTRQGLRFECSSTSKTQVDSWLSVLRLDCKSEPEERFTFLRSLFAHHSSQSSRIVSEKMSSQICRSASRAARSLLSSAKNARFFSEGRAIGAASVVHATGKVPQYASNFGKSGSGFVSNSWITGLLALPAAEPYYIRLAFFFIISVIAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTKRYFSFDLSLRSSSSSLSLIVFSCKMETGTPLIAETIALTEKKVAMALDDIIKLAKRKTNVNKGKKPRREKNKNQNFNGAARNNTSNVRHHMNSLSAVRQGAVGKRRSRFQGIQFPVTTNIARKASTAAPLDFRGRAFNGGRMTSANQSRLIAPPVQNISVQARVNAKRHEVDQKVEHRGGKRKTLDSRFASMKEQRMTINNYGVTVQVPRLPPWVRARRFSQ

SEQ ID NO: 7021 - protein, 344 aa, Triticum aestivum
  misc_feature (122)..(122): Xaa can be any naturally occurring amino acid
MANPAPATGGKSFLQAMSTVTEEAAVQLRVVQMEGLAVLKIIKHCEEFAPALVTGQLLGLDVGSVLEVTNCFPFPIREDDEEADADGANYQLEMMRCLREVNVDNNTVGWYQSCLLGSFQTXVELIETFMNYQENIRRCVCIVYDPSRSSQGVLALKALKLTDSFMDLYRNNGLTGEKLREKKLSWVDIFEEIPIKVSNSALVSAFMKELEPESPVSQCDFDRLKLSTAPFMERNLEFMIGCMDGLSSEQNKFQYYYRNLGRQQSQQQAWLQKRRQENMSRKAAGEEPLPEEDPSNPIFKPLPEPSRLEGYLVTNQISSYCNHINGVAGQSFNRLYLMKALQED

SEQ ID NO: 7022 - protein, 510 aa, Oryza sativa
  misc_feature (155)..(155): Xaa can be any naturally occurring amino acid
  misc_feature (181)..(181): Xaa can be any naturally occurring amino acid
MAATPPSSQHRRPLSSSASAASLAGKPRGGGLLLGRYELGRLLGHGTFAKVYQARSADSGEPVAIKVLDKEKAMRHGLVPHIKREIAILRRVRHPNIVRLFEVMATKSKIYFVMELVRGGELFGRVAKGRLKEDTARRYFQQLVSAVGFCHARGXVFHRDLKPENLLVDEHGDLKVSDFGXLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTIGAEIFELTPSLVVVEVKKKAGDKEEYDDFCNRELKPGMQHLVHHMGSVPNIPSDTE

SEQ ID NO: 7023 - protein, 472 aa, Yersinia pestis KIM
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 7024 - protein, 217 aa, Burkholderia sp. 383
MITRAELLDMLASNAPQGFEAQALGLVPIVVETSGRGERSYDIYSRLLKERLVFMVGEVNDQTANLVVAQLLFLESENPDKDISLYINSPGGSVSAGMAIYDTMQFIKPDVSTLCMGLAASMGAFLLASGAKGKRFALPNSRVMIHQPLGGARGQASDIEIQAREILYLKERLNQLLAQHTGQDVERIARDTDRDNFMSSEDAKAYGLIDQVLLKRP

SEQ ID NO: 7025 - protein, 335 aa, Yersinia pestis KIM
MIFTLREIYVLLCTSIKKECVMELKDIGNTELIELKNLSINNNSLFSKCEFNNPTGSHKDRTFLHILNILEEENKIIPGMTLIDCSTGNGGAALAWIGQKKGYKIKIFMPEGMTEERKEQIYSFGGEIIETPKENFLKGAVKAATEYSNHQKNIFFLNQSDTTLNKDAWHSCGEEIVRKMKEINKKPDYFICSIGTGGTFSGIAEILKKAYPRIHTVGIEVDQSAPIYSQRHGLNFHHKHHNLMGLGAGVISVNTLLDLIDEVRVVNGKAAWERMKSFIEKERLGIGPTCGANLLITEDIMQEVNGKVIVTLFFDSAWKYKSCWDGVYPGYKETQ

SEQ ID NO: 7026 - protein, 365 aa, Lotus japonicus
MDFSSSNGSEDTELSQAQIHLYKHVYNFVSSMALKSAMELGIADVIHSHGKPITLPELATALNLRPSKIGVLHRFLRLLTHNGFFAKTTVSRGEGAEEETAYGLTPPSKLLVKSNSTCLAPIVKGALHPSSLDMWRSSKKWFLEDNEELTLFESATGESFWEFLNKETESDTLSMFQEAMAADSHMFKLALKECKHVFEGLGSLVDVAGGRGGVTKLIREAFPHVKCTVFDQPQVVANLTGDENLNFVGGDMFKSVPPADAVLLKWVLHDWNDELSLKILKNCKEAISGRGKEGKVIIIDISIDETSDDRELTELKLDYDLVMLTMFNGKEREKKEWEKLIYDAGFSSYKITPICGFKSLIEVFP

SEQ ID NO: 7027 - protein, 304 aa, Arabidopsis thaliana
MRTLSSQLYSNGGLTWFQKKNQSSLFIKHLRVSKPSRVQLISAVQFRPCIDIHKGKVKQIVGSTLSDLKEDGSVLVTNFESDKSAEEYAKMYKEDGLTGGHVIMLGADPLSQAAAIGALHAYPGGLQVGGGINSENCMSYIEEGASHVIVTSYVFNNGKIDLERLKDIVSIVGKQRLILDLSCRKKDGRYAIVTDRWQKFSDVILDEKSLEFLGGFSDEFLVHGVDVEGKKLGIDEELVALLGNYSPIPVTYAGGVTVMDDVERIKDAGKGRVDVTVGSALDIFGGNLPYKDVVAWHHKQHSLH

SEQ ID NO: 7028 - protein, 568 aa, Arabidopsis thaliana
MEHYEVLEQIGKGSFGSALLVRHKHEKKLYVLKKIRLARQTGRTRRSAHQEMELISKIRNPFIVEYKDSWVEKGCYVCIVIGYCKGGDMAEAIKKANGVEFSEEKLCKWLVQLLMALEYLHASHILHRDVKCSNIFLTKDQDIRLGDFGLAKILTSDDLASSVVGTPSYMCPELLADIPYGSKSDIWSLGCCMYEMTALKPAFKAFDMQGLINRINRSIVAPLPAQYSTAFRSLVKSMLRKNPELRPSASDLLRQPLLQPYVQKVLLKLSFREHDTLPSESERRSSYPQQRKRTSGKSVSFGPSRFGVDQEDSVSSVKPVHTYLHRHRPVDLSANDTSRVVVRRPAVSSVVSNSSKYVPVRSNQPKSGGLLKPAVVTRRASLPISQKPAKGTKDSLYHPNIGILHQLNSPDVSVNSPRIDRIKFPLASYEEMPFIPVVRKKKGSSRGSYSPPPEPPLDCSITKDKFTLEPERETKSDLSDQNATAGASSRASSGASRRQRFDPSSYRQRAEALEGLLEFSARLLIDERYDELNVLLKPFGPGKVSPRETAIWLSKSFKESSPSNLEED

SEQ ID NO: 7029 - protein, 141 aa, Arabidopsis thaliana
MAAIYSLYIINKSGGLIFYKDCGTKGRMDTNDSLRVASLWHSMHAISQQLSPVNGCSGIELLEADTFDLHCFQSLPGTKFFVVCEPGTPHMESLLRYIYELYTDYVLKNPFYEIEMPIRCELFDINLTQAVQSDRVALLGR

SEQ ID NO: 7030 - protein, 474 aa, marine gamma proteobacterium HTCC2143
MSRDMRQSFIDRLRCYALDEKLQTRSRVSGRLVRVVGMTLEVVGLELSIGCRCLVMHDDQRSVEAEVVGFSEEKLFLMPIEPVTGLKPGMAVVPVAYEDKVPVGIQLLGRVIDGAGRPLDSKGPLGCTDSVDMQAELINPLQRKPISEVLDVGIRAINSVLTVGRGQRLGLFAGSGVGKSVLLGMMTRFTEADVVVVGLVGERGREVKEFIEQVLDEEGLSRAVVVASPADDAPLMRMRAAMLATRIAESFRDQGKHVLLLMDSLTRFAQAQREIALSIGEPPATKGYPPSVFAKIPQLVERAGNGADGSGSVTAFYTVLTEGDDMQDPVADAARAILDGHIVLSRALADEGHYPAIDVEASISRAMPNIITGEHLAAARRLRHLYSRYQQSRDLISVGAYVAGSDTETDAAIERLPAIRRFLQQDLDIAFNVAGSVAEMRAVINPSVVNSSESPSLQMAASSNTGGDISPAIR

SEQ ID NO: 7031 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQELFKEFGCESKLRVDGDGKPYVTDNSNYIIDLYFKTPLKDGFAAAKEIGKFQGVVEHGLFLGMATSVIIAGKNGVEVMTK

SEQ ID NO: 7032 - protein, 503 aa, Arabidopsis thaliana
MYRTAASRARALKGVLTRSLRPARYASSSAVAETSSSTPAYLSWLSGGSRAALTSLDMPLQGVSLPPPLADKVEPSKLQITTLPNGLKIASETTPNPAASIGLYVDCGSIYEAPYFHGATHLLERMAFKSTLNRTHFRLVREIEAIGGNTSASASREQMSYTIDALKTYVPEMVEVLIDSVRNPAFLDWEVNEELRKMKVEIAELAKNPMGFLLEAIHSAGYSGPLASPLYAPESALDRLNGELLEEFMTENFTAARMVLAASGVEHEELLKVAEPLTSDLPNVPPQLAPKSQYVGGDFRQHTGGEATHFAVAFEVPGWNNEKEAVTATVLQMLMGGGGSFSAGGPGKGMHSWLYRRVLNEYQEVQSCTAFTSIFNDTGLFGIYGCSSPQFAAKAIELAAKELKDVAGGKVNQAHLDRAKAATKSAVLMNLESRMIAAEDIGRQILTYGERKPVDQFLKSVDQLTLKDIADFTSKVISKPLTMGSFGDVLAFPSYDTISSKFR

SEQ ID NO: 7033 - protein, 256 aa, Pseudomonas fluorescens Pf-5
MKPAMPRRVWLTGASSGIGAALAEELLKAGAQLALSARSREPLEALAKRYPGRVLVVPGDLTDALQVRQIGKRIAQAWGALDTVILNAGTCEYIEVQQFDAALIERVLNTNLLAASYCIEAALPLLRAGNRPYLVGVASSVTCLPLPRAGAYGASKAALRYLLQSLRIDLAAEGIDVTLVSPGFVDTPLTARNDFPMPMRWTAEQAARHIHRHLGRRPLEIAFPGLFIFGLKLLAWLPGRLQLGIARRLARSGETS

SEQ ID NO: 7034 - protein, 426 aa, Nostoc sp. PCC 7120
MTSTLRKLPRLNAPKLHTLPNGLTIIVEQMPVEAVNLSLWIDVGSSVESDAINGMAHFLEHMIFKGTERLASGEFERHIEERGAVTNAATSQDYTHYYINTAPQDFAKLAPLQIDVVLNASIPDEAFERERFVVLEEIKRSEDNPRRRTFRRAMETAFAQLPYRRPVLGPESIISQLTPQQMRDFHASWYQPQSITAVAVGNLPEEQLIETITEGFNQLKKTPHSPLLTPHSLHLEPAFTEIVRREFVDESLQQARLIMVWRVPGLNQLEQTYGLDVLAGILAHGRTSRLVQDLREERGLVTSISVSNMSNRLQGTFYISAKCAVEDLAAVEEAIAQHIRKLQTELVTEKEIARVRKRVANRFIFGNETPSDRAGLYGFYQSLVGDLEPAFNYPAHIQTQEAPDLLLAANQYLCPEAYGVVVMKPA

SEQ ID NO: 7035 - protein, 287 aa, Nostoc sp. PCC 7120
MWTEIDTQISRVTGERFQSQQRRSVSGGCINQGYAVADGTLTYFVKLNQASQVAMFEAEALGLEQMLTTNSIRVPKPICWGIAGNSGYIVLEWLEMGSGNTNSWEEMGRNLAKMHKATSQKGYGWDMNNTIGSTPQINTWTEDWTEFYSKHRLGYQFQLARRRGGSFPKQDELLGALPELLADHEVQPSLVHGDLWGGNAGCTVSGEPVIFDPATYFGDREVDIAMTELFGGFPAAFYKGYNQVFPLDAGYEKRKTLYNLYHILNHFNLFGGGYASQANRMIEQILR

SEQ ID NO: 7036 - protein, 221 aa, Brassica napus
  misc_feature (47)..(47): Xaa can be any naturally occurring amino acid
  misc_feature (95)..(95): Xaa can be any naturally occurring amino acid
  misc_feature (111)..(111): Xaa can be any naturally occurring amino acid
STHASGQGGGSQVPSRHATNQGFDVVPSPTLSASRKKQKTFQSYHPXSRVVPRGVSANESAEALIGRKVWTKWSEDNNFYEAIITQYNAVEGRHXLYDINAVNETWEWVDXKEISPEDISWDGEENGAALNVGVGSGSTRGNRRNQSHFGRGRGPRIHQPRNEFVRLPTQQNGGDVVDRRTYFADIELFNTDSLVKEVSFLFYLLLHIVGDGLHPSTRPIE

SEQ ID NO: 7037 - protein, 293 aa, Synechococcus sp. CC9605
MAQSTQHNDDALRVSVLSEALPYIQSFAGRRIVIKYGGAAMAHAELRSAVFRDLALLACVGVRPVVVHGGGPEINQWLQRLEIPAEFRDGLRVTDADTMDVVEMVLVGRVNKQIVNGLNQLGTRAVGLSGSDGSLVEARPWGNGSHGLVGDVARVNPDVLEPLLEKGYVPVISSVAATPDDGRAHNINADTVAGELAAALEAEKLILLTDTPGILEDRDDPDSLIRKLRLSEARQLIEDGVVAGGMTPKTECCIRALAQGVSAAHIIDGRVPHALLLEVFTDAGIGTMVVGRS

SEQ ID NO: 7038 - protein, 135 aa, Zea mays
MAQTQYIFNYSLKFRHKDALVSALVKNNPRSVVAVMEELVSRRKLIRCIGNLDNEELGLLLEFLHRNATLPRYAKLLLCLANKVVEMREADIRSDEKLKVHMRNLKRMVAEEIQIQHMLQGIQGMISPMLALATR

SEQ ID NO: 7039 - protein, 314 aa, Polaromonas sp. JS666
MTSALDVITFGEAMMLLVADRPGPLEHAEAFHKRTAGAETNVAIGLARLGLKVGWASRLGTDSMGRYLLAAMAAEGIDCSHVVCDATQKTGFQFKGKVTDGSDPPVEYHRKGSAASHMGVADIDEAWLLSARHLHATGVFPAISATTLPAARKTMDLMRAAGRSVSFDPNLRPTLWATPELMRDAINDLATRADWVLPGMEEGRFLTGETTPEGVARFYRQLGAKLVVVKLGAEGAYFDGEAGSGRVAGFPVAEVVDTVGAGDGFAVGVISALLDGLGVPEAVKRGAWIGARAVQVLGDSEGLPTRAELNAAKL

SEQ ID NO: 7040 - protein, 278 aa, Borrelia garinii PBi
MKGIILAAGYGTRFLPITKTIPKEMLPILNKPAIDYIIQEFIDSGIKDILLISSRRKKVLEDYFDREIELENIFLKENKKNELEKIKNKKINISFIRQKEMLGTGNALLYAKPWINREPVIVAYPDDLHIGNPALSLQLIKLYEKTGKNIISIIENPENINRYGVIDLYEDKIHVKNIVEKPKIGSEPSNKASIGRFLYNYEFFEHLEEGFKLHQKGEYYHIYALKKLMDQKKVLYKNIKGKRIDIGTLEGYLDAIINFAKKNKNLMEIIKKGINEND

SEQ ID NO: 7041 - protein, 260 aa, Frankia sp. EAN1pec
MIEILSPAKLAQAKDTGALVADILQTLKSRSTVGTSLLDIDRWTKTMIVEAGAQSCYVDYEPSFGRGPFGHYICTAVNDAVLHGLPYDYTLADGDLLTLDLAVSRDGVAADSAISFIVGDSKPPESVAMINATERALYAGITAAGPGARIGDISHAIGSVLGEAGYPINTEFGGHGIGSTMHQDPHVSNTGRPGRGYRLRPGLLLALEPWVMADTAELVTDADGWTLRSATGCRTAHSEHTIAITNDGAEILTLPKQVQP

SEQ ID NO: 7042 - protein, 577 aa, Yarrowia lipolytica CLIB122
MEKNEVVSTNSPHEEGSVTEANNGRWANFKDSFRRADLSEYDTEGLSDLEKAALATANSPLSRSLKGRHLQMIAIGGSIGTGLFVGSGTTLATGGPAAILIAYSIIGTMLFCTMHSLGELCACFPVSGAFASYSTRFIDPAWGFAMGWNYTLNWFIVFPLELVAASLTVNYWNEANGTNYNAGCWVAIFWVLIVSINFFGVKGYGEAEFYFSLIKVIAVVGFIILAIVLTCGGGPNHDYIGGRYWHNPGAFSAGAKGVCAVFVSAAFAFNGTELAGLAAAETANPRKSIPTATKQVFWRITLFYIVSLTLVGFLVPWDHPQLLNKSSSADASASPFVIAIKAAGIKGLPSVMNVVIMISVLSVGNSSIFGFSRTIAALAQQGQAPSFFAYIDRKGRPLFGIITVSLFGLFAFICAGPIETQNTVFYWLMAICGLSSIFTWGSINLCHFRFRMAMKVQGRSLREMPFLSHVGTIGSMYGFLLNVTVLGLQFWIALFPVGGAKPKADVFFQAYLAVPVVLAFYIFFKLWKRPSFVALKDMDLDTGRRETDFELLMHEMDEEAAYIASKPFYYRVYKFWC

SEQ ID NO: 7043 - protein, 183 aa, Malus sp.
MASSMISSGTVATVSADRPAPAQARMVAPFTGLKSSSASPVTRKSNDITSIASNGGRVQCMQVWPPLGLKKFETLSYLPPLSTESLAKEVDYLLRKNWVPCLEFELEHGFVYRENHRSPGYYDGRYWTMWKLPMFGCTDSSQVLKELEEAKKAYPQSFIRIIGFDNVRQVQCISFIAYKPAGF

SEQ ID NO: 7044 - protein, 556 aa, Zea mays
MGIYRTGLYKKARAYRLRNSRDSLSVSYRQVCGKRDTRDKPRLLSRVLTYFFCTTYCARKTLTPRSPKMASQPPPPAAAAASGAPPPAQVVGNAFVHQYYNILHQSPELVYRFYQEASCLGRPAGTGADGMDTVTTMDAINDKIVSMGIDRAEIKAVDAQESLCGGVSVLVMGHLTGRNSVSRQFVQSFFLAPQEKGYFVLNDILRYVGEGGGDEGAEKQPAPEVAADAETTTSAPILANGTVGGDATTVPQDASPQPECQVAEPALNPKEEVLNGEVCNSLSDVEKPVAEETPVPDVINEVPNNVAVAPPISSPPVPLKEAPKKSYASIVKVMKEHRPLAPAVPSRPAPPITEKQASPAPTPVTEAPAFSPNPQSGGFQDPEVDAHAIYVRSLPLNATPQQLEEEFKRFGTIKHEGIQVRSNKIQGFCYGFVEFEDASAVQAAIEASPVTIGERQCFVEEKRTTGSRGGGSRGGRFPPGRGGNFRGEGIRGRGTYNGGRGYGRGEFSYRSDYGGRGGGRGGSLHGGDVGYQRVDYSGTSSGRGARAPSAAAAMAK

SEQ ID NO: 7045 - protein, 545 aa, Oryza sativa Indica Group
MDSARSWFQKFQPRDKSKSPAVAASHGKDPGKPPIDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAFIVKLYYSFQDEEYLYLIMEYLPGGDMMTLLMRKDTLTEDEARFYIAETVLAIESIHKHSYIHRYQISVPKFWDIKPDNLLLDRSGHLKLSDFGLCKPLDSSNFPNLNEPDYTSTKGTKPLPDSSSRLSSSAPKRTQQEQLSHWQKNRRMLAYSTVGTPDYIAPEVLLKKGYGMECDWLVSYLIVNWRSHLKFPEEAKLSPEAKDLISKLLCNVEQRLGTKGAHEIKAHPWFRGLPWERLYQMKAAFIPEVNSELDTQNFEKFEETGAQIQSSSKSGPWRKMLPSKDANFVGYTYKNFEIVNDDEVAGIAELKKKSSKSKRPTIKTLFGIEHYYYLLVPYTPCTVFHDMFNLLLSLKQRAWMKMSLFKEVS

SEQ ID NO: 7046 - protein, 331 aa, Prochlorococcus marinus str. MIT 9515
MTSFITAVDNEVPNFNLANSRLRLVSGTSNPKLAEEIASYLGIENVPLVSKRFADGELYVQIQQSIRGCDVFLIQPTCAPVNDSLMELMIMVDACKRASARQITAVIPYFGYARADRKTSGRESITAKLTANLLEKSGVDRVLAMDLHSAQIQGYFDIPCDHIYGSPVLIDYLETLNLEEVVVVSPDVGGVARARAFAKLMKDAPLAIIDKRRSAHNIAESLTVIGEVKGKTAILIDDMIDTGGTICSGANLLKKEGAKRIFACASHAVFSPPSYERLSAKDLFEQVIVTNSIPVLDNNNFQQLKVLSVANMLGEAIWRIHEESSVSSMFR

SEQ ID NO: 7047 - protein, 451 aa, Trifolium pratense
MASPPDTSKTIKLERYNSYIRKVNSTKLLNASSKLLFRATLLIALVLVFFFTFNYPPLSDTTSHHFHTHSHFLTSAFGGGGAWERQVRHSATPRRPNGFTVLVTGAAGFVGSHCSLALKKRGDGVIGLDNFNNYYDPSLKRARQDLLSQHQIFIVEGDLNDGPLLSKLFDVVPITHILHLAAQAGVRYAMQNPQSYIKSNIAGFVNLLEVSKTANPQPSIVWASSSSVYGLNTENPFSELDRTDQPASLYAATKKAGEEIAHTYNHIYGLSLTGLRFFTVYGPWGRPDMAYFFFTKDILHGKTIDVYQTQDGKEVARDFTYIDDIVKGCVGALDTAEKSTGSGGKKKGPAQLRIYNLGNTSPVPVGKLVTILENLLTTKAKKHVIKMPRNGDVPYTHANVTLAYRDFGYKPVTDLSTGLRKFVKWYVRYYGIQPRLKKENRIDNEQPDGSA

SEQ ID NO: 7048 - protein, 118 aa, Musa acuminata
IFQGLKMVSVERSFAEKHYADLSAKPFFAGLVEYIISGPVVAMVWAGKNVVVTGRKIIGATNPADSAPGTIRGDLAIEIGRNVIHGSDSIESASKEIALWFPEGVAEWQSNLHPWIYE

SEQ ID NO: 7049 - protein, 307 aa, Magnaporthe grisea 70-15
MSTTLGAFIAGGIAACGAVTATHPFETVKIRMQLQGELRDKGHQPHFYRGPFHGVSVIVRNEGLGGIYRGISCAYVYQILLNGCRLGFYEPMRQTLTGLFYNDKNQQNLGINIFCGASSGIIGAAAGSPFFLVKTRLQSYSPFLPVGTQHEYKNALDGMRQIYGAEGAKGMYRGVGAAMIRTGFGSSVQLPTYFFAKRRLVKHLGMEEGPALHLASSTVSGFVVCCVMHPPDTIMSRMYNQSGNLYSGVLDCFAKTVKTEGVFAIYKGFLPHLARILPHTILTLSLAEQTNKLMRRLEDHILPTEAL

SEQ ID NO: 7050 - protein, 196 aa, Zea mays
LQTVPLCQNLYRNSFTYHCLQEDKTLQFDDANQFLEQCEREKARVLVHCMSGKSRSAAFVIAFLMKSRGWRLAQSFQWVKERRPQVQLSDAAQQQLIEYEKKLFGSNDGSIAAQPFAPVDSLPSLGFGFPKPPGDIQAPTFNQQAPASIFERVTPNSFPSNFIFGAERTSDAKLPDSNNFGVVNSSTGSDSMMDSS

SEQ ID NO: 7051 - protein, 340 aa, Corynebacterium efficiens
MKLAVIGGDGIGPEVTDEALKVLRALRADIETTDLDLGARRYLRNGELLTDEDLALLREHDAILLGAIGAPGSVPPGVLERGLLLKLRFALDHHVNLRPSKLYEGVESPLKNPGEIDFVVVREGTEGAYTGNGGAIRVGTPHETANETSVNTRYGAERVIRYAFELAQSRRRHLTLVHKTNVLVHGGGLWQRTVDEVAREYPEVTVDYNHIDAATIYLVTDPSRFDVIVTDNLFGDILTDEAGAISGGIGLAASGNIDATGTNPSMFEPVHGSAPDIMGKGIADPTAAILSAAMMLRHLGDEANAVRIEEAVARDVAGRDPEAPISTTEVGDRIAAAVVA

SEQ ID NO: 7052 - protein, 116 aa, Nostoc sp. PCC 7120
MANWQCVKQCGACCNLDPAERPEIEDYLTPDELEIYFSMVGEGGWCVNFDHTTRECRIYSTRPRFCRVEPDIFQDMYGIESEELNDFAIECCRQQIEGVYGDRSLEMLRFDKAVGI

SEQ ID NO: 7053 - protein, 373 aa, Magnaporthe grisea 70-15
MDVDIPTVGTPTNGGASLLGSSTGGTTELQQILSTFKATRLFRRKDLRPDKPSPHVLSLDFNDPGDLCMTSESDETIQLYNVREGRHDKNLASKKYGVKLAKFTHSGTSIIYASTKQNDAIRYLETFDNSFIRYFEGHKDAVTNLEMHPGGDNFLSASRDNTVRLWDIRSKNAVGQLFLNTPYLLAWDPSGEVFAVGSPRSGSILLYDYKNYNKAPFATFDIVEACKEVDPSRLLQGWTKLEFSNDGKCILLGTDGTGHLLLDAFDGKLKANLRKPDSGTSRVAPGEGSGHGDVESSGDCCFTPDGRFVMGANRGQNVSVWDVNGAVGENKRMDPAFTLEDKREAAVLAFNPRFNFFATADRDLIFWMPDPYV

SEQ ID NO: 7054 - protein, 249 aa, Mycoplasma pulmonis UAB CTIP
MALVKTQQEIELIKKSCQILAEVKKVIYDLIRPGVSLKELDSIAFKEIVKRGAKPAFKGYMGFPATICASLNEELIHGIPNERVLKEDDLISIDIGVIYKGYYSDSAFSKSLSPENEENAFLINVAKVAFEKGIKAIKKGATIGDIGYAIGKYLDSQKVFTPREYSGHGIGSALHESPYVFNRAPRGSGMKIRNNMVICIEPMILQKSPQVYTKEDNWTVVAKSGLKSSHYEHTVLIQDWKAIVLTKEI

SEQ ID NO: 7055 - protein, 155 aa, Triticum aestivum
MSSSSAARALSPAPPAPTPPRRVRPARCAGFVGPAVESATPGARAATLASSRGGTDSSLAICRVLNGMWQTSGGWGRIDRADAVDAMLAYADAGLSTFDMADHYGPAEDLYGMFINKVRRERPPKMLEEVRGLTKWVPPLVKMTRSFVEENINRS

SEQ ID NO: 7056 - protein, 187 aa, Triticum aestivum
  misc_feature (156)..(156): Xaa can be any naturally occurring amino acid
MLRRNTRLRREYLYRKSLEGKERQHYEKKRRVREALEEGKPIPTELRNEELALRREIDLDDQDRAVPRSIIDDEYAGATLREPKILLTTSRNPSAPLTQFVKELKVVFPNSQRMNRGGQVISEIVESCRSHEITDLILVHEHRGQPDGWIGCHPTXGPLAYFGLLKGGNPACISNIGRARGTNCSKP

SEQ ID NO: 7057 - protein, 141 aa, Synechococcus sp. CC9605
MLSALTRLLRPLSRAAVALGLGLCLLLTACSGDAEARLSGDYVEDTVAVSRTLLTVIDLPQDDPTHAEAEADARALINDYMSRYRPQPRVNGLSSFTTMQTALNSLAGHYASYANRPLPEALHDRIAKELNKAEKSVVRGS

SEQ ID NO: 7058 - protein, 244 aa, Picea sitchensis
MAKEGGKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSAEIIGTFVLVYTVFSATDPKRNARDSHIPVLAPLPIGFAVFMVHLATIPITGTGINPARSFGAAIKALGSFRSNPHV

SEQ ID NO: 7059 - protein, 253 aa, Streptomyces exfoliatus
NDLSGKTVIITGGARGLGAEAARQAVAAGARVVLADVLDEEGAATARELGDAARYQHLDVTIEEDWQRVVAYAREEFGSVDGLVNNAGISTGMFLETESVERFRKVVEINLTGVFIGMKTVIPAMKDAGGGSIVNISSAAGLMGLALTSSYGASKWGVRGLSKLAAVELGTDRIRVNSVHPGMTYTPMTAETGIRQGEGNYPNTPMGRVGEPGEIAGAVVKLLSDTSSYVTGAELAVDGGWTTGPTVKYVMGQ

SEQ ID NO: 7060 - protein, 639 aa, Agrobacterium tumefaciens
MTGMPQTPLLDRVNFPSDLKEIDDRDLPELARELRDEMIDAVSRTGGHLGAGLGVVELTIAIHKVFNTPEDRLIFDVGHQCYPHKILTGRRERIRTLRQEGGLSGFTRRAESEYDDFGAGHSSTSISAGLGMAVAAGLDESDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDDKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILEIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPGTMYANAGLDRAGIVSTVFNALGQRQAGVGFAG

SEQ ID NO: 7061 - protein, 424 aa, Pseudomonas fluorescens Pf-5
MAFLALGINHKTASVDVRERVAFTPEQLVEALQQLCRLTDSREAAILSTCNRSELYIEQDHLSADVVLRWLAEYHHLSLDELRASAYVHEDDAAVRHMMRVASGLDSLVLGEPQILGQMKSAYAVAREAGTVGPLLGRLFQATFSAAKQVRTDTAIGENPVSVAFAAVSLAKQIFSDLQRSQALLIGAGETITLVARHLHDLGVKRIVVANRTLERASLLAEQFGAHAVLLSDIPQELVHSDIVISSTASQLPILGKGAVESALKLRKHKPIFMVDIAVPRDIEPEVGELDDVYLYTVDDLHEVVAENLKSRQGAAQAAEELVNIGAEDFMVRLRELAAVDVLKAYRQQSERLRDEELQKALRMLANGSGAEDVLAQLARGLTNKLLHAPSVQLKKLSAEGRLDALAMAQELFALGEGSSDKTP

SEQ ID NO: 7062 - protein, 721 aa, Nostoc sp. PCC 7120
MKRRTFVQRIGSILAVLGVAETEWLAMNNHYYQALAQPTPRKLALLIGINQYRKSSSLSGCLTDVELQKELLVHRFGFQATDILTLTEEQASREFIEAAFLDHLTKQAKPGDVVVFHFSGYGTQLPVESGTLQNALVTTDENQEAQDSQIANYLLEDTLLLLLRSLPTDHAIAVLDTSYTFTGINQPAGLKIRARPESPGTRLAAAEIDFRQQIKNQNPEFSPPVILSATSDPQQSAREILMSGFSAGLFTYALTRQLWESTPATTIRVSLSHAASSIHQLGSKQQPGLLTKKNQQGVATVENLLLDSRTGAEGAILAIEEDGKTAQVWLDGLPAQVLENYGTNSRFTLATGEELVLRSLMAGRSPSRTGLIAKAQFSKVTETIPLQVGQLIQENVRVLSRNINLILALDTKLERIERVDATSAFASVGHISTVVAGEQPADYLFGKLPQTPSRYGLFTLDGELIPNTDGGVGEAVKVAAQRLSSKLSTLLAAKLWRLTENQGSSRLPVKVNLEVVNSISSQAVMQRETTRTTTTDTPTKKSLPTPNSPLPTPIIPIGSRIQYRIQNLGDRPIYFMLLGLKNNRSAIAFYPWQSRQETNNPENQPQLQQVVIAPNETVTLPQTKATSGWVTSSPAYECEHQLIFGTAPFNSTLEILDNAKYSTADQQPIATLVNPLEVGQALLQDLHNGSAVKTETTTTATDYFVLDVNNWASLNFSFQVA

SEQ ID NO: 7063 - protein, 306 aa, Polaromonas sp. JS666
MNAPEKLPLFTLSAWSAQQLETIEQALSRWVACPTDAPAPAGLGDAMRYAVLDGGKRLRPLLVMAACEAVNGNAEAALRSACAVELIHAYSLVHDDMPCMDNDVLRRGKPTVHVKFGEAQALLAGDALQALAFEFLTPDDGSVDAATQARLCRMLAQAAGFQGMAGGQAIDLASVGLPLTSGQLHEMHRLKTGALLQASVMMGTACGAAPPAAQHALREYGAAVGLAFQVVDDILDVTADSATLGKTAGKDAAQDKPTFVSLMGLQASKDYAQQLLGKALASLDASGLGNTHALHALADMLVNRHH

SEQ ID NO: 7064 - protein, 129 aa, Photobacterium profundum
MLISKRIVMSITNEQILDAVADMSVMQVVELIEAMEEKFGVTAAAAVVAGGAAAEAAEEQTEFDVILTAVGAQKVQVIKAVRGATGLGLKEAKAVVDSAPASVKEGVDKAEAEALKAQLEEVGASVEIK

SEQ ID NO: 7065 - protein, 169 aa, Synechococcus sp. CC9605
MDLHQLPPSPSPGLVNLIVEIPAGSRNKYEYSAEAGVMVLDRVMHSSVRYPFDYGFIPNTLAEDGSPLDAMVIMAEPTFAGCLIKARPIGVLDLHDRDVYDGKILCVPDADPRQDEIRSIRQIAASQLEEVAEFFRTYRTLQGSVVSIDGWRDLDAVQPLLDSCINAAD

SEQ ID NO: 7066 - protein, 635 aa, Polaromonas sp. JS666
MYPLLETINSPADLRRLPRAQLKALADELRAFVLDSVSKTGGHLSSNLGTVELTVALHYVFNTPEDRLVWDVGHQTYPHKILTGRRDRMGSLRQFGGLSGFPRRDESPYDTFGTAHSSTSISAALGMALAAHQQGEDRHAVAIIGDGAMSAGMAFEALNNAGVHDDCKLLVVLNDNDMSISPPVGALNRYLAQLMSGRFYASAKNVGKQVLRVAPPLLELAKRLEAHAKGMVVPATLFENFGFNYIGPIDGHDLESLIPTLENIKHLKGPQFLHVVTKKGQGYKLAEADPVAYHGPGKFDPAMGLQKSSAPAKRTFTQVFGQWLCDMAEQDKRLVGITPAMREGSGMVEFHKRFPGRYHDVGIAEQHAVTFAAGMACEGLKPVVAIYSTFLQRGYDQLIHDVALQNLPVVFALDRAGLVGADGATHAGAYDIPFLRCIPNMSVACPADENECRKLLSSAFEQNHPVAVRYPRGAGAGVEPEPGLQPLPFGKGEIRREGSGVAILAFGTLLYPALQAAEKLGVTVVNMRWAKPLDTELLLKVAASHEALVTLEEGAIMGGAGSAVGEALQAAGLGKPLLQLGLKDEFIEHGDPAKLLALQGLDAAGIEAAVMARFGSVLQPEKSGKPAKPALKSVA

SEQ ID NO: 7067 - protein, 422 aa, Oryza sativa Indica Group
MPPGGEQLNVGDDETRHCRVVTLGVAPDPNPLVSVGYQGCCRPESAAACPQPRCSSRRWITWSKRVRVPRHRVHHTTPASSSDWLADVSVSTPIYSLFPRASRPATATSPASTSPADDDETSAMTTAQPLQHEHDPSPPEPDAAADADDEEESRVWSQIKAEARRDADGEPALASFVYATVLSHPTLAGSLAFHLANKLASSSTLLSSTLLYDLFAAAHAARPDLRAAAAADLLAAGARDPACAGRLSHCLLDYKGFLAVQAHRVAHALWAQGRRALALALQSRVAEVFAVDIHPAAAVGSGVLLDHATGVVIGETAVVGDGVSILHHVTLGGTGEAVGDRHPKVGDGVLIGAGATILGNVRIGAGAKIGAGSLVLADVPPGATAVGNPARLLLGGDQRGGAPAGESMDHASFMLEWSDYTI

SEQ ID NO: 7068 - protein, 352 aa, Triticum aestivum
MADEEGCMHAVQLALSSVLPMTLKAAIELGLLEILVGAGGEALSPEEVAAKLPAEANPDAASMVDRMLRVLASHDIVSCMVEEGKDGNLSRRYSPAPVCKWLTPNEDGVSMAPYVVVAQDKVFMEPWCYMKKAVLEGGSPFNMAYGMSWYDYAGTDPRFNRLFNEAMRHHSVIITKKLLELYTGFEGVGTLVDVGGGIGTTIHAITSKYPRIKGINFDLPHVISEAPPYPGLQVEHVGGDMFDKVPSGDAILMKWILLHFRDETCVALLKNCYHALPVNGKVINMECILPAELDATHRVQGCVSADMSMLAYSPDGKERYLTDFERLAKEAGFASVKATYIYTNFWAIEYIK

SEQ ID NO: 7069 - protein, 337 aa, Bradyrhizobium japonicum USDA 110
MLEKFARYPLTFGPTPIEKLERLSKHLGGNVEIYAKREDCNSGLAYGGNKLRKLEYIIPDAIASNADTLVSIGGVQSNHTRMIAAVAAKIGMKCRLVQEAWVPHEDAVYDRVGNIMLSRIMGADVRLVDDGFDIGIRKSWEQAIEEVKAAGGKPYAIPAGASVHKYGGLGYVGFAEEVRKQEAELGFKFDYIVVCTVTGSTHAGMLVGFAADGRARKVIGIDGSFTPAQTKAQVLSIAQNTAKLVELGKDIVADDVVLIEDYAYPAYGVPSEETKEAIRLTARLEAMITDPVYEGKSMQGLIDLTQKGYFEKGAKVLYAHLGGAPALNGYGYAFRNG

SEQ ID NO: 7070 - protein, 415 aa, Nitrosomonas europaea ATCC 19718
MYQHIKVPTTGSKIRVKDDSSLVVPDNPIIPFIEGDGIGVDITPVMISVVDGAVKKAYGDSRKISWMEIYAGEKSTRVYGQDIWLPDETLQAAKEFVVSIKGPLTTPVSGGIRSINVALRQLLDLYVCLRPVRYFQGVPSPVKQPEKVDMVIFRENSEDIYAGIEWEAGTEAVEKVINFLTAEMGITKIRFPRSSAIGIKPVSKEGSERLIRKAIQYAIDHKRRSVTLVHKGNIMKFTEGAFKKWGYELAAKEFGAELLDGGPWMILRHNGNEIIIKDVIADAFLQQILLRPDEYDVIATLNLNGDYISDALAAQVGGIGIAPGANMSDSIAIFEATHGTAPKYAGKDQVNPGSIILSAEMMLRHIGWHEAANIVISSMEKTIQDRIMTYDLARLTPNAKQATSSEFGNAMVARM

SEQ ID NO: 7071 - protein, 332 aa, Vibrio fischeri ES114
THAPGRHGGRGNSIGFGRIGRSVLRALYESDKRDKIEVVAVNELSQPEAMAHLFQYDSTHGRFQHKVTHDQEYLYIDLPDSSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKMLVWYDNEFG

SEQ ID NO: 7072 - protein, 221 aa, Anabaena variabilis ATCC 29413
MAEIKIYSAVVCPYAHRSRLVLQEKGIDFDLIEINLQNKPEGFTDISPYGKVPALAHGNHRVWESAVINEYLNEVFPQPPLLPSSPIAKAQARIWIDFANTRFVPAFSALLRSPDIQQQEAAKQELYKHLEFIENEGLGKLSGDGPYWFGESISLVDFTFYPWFERWPALKHYRGLALPEEFTRLRRWKKAVKQRDSVVAIANSKEFYIERYARFATPVAA

SEQ ID NO: 7073 - protein, 506 aa, Oceanobacillus iheyensis HTE831
MRYANPNKQDAIVNFEKRYDNFIGGKYQPPINGNYFENVSPVTGEVFCEIARSTKEDVDAAIDAAHAAKDAWGKTSVAERAVILNKIADRIEENLEKLAVAETWDNGKAVRETLAADIPLAVDHFRYFAGVIRAQEGTLSQIDEDTVAYHFHEPLGVVGQIIPWNFPILMATWKLAPALAAGNCVVLKPAEQTPASIHVLLDLIKDLLPDGVLNVVNGFGVEAGKPLASNSRIAKIAFTGETTTGRLIMQYASENIIPVTLELGGKSPNIFFEDVMDKDDAFVDKAIEGMVMFALNQGEVCTCPSRALVHESIYDRFMEKVIQRVNQIKIGHPLDTDTMMGAQASQEQMEKIKSYLDIGKQEGAEVLTGGNVNALEGELAAGYYVEPTIFKGNNKMRIFQEEIFGPVLSVTTFKDKDEAMEVANDTLYGLGAGIWTRDINTAYRFGRGIEAGRVWTNCYHQYPAHAAFGGYKKSGIGRENHLMMLGHYQQTKNLLISYGEGTAGLF

SEQ ID NO: 7074 - protein, 196 aa, Mycobacterium sp. MCS
MRDDMVVAEISCGRAAVILDGERGALLFFAAEAASAQLLNFAIRYSSGLIHAAMRSDRLDRLRIHDQPVLPSEDRALGFTVSVDAVGTGTGISGQARAQTLRALGSAQTTPEDLVRPGHVLPVRCPHVPRNAQDLVWDRMVRIVERAGCTPVAAACRLVHDSGDVLDDAAAEDFAATFGLALVSAPQRVRVLAAGA

SEQ ID NO: 7075 - protein, 510 aa, Trifolium pratense
MSLWIIVFVTIVAAILINRLLNLIKKPTLPLPPGPSPWPIVGNLPHMGPVPHHALAALALKHGPLMHLQLGFVDVIVAASASVAEQFLKVHDANFSSRPPNSGAKYIAYNYQDLVFAPYGPRWRLLRKISYVHMFSSKALDDFRHIRQDEVARLIRNLSNSGSKAANLGQMLNVCTTNALARVMIGRRVFNEGNGGCECDPRADEFKSMVVELMVLAGVFNIGDFVPSLEWLDIQGVQSKMKKLHKRFDSFLTSIIEDHMVSKSEKHNDLLSTLLSLKEKVDEDGDKLNDTEIKALLLNMFTAGTDTSSSTTEWAIAELIKNPKLMIRIQNELDTVVGRDRLVTEQDLTHLPYLEAVIKETFRLHPSTPLSLPRVATNSCEIFNYHIPKGATLLVNVWAISRDPKEWTNPLEFKPERFLPGGEKFDVDIRGNDFEVIPFGAGRRICAGMSLGLRMVQLLTATLAHAYDWELENGLSPEKLNMDEAYGLTLQRAVPILAHPRPRLSPHLYL

SEQ ID NO: 7076 - protein, 447 aa, Trifolium pratense
MAVSDGVQTPTPQVVGNAFVEQYYSILHQDPDQVHKFYHESSVLSRPEEDGTMTTVTTTAEIDKKIQSFDYTSYRVEVLSADAQPSYNSGVVVVVTGCLTGTDNVKRKFAQSFFLAPQDKGFYVLNDVFRYVDAYKSVDIETVPANDADESAPSEAFTPDPEPIHVAEDIPTIQPVIADTDTNISKEVSLPLENGKLSVTENVIPVNHVKESSHQEQMASIEKVPSNTQEDTPKKSFASIVSAYKDNSAPFLSRTSPAKPAVQPPRVHSVPAPEAPAPNMDIPSEKNNENGGRAHAIFVANLPMTATVEQLDRVFKKFGTIKRDGIQVRSNKGSCFGFVEFESAASLQSALEASPPVMLDNRRLSIEERRGRGGYRNDRNDNFRGRGNFGGGRGGGFNGRNDFDRRGEFSGRPRGGNNTGRSNGDAAPRSYQNGGGKVARQPPVKAQ

SEQ ID NO: 7077 - protein, 443 aa, Shewanella sp. MR-4
MSQQNPGLKQSLSLWQVVVMGLAYLTPMAVFDTFGIVSEITSGHVATSYLLALAGILFTAFSYGHLVRKYPYAGSAYTYAQKTFSPNVGFMVGWSSLLDYMFMPMINMLLAKIYLTAMFPNVEPWIFIFGLVAVMTVLNLRGIDLVANFNGVIVFAQIAIILVFIGLMAHSLSLGEGEGVIASVRPFYSEEISLAPLFTGATILCFSFLGFDGLSSLSEETKDAKRVIPRAIVLTALIGGVIFVSVSYFLQLFFPDISRFQQLDAVLPEIALYVGGNLFQSVVLVATTIAVLASGMAAHAGVARILYVMGRDNMLPNKGFGYIHPKWRTPAFNVILVGLLALSAVSFDLEMALALVNFGALVAFTFVNLSVIVQFYIKEKRNQSLKDHFQYFVLPLCGAATIGVLWLNLEPQSLELGLIWAAVGVLYLALRSLRLRKTVELQN

SEQ ID NO: 7078 - protein, 330 aa, Methanococcus maripaludis S2
MHKICVIEGDGIGKEVVPAAVEVLKATGVEFEFNHALAGDEVFEKTGVALPEETIAAAKAADAILFGAAGETAADVIVKLRKILDTYANIRPVKSYNGINCLKTGIDYIIVRENTEGLYKGIEAEIADGVTVATRVITKDASERIFKHAFEMAKDRKKQGTAGKVTCAHKANVLKITDGLFKKTFYEVSNDYKDIQTEDFYVDAMNMFIISRPETFDIVVTSNLFGDILSDGAVGMVGGLGMAPSGNVGDKYGLFEPIHGSAPDIAGKGLANPTATILTAVMMLRYLKENEAAEKVEKALEEVLSLGLTTPDLGGTLSTSEMGQEVAKRV

SEQ ID NO: 7079 - protein, 462 aa, Oryza sativa Japonica Group
MAAPPATASAPSLRPSAASPRAAAARSVAVPSGPRTVGPRRDGGRFLGVRAAKAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLKPDGVFFSNGPGDPAAVPYAVKTVQEIIGKVPVFGICMGHQLIGQALGGKTFKMKFGHHGGNHPVCDLRSGRVDISAQAVRYIQFNQLLPPFHNNHNYAVDPESLPEGVKVTHINLNDNSCAGLQYPKMKLLSLQYHPESSPGPHDSDLAFGEFIEMMKNNRL

SEQ ID NO: 7080 - protein, 522 aa, Xylella fastidiosa Temecula1
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASVQVIYPDTLFSGLSDHPSEFRLDVWMSHGDHVSRVPPCFTITAATDRIPIAAMSREDKRWYGVQFHPEVTHTLQGQALLRRFVVDICGCQTLWTSANIIEDQIARVRERVGCDEVILGLSGGVDSSVVAALLHKAIGSQLTCVFVDTGMLRWGEGDQVMAMFAEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 7081 - protein, 399 aa, Zea mays
MATTNAGNDHCWPEPIVPVQTLSNSGVSTVPQRYIKPPSERPNGTGSMNCCDDDDVVASIPIVDLARGFSSSAGGGIPDDDEHRDRRAAAALEAVGDACKNWGFFQVVNHGVGVDSVERMRGAWREFFDLPMEEKKPYANSPATYEGYGSRLGVEKGAALDWGDYYYLNLLPDDTKNLDKWPEMPRQLREVTEKYACDLMELSQVLLKAMSSTLGLDEDYLHMALGGTTKKGISASMRVNYYPKCPEPELTLGLSSHSDPGGITLLLLDEDVKGTQVRRGDDTWVTVHPIPGAFLVNVGDQIQILSNGAYKSVEHRALASSGHDRLTIAFFCNPCGDLPIVPAPQLVGPESPAVYGQPPITFNEYRKYVRTKGARGRAQVESLSISTTSTSTTNNNNTS

SEQ ID NO: 7082 - protein, 366 aa, Pseudomonas fluorescens Pf-5
MGFNCGIVGLPNVGKSTLFNALTKSGIAAENFPFCTIEPNSGIVPMPDPRLDALAAIVVPERVLPTTMEFVDIAGLVAGASKGEGLGNKFLANIRETDAIAHVVRCFEDDNVIHVSNSVDPKRDIEIIDLELIFADLDSCEKQLQKVARNAKGGDKDAVAQKALLEQLIAHFTEGKPARSLMKDMSADEKLIIRGFHLLTTKPVMYIANVAEDGFEDNPLLDVVKAIAEEEGAMVVPVCNKIEAEIAELEDGEEKDMFLEALGLEEPGLNRVIRAGYEMLNLQTYFTAGVKEVRAWTVRVGATAPQAAAVIHTDFEKGFIRAEVIAYNDFIQFKGEAGAKEAGKWRLEGKEYIVKDGDVMHFRFNV

SEQ ID NO: 7083 - protein, 240 aa, Arabidopsis thaliana
MICTESNHQRFSFAGDLGQSDKGTPMEQQPSGPVRRDTTLLDSSNSDFEFHISSNFDPGDSSPADEIFADGMILPVLPFQVTATSTMPKRLYKYELPPIVSAPTLSSYLPPLPLPLPEHSRKYSVKETRGSLNGRGSGRANSRPLNSIRPIVSRITIHWPSFYNVVTGKTLALPNLIALQHIPLSPAGVIAKRPAPIALPNSCAAYTYGSLRFTPIKERAVIVCLWMYRVILLTRRGDGW

SEQ ID NO: 7084 - protein, 442 aa, Synechococcus sp. CC9605
MPLRLLLVRHGLSSFNKERRIQGRDDLSNLSEEGHEQARALGRSLEDVSLQAIYSSPLQRAAATTASLLETKGGQSPAPVFDDRLLEVDLEPWSGQTIDELMQGSTEAYKIWKQRPMELELQRRDGSSYKPLPELMEQAQDFISKLLERHPANGNDTLLVVAHNAILRCLMLVLLGEPDHGFRRLRVDNTSLSVFNIRPGENGPQVQIECLNSITHLQPLPEKGKNARLILVRHGETDWNKAGRFQGQIDIPLNENGRRQAAAARDFLKDIPIDRAWSSTLSRPTETAQIILEAHPDVPLTQIDGLVEIGHGVWEGKLESEIREDWSELLDTWKRAPETVQMPEGETIQDVWGRSVRSWGEIAGELKPEETVLVVAHDAVNKTILCDLLGLTPADIWAVKQGNGGVTVVDIAADPGQPAVVTCLNLTSHFGSVIDRTAAGAL

SEQ ID NO: 7085 - protein, 220 aa, Rickettsiella grylli
MRRFIISASVLSADMGCLARESSAVLQAGADQLHIDVMDNHFVPNLTFGPLICRALRKHLPNVFLDVHLMVNPVDALISAFAAAGANQMTFHPEASNDIVKNLNQIRRLGCKAGLAINPQTELTLLNNYWDHLDFVLMMSVHPGFAEQPFIPEVLNKISTAKQLLSLHKPSARLGVDGGVKKNNIAEIAKAGADTFILGSGIFNTANYSNTLNELRSQLR

SEQ ID NO: 7086 - protein, 333 aa, Borrelia garinii PBi
MNRKISIAPMVNITDEHFRYLIRLLSKKVTLYTPMISAKSIIMGDVKKVVKQTPLESPIAIQIATNCKFDALKAIQILEKHFNFDEYNLNVGCPSLKIQNANCGACLMSNANQVGEILKTMKENTNKPISIKHRLGIRLLNSDYKNESYSEVKNFIKIISDFGIKNFIVHARVAILKGFSPKNNRNIPKLRHEFVYNLKKENKNLFIETNGGINNSEQIKKHLSFVDSVMIGRSAFENPYFIANASREFLGETDKIPTRKDILMKMVEYIKEYENYLSINILCKHLMGITFSKEGARKFRQNLTAPFPKNLKKHEILLKAMETLPEKILNSNS

SEQ ID NO: 7087 - protein, 350 aa, Mesorhizobium sp. ICMP 15054
DPKGKLQHVTMDVIEVEEDMFADGVMFDGSSIAGWKAINESDMVLMPDADTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKSKRVEVRFPDPGANPYLAFAA

SEQ ID NO: 7088 - protein, 305 aa, Yarrowia lipolytica CLIB122
MSSIGWNTIESDCGVFTTLVEELGVSGIEFFDVLSIDPDSLAQFNPLYGIIFLYKYRKSEYAVSREYSETEKNASGQFFFAHQKIQNACATQAILSVLCNLPEDIEIGPILSNFKEFSRDIDPETRGEILGMSDEIRQAHNSFSRPNPFESGDDDRETPDEENDGLYHFVAYVPINGQLWELDGLKQYPVNYGGCTNEEFPEKVSSVLMERVQKAPGGDLRFSVLAVSRDRREVLKENGGSTTELVVEDLKRKEWTRDNALRRETFVGLINELVKGVVGGMGDEQYKKALEQGREKTKEMYAKRA

SEQ ID NO: 7089 - protein, 248 aa, Picea sitchensis
MDGDSPQRGSRRIRSGVVSDRSYYRDAPYRRDFRRSRSDDACKNCKRPGHFARDCPNVSVCNNCGLPGHIAVECTTKSLCWNCREPGHVASQCSNDPICHTCGKSGHLSRDCTAPELPPGDIRLCNNCYKQGHIAAECTNEKACNNCRKTGHLARDCTNSPVCNLCNISGHVARECPKGRILDDNRGGRFMDERRGRFNDIICRTCNEPGHTSRECTPILICHNCGGRGHVAYECPSGRVMLRDMRRR

SEQ ID NO: 7090 - protein, 362 aa, Pseudomonas putida
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPPEAGALIEPLAVGMHAVKKAGSLLGQTVVVVGAGTIGLCTIMCAKAAGAAQVIALEMSSARKAKAKEVGATVVLDPSQCDALAQIRALTFGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 7091 - protein, 325 aa, Vibrio fischeri
CRIGRSVLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKMLVWYDNEFGITSEFAAAC

SEQ ID NO: 7092 - protein, 130 aa, Eremothecium ashbyi
AIVFGETIRSRSLFRQRKGESQQDRMIRGAYVGRLYPGRTVADYDERLGIRLKFEDDGELIAEAGTTWDEDGDTGTLVRLHSECYTGETAWSARCDCGEQFDRAGRMIGESGSGVIVYLRQEGRGFPLSV

SEQ ID NO: 7093 - protein, 510 aa, Oryza sativa Indica Group
MAATPPSSRDPSPQHRRPLSSSASLAGKPRGGGLLLGRYELGRLLGHGTFAKVYQARSADSGEPVAIKVLDKEKAMRHGLVPHIKREIAILRRVRHPNIVRLFEVMATKSKIYFVMELVRGGELFGRVAKGRLKEDTARRYFQQLVSAVGFCHARGVFHRDLKPENLLVDEHGDLKVSDFGLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTISAEIFELTPSLVVVEVKKKAGDKEEYDDFCNRELKPGMQHLVHHMGSVPNIPSDTE

SEQ ID NO: 7094 - protein, 239 aa, Anabaena variabilis ATCC 29413
MLLTDLRTIYERDPAARNWLEILFCYPGLQALMFHRLTHWLYKIGIPLFPRLISSISRFLTGIEIHPGAKIGKGVFIDHGMGVVIGETAIVGDYALIYQGVTLGGTGKESGKRHPTLGENVVVGAGAKVLGNIHIGNNVRIGAGSVVLRDVPSNTTVVGVPGRLIRVDQAHVLAHGKVRDMEAEAIRALFERVKDLEQQVEQLGGNFHVSINQVDNQHLQETKAESNLVIEEFLDGAGI

SEQ ID NO: 7095 - protein, 118 aa, Panax ginseng
LCAGGELFDRIIEKGHYSEHAAAVLCRQMVTVVHNCHSMGVMHRDLKPENFLLLSTAEDSPLKATDFGLSVFFKPGDVFKDLVGSAYYVAPEVLRRSYGAEADIWSAGVILYVLLSGV

SEQ ID NO: 7096 - protein, 320 aa, Anabaena variabilis ATCC 29413
MKIARNITELVGRTPLVRLNNIPQAEGSVADIVVKLESMNPSASVKDRIGVSMVESAEEAGLIHPGKTILVEPTSGNTGIALAMVAAAKGYHLILTMPETMSTERRSMLRAYGAQLELTPGLEGMRGAIARAEQIVTELPNAYMLQQFRNPANPKVHRQTTAEEIWSDTDGQVDIVVGGVGTGGTLTGVAQVLKERKPSFQAIAVEPSNSQVLSGGKSGAHKIQGIGAGFIPAICRLELIDQIIAVSDEDAIAYSRRLAREEGLLSGISTGAALYAAIQVAKRPENSGKLIVMVQPSFGERYLSTTLFKDLSELEISALN

SEQ ID NO: 7097 - protein, 552 aa, Oceanobacillus iheyensis HTE831
MLHATWYWMWEKHDQVKDLFRLFVNPNEIIEKNKKDSTPSSTTSNSNNGDDGGNNRQYNKAQLIGLFLGPISFILTLLFFSPEGLSSEGQAVLASTIWIAIWWMTEAIPIPATALLPIILFPLTNGLDIGATTSAYGSDTIFLFMGGFVIALAMERWNLHRRIAISIISVIGTNTDRIILGFMVATGFLSMFISNTATAMMMVPIGLAIIYQVSDTLKEQGGFDTSPENFSFGKSLMLGIAYSASIGGMATLIGTPPNVIFAGTINTMYGIEVSFASWMMFGVPFAWIFIFLTWFYLSKIAFKLEVSHIPGGAKIIKEEKKKLGNASYEEKAVFVVFILAAIAWISREFLLGPYVSENINDAIIAITAALVLFLIPAKNKKGDFLMNWESAIKLPWGILLLFGGGLAIAAGFTDSGLSDWIGEQLTGLENVAPIIIILSIAALVIFLTEITSNTATATMMFPIMAALAVAVGVHPFILMIAAALAASCAFMLPVATPPNAVVFGSGYLRIPDMAKAGFFLNIVGIILVTLTVYFLVPMALGIDINEIPAYVE

SEQ ID NO: 7098 - protein, 458 aa, Wigglesworthia glossinidia endosymbiont of Glossina brevipalpis
MTLQLKRWIDKINHKESLIYDIPDYFQYGKLVRATGMVMEAIGLQLPIGSTCFIEKKEENSITNIECEVVGFNGQNLFLMPLEGVDGICPGARVHSQDLYNSKISTRLLPIGYSLLGRVLNSSGKFLDKLPVPKTYKKKSLYTKPINPLLRDPIKKVLDVGVRAINGLLTVGIGQRMGIFSGSGVGKSILLGMMAKYTKADIIVVGLIGERGREVKDFIENILGEKGISRSVVIAAPADVSPMLRIQGAIYATRIAEYFRDKGKHVLLIMDSLTRYAMAQREISLAIGEPPATKGYPPSVFAKLSELVERTGNGTDNKGSITAFYTVLTEGDDQQDPIADSSRSILDGHIVLSRFLSESGHYPSIDIESSISRTMSNIVTESHFKCVQKVKQLISSYQKNRDLLSVGAYSSGSDPILDIAIKNYPKIEKYLKQDLNQSCSYEESCLQLNNLCSNNFNI

SEQ ID NO: 7099 - protein, 636 aa, Neisseria meningitidis Z2491
MNILSVENASFAVGHVALLDKTSFQLDSGEKIGLIGRNGAGKSSFLKILAGVQKLDDGQIIVQNNLKIVYVPQESFFDKEATVFDTVAEGLGEIRDLLRRYHHVSHELENGSSEALLKELNELQLEIEAKDGWKLDAAVKQTLGELGLPENEKIGNLSGGQKKRVALAQAWVQKPDVLLLDEPTNHLDIDAIIWLENLLKAFEGSLVVITHDRRFLDNIATRIVELDRGILRSYPGSFSKYSEKKAQELAVEAEHNRLFDKFHAQEEAWIRKGIEARRTRNEGRVRRLEELRRQRAERRNVQGQVNFKLDSGEKSGKIIAELEHASFTYGDKVIMDKFSAILQRGDKIGLIGPNGIGKTTFLKLILGELQPTYGRIRIGSKQEVAYFDQFRSTLNENDTVFYTLGQGNDYVEVGGKKKHVMSYLEDFLFHPARAQSPVSSLSGGERNRLLLAKLFTRPANILILDEPTNDLDIDTQELLEDLLRDYQGTVFLVSHDRMFLDNVITQSIIFEGNGRLKEYIGGYQDYIDAKSREAKIQTESAPKTADAEPVKEKPKANRTVKLSYKEQRELDALPDEIAALEAEQAEINAQLSDPEIFKDYEKAGALQSRAEEIEMLLLEKLERWELLETKQNGNAV

SEQ ID NO: 7100 - protein, 266 aa, Anabaena variabilis ATCC 29413
MQKLLFHGKDSFKAQALFLGKKINLQRLENYDCLATMPLIVTVGEQGCAVLLSYGAVVLFNLEPMEKVAFLSKLSSLVSDSFTEPETEEVDVRRNIAESERVKEGKIFLHEFSVERLQIVADILAKSVVLSHYETSLATVFDQIEPFAASLQGDNRSQRKSRELLRQLGATLLVQHKIVGRVEIIDKPELLWESPQLENLYLRLEDEYEIRERHNALERKLELISQTAQTVLEFMQHSSSQRVEWYVVILIVVEILLSLYDIIFKR

SEQ ID NO: 7101 - protein, 205 aa, Streptococcus suis 89/1591
MGWWKDTIEIVKEKDPAARTTLEVLLTYPGVKALAAHRLSHWMWKKGFKLLARMHSQFWRFWTNIEIHPGADIASGVFIDHGAGLVIGETAIIESGVMLYHGVTLGGTGKDTGKRHPTVRKGALVSAHAQVIGPIEIGENAKVGAAAVVLADVPADVTVVGMPAKIVRVHGQKDEKVIHDMEDGREHYTTKLAELREASHRSSHL

SEQ ID NO: 7102 - protein, 356 aa, Gibberella zeae PH-1
MVNTTDNLNRLLGLLTQLQASKVTDWVKPGDTSGEFKRQVSSFRDWISRDANAKYPAEKGRYHLYVSYACPWACRTLIARKLKGLEDFISYSVVHWHLGEGGWRFVSKDESVPGENVVPDPIKGHESFTHLKDVYFESEKNYDGRYTVPVLYDMKTNRIVSNESSEILRMLGTEFDDLLDEEHKAIQLYPENLQKQIEEAHEWQYGGINNGVYKSGFATTSEAYERNVVALFESLDRAEKHLSEQKEGPYWFGNQLTEVDIRLFVTIIRFDPVYVQHFKCNIRDIRSGYPALNRWMRNLYWNHPAFKDTTQFEHIKWHYTRSHTQINPHSITPVGPLPHILPLEEEVAAVAAAQKN

SEQ ID NO: 7103 - protein, 591 aa, Neisseria meningitidis Z2491
MAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 7104 - protein, 296 aa, Xylella fastidiosa Temecula1
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGCKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKR

SEQ ID NO: 7105 - protein, 285 aa, Arabidopsis thaliana
MFGAQSSDSLPEISRPTATECQEVKSDEALTEPNPDWALVLVKDPSPPLIIEVEDETLPSIDSVQNPKPKDPEATPSQPSVASRLRKRKSSAADPRIKRMKQGKGVTGSSSFDGIRFVSTEAEKRYAQFSQRNFIEEVELSRKTNEAAREFIKQAGLIRTVTKFNPFTQNLVFEFWANLPTMKVDTYMVKVLVRNREYELSPGKINEMYGLPSVDARQQRMDIAGLVDEQVAEFLTGGKVSVLSKLQVSAFTPTSLELFKLCCSNSSPTSNAGYAQPDRLYITFL

SEQ ID NO: 7106 - protein, 469 aa, Vibrio sp. Ex25
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEEAAEIPTVAYSLKDALAELDADREFLTAGGVFSDDFIDSYIELKSQDVERVNMTTHPVEFELYYSV

SEQ ID NO: 7107 - protein, 304 aa, Methanococcus maripaludis S2
MDLLTLWNLEREEVLKIIEDAEYFKKNRYGHEILKNKSIALIFESPSTRTRMSFDLAVNELGGHSLMMNEGEIHLGKKESIADTARVMSRFVDAIVARVKNHKTLEDLAEYGSVPVINALCDLAHPCQILADLLTMKENGKNFKGLKLAYFGDGNNVSNSLMIAGAILGMDVVIATPRSYEPNGLFVKKALEIIAKYGEGSLTLTDDPEIAAKDADVLYTDVWISMSDKNKQMDEILKIFPKFQINDEILSKAKKDAIVLHCLPANRGLEITDEVIDGKQSKVFDQAENRLHAQKAVLKYIFEH

SEQ ID NO: 7108 - protein, 179 aa, Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 7109 - protein, 675 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVPGDVVLDLSNMNNQTIKLGSGLLQDNDAISAMRAGKLSYSKPNKYWLESSHKRYIPRPDDHVLGIVVDSRADNFWVDIKGPQLALLPVLAFEGGTRRNIPKFEACRHSALSPGCQDKHRNESGAVLYRGLLNSPTRPVIEALGKKLSFEIAVGLNGRVWVNATAPRIVIIVANAIMNSESLSGTQQRIMVEKLLAIISD

SEQ ID NO: 7110 - protein, 350 aa, Neorickettsia sennetsu str. Miyayama
MGLKCGIVGLPNVGKSTLFNAMTQTQAAEAANYPFCTIEPNIAKVPEYDERLVQIAKISSAQKIIFSQLEIVDIAGLVKGANKGEGLGNKFLSHIREVDLIIHVLRCFPDNNIRHVHGKVDPVYDAEIIKTELLLADIQSLENRLKKSKASSQIIEQALEILNKKNPLPYDLMDQAFKELHLLSAKPVLYVCNVPQEDIVSGNNFSKQAEKFAQDSMSEAVKVSAAIEAEISLLESAEDRKLFLNELGLEESQLNKVIRASSRLLNLIVFFTSGEKEARAWPIKRGSTAPQAAGTIHTDFEKKFIKAETISFTDYITFGGEQKCKALGKIRSEGREYVVQDGDIILFKHG

SEQ ID NO: 7111 - protein, 154 aa, Triticum aestivum
  misc_feature (93)..(93): Xaa can be any naturally occurring amino acid
  misc_feature (126)..(126): Xaa can be any naturally occurring amino acid
VSDKIKLIDNLLGKVDSLIICGGMAFTFKKTLENVNIGDSLFDKAGSETVGALVEKAKKNKVKIVLPVDYITADKFAKDAKTATATDEEGIPXGWMGLDCGKKSIELYKAAIGEASTILWNGPPGXVFEFDAFANGTKETPICSGRPAQQRKCD

SEQ ID NO: 7112 - protein, 181 aa, Fagus sylvatica
KKIGNAFDNRIDAKRTLREIKLLRHMEHENVIVLKDIIRPPQKENFNDVYIVYELMDTDLHQIIRSTQPLTDDHCRYFLYQLLRGLKYVHSANVLHRDLKPSNLLLNSNCDLKIGDFGLARTTSETDFMTEYVVTRWYRAPELLLNCSEYTAAIDIWSVGCILGEIMTRQPLFPGKDHVHQ

SEQ ID NO: 7113 - protein, 368 aa, Borrelia garinii PBi
MKLNAGIVGLPNVGKSTLFSSLTSSKVEIANYPFCTIEPNLGIVEIPDERLLKISGCIVPQKIIPAVMEFVDIAGLVKGASTGEGLGNKFLANIREVSLIVHVVRCFEEKEVIHINDDINPEKDITTINVELCLSDLETIQKSLQKQEKNVKSTDKKISESSKAIVSMLKRLEDHLSNMNPAIEFKFDDFEYSFIRSLNLLTFKKVLYVCNVDENSLSGNKYTDIVKNIALKEGSDFLILCAKIEAELAEIKDISYKNEMLESFGINDSGLSNLIKKAYYTLGLRTYFTAGLQEVRAWTFKQGMKAPKAAGIIHSDFERGFIKAEVYSCEDLFKFQSVQKLKEKGLIRIEGKEYLVRDGDVIFFKFNV

SEQ ID NO: 7114 - protein, 444 aa, Caulobacter crescentus CB15
MRSLIAAVERIDPLTIYGRVAAVNGLLIEVRGGLTRLAVGARVEIERFGQKPLPAEVVGFRETRALLMPFGPVEGVGPGAEIRIVPEGAVVRPTKAWLGRIINAFGEPIDGLGPLPQGEVPYPLKTAPPPAHARGRVGERLDLGVRSMNVFTTTCRGQRLGIFAGSGVGKSVLLSMLAKEATCDAVVVGLIGERGREVREFVEETLGEEGLRRAVVVVATSDEPALTRRQAAYMTLAISEFMRDQDQEVLCLMDSVTRFAMAQREIGLAAGEPPTTKGYTPTVFTELPKLLERAGPGPIRPDGTTAAPITALFTVLVDGDDHNEPIADATRGILDGHIVMERAIAERGRFPAINVLKSISRTMPGCQHPHERDIVKGARQVMSAYSNMEELIRIGAYRAGADPVVDRAIRLNPAIEAFLSQDKEEATSLDDSFGMLGQILQSEY

SEQ ID NO: 7115 - protein, 611 aa, Pseudomonas fluorescens Pf-5
MFSNFPPRHRQLLGLSLLAAALSLGACHNPPSSNALPAAPEIASGYRTDMQTRHAGKHMAAAANPLAAEAGREMLRKGGSAIDAAIAMQAVLTLVEPQSSGIGGGAMIVLWDGKAVRTYDGRETAPAGATEKLFLQADGKPMAFPQAQIGGRSVGTPGVLRALEMAHQKHGRLPWAQLFEPAIRLAEQGFAISPRLHTMISADPFLARSPDMAAYFLNADGTPKAVGALLKNPPLAAVLKRIAEEGPDALYKGPVAAEIVAKVQGHANPGSLSLNDLQGYRAKERAPLCSDYKRWQVCGMPPPSSGGVAVAQILGTLQALEQRDPRYTLANLKPQKTSLPAGLEPAPQAVHLIAEAERLAYADRGLYVADSDFVPVPVAGLIAPDYLAKRAALIGERSMGKAEPGKPQGIQVAYAPDRSPMRISTSQVVAVDDLGGAVSMTTTVEAAFGSHLMVQGFMLNNQMTDFSFIPEENGQPVANRVQPGKRPRSSMAPTLVFDRASGELLASVGSPGGSQIIEYVAKSVVGMLDWNLDPQAAVGLPNFGSRNGPTELEKGQFSPALKQALQAQGHEVNEIDMTSGTQAIVRVRDAQGKASWAGGADPRREGEALGD

SEQ ID NO: 7116 - protein, 337 aa, Polaromonas sp. JS666
MAHDATDPATTLHRLVTGYQVSQAIHVAATLGIADLLADASHTGDELAALTNTHPPTLYRLLRALASVEVLHELDGRRFELTPLGEPLRSGVPGSMVDLAAYMGRPYRLQAWGGLLHSVRTGENAFRHIYGTDVWTYRSTRPDESAIFDRAMTSLSRGATAALLAAVDFGGFRTVVDVGGGNGALLAAILAAHSHVQGVLFDQPHVVSGATTLLEHAGVADRCRTVGGSFFESVPEHADAYVLRAVIHDWDDDASIRILTAVRHALADNGRVLIVEYMIAPPNEGREAKFSDLNMLVGPGGRERTREEFVALLEASGLRLARVIAAGSQSVAEAVRA

SEQ ID NO: 7117 - protein, 674 aa, Sulfolobus tokodaii str. 7
MLILIICKPKLIILIIIFAIIYDKMIWIYDENGKKYTCDEKGNCENIALVRLHTKEFDKGKLLSVEVKSLIRLSKFPIEMKLDINTNNVLSFTTQQIYAETYGKAFNYYNSLAVDKVPETEPPKEVNYKLENLDHESYLRTYPCWIYPVVGIIPAYSVFVLAEENGKYEAILSLSNNYVTSYLSSDKVIVYTGLVTDTIPESYFLSIGISEDPYEAIRSSFEIASKHLLTFKLREQKGVPQKLLNGLGWCSWNAFLTKDLNEENLLKTVKGIIDRGVKLSWVLIDDGWQDQNSDRALNSLNPDSKKFPSGFKKLIESLRALGVKYVGLWHTINGHWGGLTQNFLKTYSVTGYFSKFLNSYVPPASSLEDSLHFYKEFDGHIMREGFDFVKVDNQWVIHAIYEGLPIGIMARNIQFSLQSIFGLDIINCMSMTPENYCNYLYSNIMRNSIDYVPFWKEGAKLHILFNAYNSLLTSQIAYPDYDMFISYDPYAKIHLIARIFSGGPIYITDRHPERTNVELLKSVLLPNGEIVRVDEPGIITPDLLFKNPLKDDVLLKIRSKVKGYDAIAFFNVNEKEIEEVYKTDKEAIYYKVFSGELGKGDIKVKLKELEAEIVIILPKGRNIVGLKEYLLPPYPIEIIGNNRVYSKANGTLVYIKDSTKKEISIQAEEIVSIE

SEQ ID NO: 7118 - protein, 425 aa, Thiomicrospira crunogena XCL-2
MDYQDAEKMQHQRSFWYFLGPAFLVSVGYMDPGNWATSIEAGSRYGYDLLWVITLASLVAILMQLLSAKLGIATGKNLAQMIRVQHPGKGGTFLLSSAALAMVATDLAEFLGVAVALNLLFDIPLVAAIFLTIFDVLLILWLERFGFRWVEVTIFAFVATIGLGYVVELWLVQPDWVEVAQALAVPNDTIMDTTALFIAMGILGATVMPHNLYLHSHQVTTRSNLAGDALQRFYKMMKWDTILALTAAWVVNSAILIMASAAFHEKGLLITDIDEAYHTLGPLLGSSAALTFAIALLASGIASSATGTLAGQIVFESFFKKRPINILKIRVYIRLATMIPAAIAILLSAKPLSLLVLSQVILSMQLPFAVIPLVMMTSNTTLMGDLVNQPKTKLMAWTATVIIVALNLWLLGMLFWEGFHKMNLH

SEQ ID NO: 7119 - protein, 507 aa, Oryza sativa Japonica Group
MADSGDSSPHSAAATDDAHHEGSEAAAAQAAPPPPAPPAKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGGSSRGGSTPRLRVFLFPVQSPTPPPPPQPSGLLEPKQEQRQWFVDALNSVHQPPPPSPPQPKQESVSVQSPPPAVVPMPQPPPVLPAPTGPDYLFGLDNGFVPPPAVKVKDPAGDPPTVKDNVPVEIPAKNDDRHTTNPVSDHVVVSPVVSPGEFQRQIQGLEKLQFADTAAQQPPPPPAPATAAPPPAALPRNGSDDSLTRAYPPATVTPTPPTATPEYYLPKYQEKPAAPPPSSAPPPTAFLPVPGRYTSVAPGSGADHAPVFFIPAPPHGYFTTAAGPGATSFPAVYAVAQHNGNANASGNGPSPAAASNAQAYAPQVAYDSNGHAIYYTSVLPQYASAVSGVPAAATVLGTDPAKPVAVKPTVS

SEQ ID NO: 7120 - protein, 336 aa, Pseudomonas aeruginosa PAO1
MAFNMHNRNLLSLMHHSTRELRYLLDLSRDLKRAKYTGTEQQHLKRKNIALIFEKTSTRTRCAFEVAAYDQGANVTYIDPNSSQIGHKESMKDTARVLGRMYDAIEYRGFKQEIVEELAKFAGVPVFNGLTDEYHPTQMLADVLTMREHSDKPLHDISYAYLGDARNNMGNSLLLIGAKLGMDVRIAAPKALWPHDEFVAQCKKFAEESGAKLTLTEDPKEAVKGVDFVHTDVWVSMGEPVEAWGERIKELLPYQVNMEIMKATGNPRAKFMHCLPAFHNSETKVGKQIAEQYPNLANGIEVTEDVFESPYNIAFEQAENRMHTIKAILVSTLADI

SEQ ID NO: 7121 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 7122 - protein, 267 aa, Anabaena variabilis ATCC 29413
MKQIKFKNNAGKITAFLFLISILLTPFVVVNAGERGVLMQFGKVQETVIDEGIHIIIPIVHTVKKISVRIQKQEISTEASSKDLQNVFIDVALNWHILPEETNIMFQEIGEEKDIIEKIINPAIEEIIKAVIAGYKAEEIVTRRGELKSSFDQTLTSRLRDYHIAVDDISLVNVRFSDKFIEAVEAKQIAEQDARRADFIAMKAVKQAEAKVNLAKGEAEINRLLSDSLTNDILVRQAVEKWDGKLPIIINNDAPQVLNLREILKLK

SEQ ID NO: 7123 - protein, 287 aa, Bradyrhizobium japonicum USDA 110
MRLELLLDAGSFVEFIGPEQREVSPHLKIFDLPEQFDDGIVVGHGRLDGSPVFVAAQEGRFMGGAFGEVHGAKLTGLLRAAREIGSIPVLILFDTGGVRLQEANAGELAIAEIMRAVMEARAAGVKVIGLIGGRSGCYGGGGLIAGCCSALAVSEPGRIAVSGPEVIETNRGVEEFDSRDRALVWRTMGGKHRRLLGAADVFADDNVQDFREAALELIGLVGPFGLDRLKAEQERLAGRLRRFGACADAVDIWTAEGIEHAETVPELPADQFIALANRIGRTSRDAR

SEQ ID NO: 7124 - protein, 397 aa, Trifolium pratense
MASASASLFKSSLVLDKSEWVKGQTLRQPMSVVRCSPAAPSSLTIRAGAYTDELVKTAKTIASPGRGILAMDESNATCGKRLASIGLENTEVNRQAWRTLLVTVPSLGEYISGAILFEETLYQSTVDGRKIVDVLVEQNIVPGIKVDKGLVPLAGSNDESWCQGLDGLASRLAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRIENVKAAQEALLHRAKSNSLAQLGKYAGDGESEEAKKELFVKGYVY

SEQ ID NO: 7125 - protein, 246 aa, Mycobacterium sp. MCS
MSSTMSRVVAITGASSGIGEATARELARRGAAVVLGARRADHLDRVAAEIREAGGAAVVCTADVTRLDDVRRLADRAVDEFGRLDVMVNNAGIGRIGPISDLDVDGWSAMIDVNLRGVLHGIAAALPIFRRQGHGHFVTTVSTAGLKIVPDQGVYAATKNAVRTVLEALRQESTDGVVRTTAISPGFVNTKMDGSIDDPVLRERIRRSMDDVGLEPEAVAQAIAFAIEAPAHVEIGELTIRPAVQN

SEQ ID NO: 7126 - protein, 307 aa, Clostridium perfringens ATCC 13124
MLKNKHLLDPSDFTIEEFDEIFKLAHQIMANPKEYQNICNGKILATLFYEPSTRTRLSFESAMLRLGGQVIGFSEPNSSSVSKGESLRDTIKTVNCYADLIAMRHPLEGAAKVASMYSDIPVINAGDGGHQHPTQTLTDLLTIKEYKGNLEGNTIALCGDLKFGRTVHSLIKALSRYKNNKFILISPIELRIPNYIREQILEKNNIEYKEITSLEEGIKEADILYMTRIQRERFVDQSEYERLKDVYVLDEAKMKGAKEDMMVLHPLPRVNEIAYEVDEDSRAFYFKQAKCGMYVRMALMAKLLGEA

SEQ ID NO: 7127 - protein, 175 aa, Oryza sativa
  misc_feature (164)..(164): Xaa can be any naturally occurring amino acid
  misc_feature (169)..(169): Xaa can be any naturally occurring amino acid
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAXKPPGXEESGAN

SEQ ID NO: 7128 - protein, 145 aa, Zea mays
  misc_feature (34)..(34): Xaa can be any naturally occurring amino acid
  misc_feature (71)..(71): Xaa can be any naturally occurring amino acid
  misc_feature (89)..(89): Xaa can be any naturally occurring amino acid
  misc_feature (123)..(123): Xaa can be any naturally occurring amino acid
GATCECIDMDDDWDDKRDTRLSVRYSILTLDHSXASNMADKCVLASSGFQGDIKCLCKNLCDRELLYRLHXVCKRMSCPGMAQLLSNTXLDYERFFRILHLQVSSVCLTSRSKAGMSAMMPDXSYDRTGYSAQATRSTYIMSLLD

SEQ ID NO: 7129 - protein, 968 aa, Solanum lycopersicum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPSSLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 7130 - protein, 363 aa, Xylella fastidiosa Temecula1
MAAIIATAWQPFKNETPLTTFPFRFPAEWEPQSAILIAWPHANTDWSAHLADVEETYITLVAAITRFQMVIICVLDDDLQTYTEARLRSASVAMQQVRFTVASYNDTWLRDSGPIILIGINGDFRLLDFRFTGWGGKFEAKADDQLVSSLHANGLFKNTQMHSINFALEGGAIETDGAGTLLTTWRCLHERHPQRTRTTLDANLTAWLAQNRVLWLEHGYLEGDDTDAHIDTLARFASTDSIVYQSCDNTTDSHYAELQAMANELTALRTTEGRPYRLFPLPWTKPILDQDRRLPASYANFLIIEGAVLMPTYDDPADTIAQSVLAEAFPTREIVPVPCRPLIWQNGSLHCITMQIPAGLLAT

SEQ ID NO: 7131 - protein, 212 aa, Glycine max
NGTHPDIHFFCGDSSFAKSNQDSLRNILIIFAKLNAGIRYVQGMNEILAPLFFVFRNDPDYKNANFAEADSFFCFVELLSGLRDNFCQKLDNSAVGIRGTLSKLSQLLKKYDGELQHHLEITTEVNPQFYAFRWITLLLTQEFNFADIIHIWDTLLSDPDGPQETLLRICCAMLILVRKRLLASDFSSNLKLLQSYPPTNIGHLLYVANKLQ

SEQ ID NO: 7132 - protein, 235 aa, Oryza sativa Japonica Group
MAGGGDELKLLGTWFSPFVSRVKFVFHLKGLSYENIEEDLKNKSELLLKSNPAIKKVPVLFHNGKPLCESMIIVEYIDETFAGVGPSVVPTDAYERAVARFWVSYIDNKLVAPWFQVFRSKSMEEKAEGLKQIFVAVMVLEEAFKECSKGRPFFGGDNAGIVDIALGSQLGWVRASQALSGIKLFDPAKTPLLAAWAERFLALDAAKASMPEFGRLIEYAKMRQAESDAANAAAN

SEQ ID NO: 7133 - protein, 471 aa, Aspergillus oryzae
MSFPEVTAANVAEVLHNDRMVIAGVDVDGQLRGKLMKKSKFLSIATGGFGFCSIIFGWDQQDTGYPKELAICNEENGYRDLIAVPDLSSFRRIRWENKVPFFLLSFLDPDTQEPVCACPRGLLKNATAKVEAAGPPADMFAAEYEFGHFRIPGDSFSPERAASGITSFIQNNSVDSLPSLTEGMFGYSMTRSLHSENYHDGILDACEQFRCNIEEWRAKSGPGAFEACSEAKDMADKASLCKYVVKAYGIKHGITPCFMAKPRHELPGNGGHMNISLITADGKSAFTRDTPDPSPPYPDVAHLSDLGRQFLTGLLVGLPDIMPLFAPTINSYKRLVEDLWAPNTVSWGLEHRAAFIRLITPPTANANATRFEIRVPGADANPHFVFAAIIALGWRGVEKKLEIPVPPLPKGEDMSSSSDKSMPLAKALKEAVATFTRLDSVAREVFGDSFVEHFGGTREYKIQLWEQAVTD

SEQ ID NO: 7134 - protein, 519 aa, Arabidopsis thaliana
MNRGAQRYSNLAAAVENTITPPVKVEHTQLLIGGRFVDAVSGKTFPTLDPRNGEVIAQVSEGDAEDVNRAVAAARKAFDEGPWPKMTAYVYNKVVLCLSSERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 7135 - protein, 363 aa, Crocosphaera watsonii WH 8501
MLKAGIVGLPNVGKSTLFNALVANAKADAANFPFCTIEPNVGVVSVPDERLAVLAELSQSQKIVPTRMEFVDIAGLVQGASKGEGLGNQFLANIREVDAIVHVVRCFDDDDIIHVSGSVDPARDIEVINLELALADLTQTEKRLERVRKQVKGKKEGQEEIPALEKILAALNEGMGARHVELTEEEEDLIKSLGLLTRKPIIYAANVSEDDLATGNEWVEAVRKIATADKAKVVIVSAQVESELVEIPEEEKADYLEALGVKEGGLQSLIQATYELLGLRTYLTTGPQETRAWTILAGMKAPQAAGVIHTDFEKGFIRAETVSYEDLVACKTMTVAKEKGLVRSEGKEYVVQEGDVVLFRFNV

SEQ ID NO: 7136 - protein, 602 aa, Chlamydomonas reinhardtii
MPFQSNFQLIKASYKEFLRKVAAAHRGDGAGEAGPAHYYVERVYADASLDQSLARLQTQLLASVDVAELRAAYQARKLRAKLRANQIRQAFDDKVSRLNSYLGGASSSSAAGAVTAVAPATVGEAVAVAAQRDQQPAAVMMAASSGAMVTEAVQRSGGVVSTSAGGGAGASAMELETIFGSDGLLRRMVLLAVGSASRAYMTSLNTTSVEGGGHLAAALERPAGQALITVCNHVAALDDPLVVSALLPEAALQQPDKLRWTLCASDRCFRYAALVPLFRAAKVLPVVRGGGLAQPGMAAAESRLAAGDWVHIFPEGTRSPDGVSLGAVRKGVGRLVASVPEEAPPPLVVPFVHRGMEGVLPRGAVLPATGQKIDVMVGEPIPVADLLHAARAEAWPTDRLHTAVAARVSHHLRDLTARLDARRAGLPDPGPSAAPDAGAAVSSLDQFDPSDLLLAAAAAERRRAGRGVWAAWERVKFRSALERPGGGSWATQGVAAGAAQQQTQQTRMQVAPPGSAVLTGCGGNGSVSAAAGAAAGAAPLMTGASPVLRDLLGWRQGAAAGLVGLGAMYGAGGAGVRRSWLAREELAQGMAGSVASENAAAA

SEQ ID NO: 7137 - protein, 486 aa, Pseudomonas putida
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQGSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 7138 - protein, 509 aa, Nicotiana tabacum
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKAGRMRTSNAFFSFFMAVGNVLGYAAGSYSRLYKIFPFSKTPACDIYCANLKSCFFIAVFLLLSLTILALTVVRENELPEKDEHEIDEKAGGGGKSKVPFFGEIFGALKDLPRPMWILLLVTCLNWIAWFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIVGGPWDDLFGGGNLPGFIVGAVAAAASGILALTMLPSPPADAKPATTMGGFH

SEQ ID NO: 7139 - protein, 506 aa, Aspergillus oryzae
MAVSLSFLTYLFLIVAGVYLARKISRAVQIRQFKKRHGCLPPPRDHHKDPVLGLDEVRSMLRVFREDYLMEYTLEKYRRHGNTFATSVLGDDDIFTAEPENIKTILAVKFKQFDLGETRRRTFHPLLGDGIFAADGPQWEHSRTLLRPSFTRTQIAATDLHERHIQRLISRIPRDGSTVDLQELFFNLTLDTATEFLFGESVESLRLGSSAGSSSFAHHFNVAQDEIAFSMVIAPFDQLIFRPRFRESVREARGYVGNFVKKAIEYRHSLDAEKHAGDTTDSQSRYVFLEELAKETDNPSDITDQILNILLAGRDTTASLLSMVFYNLARRPDIWDLLRSEVATLDGKCPSFEELKQLKYLSWVINETLRLYPVVPSNSRTANEDTFLPVGGGPDGKSPVFVAKGQRVAYDVYVMHRRHDIFGPDAEEFRPERWETIRPGWGYLPFNGGPRICLGQQFALTEASYTTVRIVQSFKEITSRDPEPYRERLALTLASRHGTKVAMVPA

SEQ ID NO: 7140 - protein, 375 aa, Neorickettsia sennetsu str. Miyayama
MVDVEDVKDCRVVLRVDFNVPVNQEGLITDFSRIAVVLPTINLLLKNGCAILLLSHFGKPTAAIKEKFSFERIIGQICQFTGLDIRVVSDLSNELLLRQGEIILLENVRFFAGEVENDSKFAMLIARHGDVYVNDAFSVSHREHASVVGIPQFLPSAMGLAFLREYQELDSAATKGTVAVIGGSKISTKLPLIRGLLKKVKMVILGGALVNVILRSRGYNVGKSMCEDCHCDITLPELFIPFDFVTSHGVEDQNFHFTDARMIPHNEMILDIGPASLIAMKGILSKAEKILWNGPIGAFEFEPFCSGTHELARFISFLTKNANIKSIIGGGDTLAAIKSLQEPCFSYISTSGGAFLKFQEEGTLPGIEAIKKCKV

SEQ ID NO: 7141 - protein, 459 aa, Sulfolobus tokodaii str. 7
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 7142 - protein, 195 aa, Thiomicrospira crunogena XCL-2
MTLQSLPMIMTWSRVALIPVFLVCYYAPIEDARFWAGLAFMIAAITDWFDGYLARKLNVSSKLGAFLDPVADKLIVAAALIVVSVEYQNIWVTLSAIVIMMREISISALREWMAENNARDVVAVSSLGKIKTASQLAALTWLLYGGELWGVDWGTLGFPMLYFSAVLTVITWYQYGRAALPVMLETVSDETKKPS

SEQ ID NO: 7143 - protein, 346 aa, Synechococcus sp. CC9605
MFGLIGHSTSFEAARRKAMELGFDHIADGDLDVWCSAPPQLVEHVEVTSPVGTTIEGAYIDSCFVPEMLSRFKTARRKVLNAMELAQKKGINITALGGFTSIIFENFNLLQHQTVRSTTLDWQRFTTGNTHTAWVICRQVENNAPTLGIDLSKAKVAVVGATGDIGSAVCRWLQARTRVGELLLVARQQQPLLDLQQELGGGRILSLDEALPEADVVVWVASMPRTLEIDQDSLKKPCLMIDGGYPKNLDTKVAGGGIHVLKGGIVEFCRDIGWSMMAIAEMERPQRQMFACFAEAMLLEFERCHTNFSWGRNNITLEKMDFIGAASVRHGFSTLNLHPNLQATAA

SEQ ID NO: 7144 - protein, 296 aa, Physcomitrella patens subsp. patens
MTRASELHASICDAIERVSQSRHLGDGLLDNGAAYDDDEAGVGGSSFEEEVRSLECIRDALEVLETQLESLQSVQQQQRIRKDAALAELEESRRVLLQRLKEHHGREMQVVEEAMTFAGEPVKKTDDLPLPPYLHPVSHSIYSESPVFRSVKAEKPSLMLTDVGSDMTTDTRAADMSTTTHRGEATSASPGGLSRVFSGMITFTGKVLLVAVSVVAIFAASEFNPKSPNPRKSSDEPATRPDPRSEPRSRPTPIFECPPGYKRIEDDGVVKCIVKERVELPFPRGLKTPDVLHGRG

SEQ ID NO: 7145 - protein, 628 aa, Sulfolobus tokodaii str. 7
MIIPINPNFKTKPEEYSEEEKIKLMTKGLTQDSLGIYNSLSDLTKDDIEKEISQIVKSFGIYLEFNRDKMKFDRVKDWIYMIRVAIPGGGPISSDQWRILDEVANKYTVSNAYTGYPQPSLKLTTRQDVQFHNVKKKDLVNAIRDIVQSKFYTLNGCGDNVRNTISCPISSYYGFDINRLAKKIAEYFRLPSKLYIQVFELDPNISSELENRESFQYSDNLLPRKFKIAIAGIIKINGSYVIDNCVEVRANDIGIVPVIEEGKIEGYQIYVGGSMGENNSYPTFSALALPIGTVSEEELVRVLDAIVRIQQEWGDRKNRHWARLKYLVYKMGVEWIREKVKEYSGIELGEIKDIDLSFKELHLGWIKLGDKWGYGIFIENGRVIDGKNGKVKSMIRYIVDNYYDVKLFITPNQHLIITQIDQREEFEKIFKEFGYGIRDGKAYSKLRINSIACVGFPTCKLSFTDSERFLPSLIDELERRGFSNVSASVGISGCVAQCSRPATHPISWVGSGYELYMLKIGGSNDHIGEPLIDWEENVIYLYQVPSKRLADVTEALLQLYEKNKDLGKDAGEVFRKLGNKKIIEYLKSHEKTRDLMKPHKFDTKIEGYREYHELLKQRINEVIKFKQG

SEQ ID NO: 7146 - protein, 271 aa, Oryza sativa Japonica Group
MPAAAAAAARGPLLHLRRNPAPRLAAARRSFSSSGMRCVSAAAGAGGGGRERRSSPAFGGLLLDAGGTLLQLARPVAQTYASLGRRYGMSKSEESIKEGFKRAFSAPWPKTLRYQGDGRPFWRIVVAEATECTNNDYFEEVYEYYAHGDAWRLPAGAYETLRDLKDAGVKLAVVSNFDTRLRKLLKDLHVSDMFDAIVVSSEVGHEKPAPEIFKRALDQIGVEASKAVHVGDDETADKAGANAIGLECWLWGQDVRTFSEIQDRILTRFPQ

SEQ ID NO: 7147 - protein, 650 aa, Anabaena variabilis ATCC 29413
MVKSAPPPTTGRKPSKVEGLKENSNFLREPVATQILEDTTHFTEDAVQILKFHGSYQQDNRDNRTKGQEKDYQFMLRTKNPGGLVPPQLYLALDKLADEYGNHTLRATTRQGFQMHGILKKNLKAAIATIVKNLGSTLGACGDINRNVMAPPAPFKKRAEYQYAWEYAQNIADLLSPQTGAYYEIWLDGEKAISAEESPEVKAARQSNGNGTIIHDTEEPLYGTYYMPRKFKVSVTVPGDNSIDLYSQDLTLVVLTDKKGNLEGFNIFAGGGLGRTHNKEETFARLADPIGYVAKEDVYNAVKAIVATQRDYGDRTDRRHARLKYLINDWGVDKFRAKVEEYFGKPIAPFKQLPEFKYHDFLGWHEQGDGNLFLGISIDNGRVKDEGSFQLKTALREIVEQFNLPIRLTPNQNLIFYEITPENKPAIQAILDRCGVVSDPTTIEPLVRYAMACPALPTCGLAITESERAIPGILERIRTLLDKVGLQNEHFVVRMTGCPNGCARPYMAELGFVGSAPESYQVWLGGSPNQTRLAQPYVEKLHDNDIESFLEPIFVYFRKSRKSGESFGDFCDRVGFDGIREFVAQYQPETTPVTIEPEQPEAVSKSRKARYRVSLHDDLYNKVKATATSQGRSMTDLVKDALEAYFQSLS

SEQ ID NO: 7148 - protein, 160 aa, delta proteobacterium MLMS-1
MKHTISVLLQNKPGVLSRVTGLFSGRGFNIDSLSVAETLEKDVSCLTLVTHGDEAIIEQITKQLHKLIDVIKVTDMVEHEHVEREMVLLRVKAEAETRAEVLRVIDIFRGKVVDVSPKSYVVEITGSKSKVQAVIDILRPIGIQEIVRTGGVAITRGKKF

SEQ ID NO: 7149 - protein, 291 aa, Wigglesworthia glossinidia endosymbiont of Glossina brevipalpis
MKIKNNFSKKENIMKIFKKITFIGSGKIAESMIIGLINSKYPSDCIFVCSPDEKSRSAISERYLVKNFKENLIGSNIGEIIVLAVKPNIIPIVCEEIKNLTNIENKLIISVAAGININSIKKYLNNKKALIARAMPNTPVLVREGVIGLYAKKDIRTIHEKTIEQIFNRIGKIFWLSQEKEINYIISASSSATAYFFLMMDAMKNTAENIGINKSYSREVILQTAKGAIVLAEHFSEISFNTLKKHITSKKGTTEAALNSFKKNNFRKIVEISMKAAVSRAKEISIDVDKV

SEQ ID NO: 7150 - protein, 334 aa, Synechococcus sp. RS9916
MTIRIGINGFGRIGRLAFRQAMSSPDVEVVAINDLIQVDYLAYLLRYDSTHRRFPGDIQVEDGHLMVNGKPIRVTAERDPHQLHWDEVDVDYVLESSGLFLTADKAHAHLEAGAKRVVMSAPSKDDTPMFVMGVNHTSYAGQDIVSNASCTTNCLAPLAKVVNDNFGIVSGLMTTVHATTATQKPIDSPSLKDWRGGRGAGQSIIPSSTGAAKAVGRVIPELNGKLTGMAFRVPTPDVSVVDLTVNLARPASYDEIKQAMKAASQNGLSGILGYTEDPIVSNDLLGESCTSVFDAGAGMALNDQFMKLVAWYDNEWAYSCKCIDLIRHMAAYTG

SEQ ID NO: 7151 - protein, 233 aa, Wigglesworthia glossinidia endosymbiont of Glossina brevipalpis
MKLLIKKNLEKIQNKIYNLSKYYNRNPKNINLLLASKSRSVYEIKFANEYNQNNFGENYVQEAIKKIVWFKKNHPKNNLIWHMIGQIQSNKSKLIAKYFDWCHTINNIKISKKLNNYRKIKKKPLKVLIQININEEKNRYGSSLKEFDNIYEFIFQKCNNLMLKGIMIFPIITDDLNKKIYNFNIIIDKFNTLKNKNSNFNVLSFGTTSDIDHAIKIGSTLLRIGKGIFENKK

SEQ ID NO: 7152 - protein, 553 aa, delta proteobacterium MLMS-1
METGVEVIFGFPGGAVIDLYDELLRTDKLTHVLVRHEQAAIHAADAYGRVRGEVGVALVTSGPGATNTVTGIASAYCDSIPLVVFTGQVPTMLIGNDAFQEVDIVGITRPVTKHNYLVKKPEDLIPTIREAFHLARSGRPGPVLVDLPKDVIGAMVKYTEPKPIKMRTYRPTYEPHPGQIEKACKTILKAKKPVLYVGGGVINANASEELTALAKKLDIPVTMTLMGLGAFPGTDPLSMGMLGMHGTYYANMAVAHCDLLIAVGARFDDRVTGRIDAFAPHAKIIHIDIDPSSISKNVKVDIPIVADCNHALAAMNSWFNNSQEFNQEEARQRHRPWHEQIKEWKNKHPLGYIEETNVIKPQFVVQKLHELTGGNAIITTEVGQNQMWAAQFYYFNKPRHFMTSGGLGVMGYGFPAAIGAQMAAPNEVVIDVAGDGSIQMNIQELATARQYKCPVKIAILNNNYLGMVRQWQELFYDKQYAHTTLDVAPDFVKLAEAYGAVGLRATKPSEVEPVIKEALKTNNTVLMDFVISREEGVYPMVPAGKATTEMLLV

SEQ ID NO: 7153 - protein, 1016 aa, Solanum lycopersicum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTYLDLGENALNGSIPASLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 7154 - protein, 365 aa, Solibacter usitatus Ellin6076
MRTSNAALIREWTMLVALASSALFFVFGRSWLADLSNPMWLAFLFVWPFAVILLSATSVVRHAESLAAILGEPLGTLVLTLSITGIEVMMIASVMFAGEGHPALARDAVFSVAMIGLNGIVGLSLIVGGIRYREQQYNLQGAQAFLAVLVPLLVLGLVLPNYTVSAAGPTMSPLQAGSQIVISLALYGVFLAIQNVRHREYFMADPDAATDIPATISPWYHFPFLLGYLLLIVYLAEQIAIPIDYSIDVLKLPPALGGLLVSVLVMTSESLSAVRAAMANELQRSVNLLLGSVLASTSLTIPAVLAIGFISGQTIILGLGPVEMTLLLLTVGVSALTFASGRTNVLLGAVHLVLFLAYLMLIFEH

SEQ ID NO: 7155 - protein, 171 aa, Prochlorococcus marinus str. MIT 9515
MENKLIELIETYNDFPRKGIEFKDVLGIIQEPKIFKELILKMSSSQIIRNAEAIISIDARGFIFGSAISLEASKPMIVARKPGKLPGELSKKKYSLEYGENSLSIQKKCLQKYNSYAIVDDLLATGGTVSCVSKLLESNGKEVLGLLVVVELMKLKGRFKLKFPVESSITF

SEQ ID NO: 7156 - protein, 397 aa, Oryza sativa Japonica Group
MGYNNPYDSSGTDDDLPPTQNRGLRVRSFSANGRASVMPFSYIRPHGDLESEIHQVEQEAYTGVLRAFKVQSDAISWEKESLITELRKELRVSDDEHRELLNKVNEDVAIRRMREFRQGGGSLSAQHRGSRIFHDTEPGPAAKRQRTPLSIPSHSAGLQSPAMPSPSVPSSTKWGPFSGTKGKKTRTNTPLAVPSADPTSLINRKIYTRWPDDNNFYEATITDYNPATGKHALVYDMGTVAQTWESVRLSDLAPEDIIWDLDDQGISNRDGWGPHPGMRRHPGNNGTMAMASRGGGRFSRNEPTKDSAPPQNGINRNIGHIDVPNTRSVVIEVERVLSNPNMGEIEKAKKLLQDQEQSLLDAIARLDDASDSESEDMAVGAQMVSAGDHMGRNGVAC

SEQ ID NO: 7157 - protein, 382 aa, Xylella fastidiosa Temecula1
MQVTSKLPQVGTTIFSVMSQLADVYGAVNLGQGFPDFPVPLRLQEALAGAVREGHNQYPPMIGVAGLRQGIAAKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPSALSAEFRKVHQYNTFTSFGPAQYAFAAMLHEEPGYVEQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 7158 - protein, 410 aa, Zea mays
  misc_feature (53)..(53): Xaa can be any naturally occurring amino acid
MASQGSSVFAALEQAPEDPILGVTVAYNKDPSPVKVNLVVGAYRTEEGKPLVXLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 7159 - protein, 520 aa, Aspergillus oryzae
MNPERNAEDVPDDEASIEAAPLIHQAENETVVPPGQGQPNRRLGLVSTTFLITNRMIGTAIFSVPSAIAHSTGSAGASLVVWVAGYFLAFCGFFIYLELGSLLPHNGGEKIYLEAAYPRPPLFATVIFATHIIFLGFTGIGTIAIAENILLATQATADDRTKRCMAIAFVASVAAMHICAKTWNVKLMNILASLKLFVLALMVLTGLGLVIFGSPNIPYPGASYKHPFAGSSTDVADYTVALFKVLATFQGWSNAMYVLDEVKDPRRTLKVAGFLGVGSVGVLYVLLNAAFFVAATPKELSETGITVVALFVGKVFGQHMQRFTAILAALSSLGNIMTASFSMSRVIRSFAQEGLLPFSRFFASRSRSGSPAGAFALVFFSSCVMIIAVPFGEAYNFVLDVGQWAVALIQFFVVCGLFIIRKRVTYPPRAFKVWTSVACLFLATQVFLIVSPFVAPVTGRTSIPVWLTPLTGTLLFCLGGMYWYIWWILLPRLGQFSWEKSALIGPDGEHAVAWRRVSKN

SEQ ID NO: 7160 - protein, 569 aa, Mycoplasma pulmonis UAB CTIP
MELKGIGASRGIAIAKVFRILEDEIEIPKNSLGVEKETENFKKTCEKILNELKEIEKKLLISKPEEAAIFQAHQDIASDPVMQEEIIDLIKNNKSAMQAVDEVYQRYSELFESMDDEYMRERASDIKDIKKKMLYSLAGKEILDLSKINQEVIIVAHDLTPSQTVQLNKKYVKGFATNIGGATSHSAIMARSLNIPSVVGLKNILEMTKDGDILAIDGMGESVVINPDQKTLKIYEEKLLKHQEFLKILQNFKNKPSLTKDGHKVEIAANIGSPKDMEDVIENDAEAVGLFRSEFLYMDNSNWPSEEEQFQEYAKTIKAFKDKNKKTIIRTLDIGGDKTLNYFAFPKELNPFLGYRAIRFTLEHEQIFKDQIRAIIRASFFGKVGVMFPMITNVDEFLKAKEMFEKEYQLLKDEKQEIGKREDIELGLMIETPAAAVLSDKFSKYADFLSIGTNDLIQYSMAADRMNEKISYLYQPLNPSILKLIKLTIDGGHKHGKWVGMCGEMAGNPEAIPVLLGLGLDEFSMSASNVLQSRELISRLSYQQMKELAQKALECEREQEVKELYKNIK

SEQ ID NO: 7161 - protein, 193 aa, Zea mays
MASATTYNLADQILKQNRWEYSNPGYLDALKHITDLKEEGKIKTVALTNFDTDRLQIILENGIPVVSNQVQHSIVDMRPQQRMAELCQLTGVRLITYGTVMGGLLSEKFLDTNVSIPFAGPPLNTPSLQKYKRTSVAGSMVGVRLGLSEHIKDTNAIFSLELDEEDMNIITEVSKRGRNLIDIIGDCGDEYRA

SEQ ID NO: 7162 - protein, 275 aa, Vibrio sp. Ex25
MPMTKDLSHLLPQVIEIARSAGQMILEIYEKKQYEAYTKSDETPVTSADIAAHKLITERLSELTPDIPVLSEEDADISLEQRAQWERYWLVDPLDGTQEFIARSGDFATIIALVDNNKPTMGVVYGPVSGVTYYAYSGKGAWKIPDMSDSVKIHTHKHEQPGQSIAIAISRRQDINRITSRMSSAWNYDLIPLGSAALKACLVAEGAVDCYLRLGPTGEWDTAATQCIVEEAGGRILSTQLEPLSYNERETLENPNFIVLGDADLPWNEILQRKD

SEQ ID NO: 7163 - protein, 648 aa, Vitis vinifera
MQQAWDTQSHLCHLIFCANYWAVTLPGHPRAAAAPITPDVSSSFLRFPSSINSLPHIHRIVNFRRFAANKRPPIFLSEHSIHSCLSPTTMASINASCPTAAISRLRACKNFKLFNGLHGVNPSLSNWYTSDLALIRLGSKSSFTIKGDGRTRATLISGEGGLLSYSNGNNVAAITKDQSVGIEIQPDAIAFGTLEADTAPATNGFPIDNDEFDLDRPSEGFSSIPEAIEDIRQGKIVVVVDDEDRENEGDLIMAASLATPEAMAFIVKHGTGIVCVSMKGEDLERLEIPLMVTQKDNDEKLSTAFTVSVDAKHGTTTGVSARDRATTILALASRDSKPEDFNRPGHIFPLKYREGGVLKRAGHTEASVDLAMLAGLDPVAVLCEVVDDDGSMARLPKLRQFAERENLKIISIADLIRYRRKRDKLVDRSAGARIPTMWGPFTAYCYRSILDGIEHIAMVKGEIGDGQDILVRVHSECLTGDIFGSARCDCGNQLALAMQQIEKAGKGVLVYLRGHEGRGIGLGHKLHAYNLQDDGRDTVEANEELGLPVDSREYGIGAQMLRDLGVRTMKLMTNNPAKYIGLKGYGLAVSGRVPLLTPITKENGRYLETKRSKMGHVYGLEFNGHLTNLISGNGKQSINTQPDPVSDS

SEQ ID NO: 7164 - protein, 175 aa, Triticum aestivum
MPPRMMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 7165 - protein, 630 aa, Oryza sativa Indica Group
MESGLVASHRLRVPSAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKQSQEPESTTSEKSGQQSQ

SEQ ID NO: 7166 - protein, 283 aa, Acinetobacter sp. ADP1
MADIDYLLNKQSFIEMDARERAKSLFDLNSCKELLDPFAGVMSPWLLRQNIVPQADDGVVVMKGFIEQQPAVVISVEGSFQGGSLGEVGGAKIAGALELAIEDNCNHIPTRAILLLETGGVRLQEANLGLAAIAEIHSAIVELRHYQPVIGVIAGSVGCFGGMSIAAGLCSYLIMTQEGRLGLNGPQVIEQEAGIDEYNAKDRPFIWSITGGEQRFASGLIDAYVEDDRELIKQKVIAYIQQGIPQVQRSTQSTFYLSKLFQLDTSDQILPVDVRKLYQGEQA

SEQ ID NO: 7167 - protein, 443 aa, Vitis vinifera
MQAWQLLAIFLSTVAGLVLNPLPVGAWAFLGLTTSILTNTLSFSTAFGAFTNEVIWLIVISFFFARGFVKTGLGDRVANYFVKWLGKSTLGLSYGLTFSEILIAPAMPSTTARAGGIYLPIIKSLSLSVGSKPGDPSARKLGAYLVQSQFQSAGNSSALFLTAAAQNMLCLKLAEEVGVIVSSPWVSWFRAASVPALVSLLLSPFILYNLYPPEIKDTPDAPAMAAKRLEHMGSVTRDEWVMIGTMILAVSLWVFGEALGIASVVAAMLGLSILLLLGVLEWDDCLSEKSAWDTLAWFAVLVGMAGQLTNLGIVTWMSSCVANLLQSFSLSWPAAFGVLQASYFFIHYLFASQTGHVGALYSAFLAMHVAAGVPGVLAALTLAYNTNLFGALTHYSSGQAAVYYGAGYVDLPDVFKVGFMMALSNAVIWVVVGSFWWKFLGLY

SEQ ID NO: 7168 - protein, 304 aa, Xanthomonas oryzae pv. oryzae KACC10331
MSCVVKTSERPSSPSTNHMHCAPRTAAPAIPHSQRNTMTVPTFGLGTFRLKDQVVIDSVRNALEVGYRAVDTAQIYDNQAQVGEAIAASGIVRDQLYLTTKIWVDKFGDGALLPSLQESLRKLGTAYVDLTLIHWPSPNDQVPMREYLEALAQAKQQGMTRAIGVSNFTIALTKQAIGILGADAIATNQIEVHPYLQNRALTDFLREQGIHVTSYMTLAVGEVLKYPVIQAIAARHAATPAQVALAWALQQGHSVIPSSTKRENLESNLKAQTLQLSEQDMGEIAALDRGHRLANPKAIAPDWD

SEQ ID NO: 7169 - protein, 870 aa, Triticum aestivum
  misc_feature (746)..(746): Xaa can be any naturally occurring amino acid
MDRSPAPLSPPGFAVPLAVKKRQQAAPGYSSSSSPWGVPPAPPLTNNNNPNPPNGLRAGDTSIFSTSLPVLPHEKLNFPDSAHGTPSMDDASAKLKDFDDDPQGNDYPFDFDLRQIDDLLPDEDELFAGITNEMEPSSQANPVEELEEFDVFGSGGGMELDSDPLDSITAGLGNASISDGIRANGVNNNFGLSNSPGAVAGEHPLGEHPSRTLFVRNINSNVEDSELRSLFEQFGDIRTLYTATKHRGFVMISYFDIRAARGAMRSLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRSLVQHLGHELEDETRGYRHSPHVGSPMANSPPGAWAQYGSPTDNNLLHAFSNSPTGNGMSPIGMSPSMMSNALKIAPIGKDNNWSKYDQVFSNSNQSLGAAFQYSQSYQDRKSEHMSSSPGTLTGPEFLWGSPKPYPEHSQSSSMWRPPPVGHAMSSSSRPQGQGFLYGSRQASLFGSLDQNRHHVGSAPSGAPFESHFGFLPESPETSFMNQVRFANMGNIGGANRNGGSLMLNMASRASLNPVSALSGSLTDNNSTNFRPVPSPRLGQPPFFGNTTYQGPGYYGLDSSSIERGRNRRVDSSAFQADSKKQYQLDLDKIRKGEDTRTTLMIKNIPNKYTSKMLLAAIDELHKGTYDFFYLPIDFKNKCNVXYAFINMISPVHIVSFYQAFNGKKWEKFNSEKVASLAYGRIQGRNALISHFQNSSLMNEDKRCRPILFHSNGPETGNQEPFPNGICIHMPLDGGAGSSKEPLGFEEDDNPSEIKISGEKSMAGSL

SEQ ID NO: 7170 - protein, 295 aa, Zea mays
  misc_feature (166)..(166): Xaa can be any naturally occurring amino acid
  misc_feature (231)..(231): Xaa can be any naturally occurring amino acid
MGKDDVVESGAGGGEFAAKDYTDPPPAPLVDAAELGSWSLYRAVIAEFIATLLFLYVTVATVIGYKHQTDASASASGAGADAACGGVGVLGIAWAFGGMIFVLVYCTAGISGGHINPAVTFGLFLARKVSLVRALLYMVAQCLGAVCGVGLVKAFQSAYFDRYGGXGANSLASGYSRGAGLGAEIVGTFVLVYTVFSATDPKRNARDSHVPVLAPLPIGFAVFMGHLATIXVTGTGINPARSLGAAVIYNKDKPWDDHWIFWVGPLVGAAIAAFYHQYILRAGAIKALGSFRSNA

SEQ ID NO: 7171 - protein, 286 aa, Arabidopsis thaliana
  misc_feature (170)..(171): Xaa can be any naturally occurring amino acid
MEGKEEDVRVGANKLPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAXXYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVVVIRAIPFKSRS

SEQ ID NO: 7172 - protein, 1383 aa, Oryza sativa Indica Group
MELSNQGQTPMSTNMGSQPLPSSNIQPNQAEYPSMLYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRIEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQAYKGRQHVPLTSARPVEQMRELVQKYGKRSSVQARPWDDDDDDDIPEWNPNQLVTQQQPTRQLPVPPTPQQPLPPPPPPPSLQQLHHPYQHQQLYHHQNALQPQIPSNSIPQAYLRTQQPLQQLPLMQQQLQPAQAWQQTNAWWPAQGGAAAAAAAAAAPASMVQQSQYGVIPNSNNSTQSYGSGSESGSEDDDLDVGIGDVPSELEVKNSGLIPAQSKETERQLSKKELKKKELAELDTVLAELGISGHAERKPDKQNGGDKNGAPQGPWRGGGYKSEEEITAVYVKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 7173 - protein, 389 aa, Picea sitchensis
MNMYYRFLISELQKDAMKKYRVFSSIACVFVFVSAFIISTSGLHVHVDDLPTPVDGLSWTFYKETCPDLEDIVKSTLEQALDQDITQAAGLLRLHFHDCFVQGCDGSLLLTGSASNPSEQEAQPNLSLRARALQIIDEIKTAVEASCSGVVTCADVLALAARDSVAKAGGPKYPVPLGRRDSLDFASESVVLANIPTPTSNLTQLMSIFGPKGFSLTDMVALSGGHTIGIAHCNSFDNRLYNTSTGEAIVDPTLENSFASNLYSICPAVNDTVNTADLDVLTPNYFDNSYYVNVQRNQALFTSDQSLYTDSTDSGDIVDSFASKKTVFFKKFVLGMVKMGQLDVLTGSEGEIRSKCSVPNPTSSSYEEVIEPIVSTGKRSRSGHVHSEL

SEQ ID NO: 7174 - protein, 515 aa, Gibberella zeae PH-1
MGFQITHLWKAPEVNPISRKARSVPMLNPIDMYGRVFSFSWLGFMLAFWAWYTFPPLLTVTIKEDLHLTPAQIANSNIVSLSATFFLRFLTGPLCDLYGPRRVFAYLILLGCLPIGLAPLVNSATGLYVSRFFIGILGATFVPCQVWCTGFFDKNVVGTANALAGGWGNAGGGITYFIMPAVFDSLVANHGLTPSKAWRVTFIVPLVCLIVCGLGMLLLCEDSPMGSWDNQNELVRKNMEAHGISSSGDVTPIGTRTPDRAGSDEEKSPGEEKDVKVGDHEHSISRTEAMEIARGEIVVKPSLREALPVTYSPQTIFHIATYACSFGGELAINAILSSYFKKNFPHLDQTKASNYAAIFGFLNFVNRPLGGVIADLLYNNFGRSLWLKKVWIITCGLVTGALLIVIGKVNPSEANGGNIGTMVGLVVVMAIFIEAGNGANFALVPHVHPSANGILSGLTGGGGNIGGVIFAIVFRFMHGGNDYAMGFWVIGIITIALNLAVCWIPPLPKGQIGGH

SEQ ID NO: 7175 - protein, 325 aa, Anabaena variabilis ATCC 29413
MPKKLLQSIKPFLKTVFTLGLVLVLALGNADGALAARSGGRIGGGSFRAPSSRTYSPRYAPPSGGYGYSPYPGGGFGFPFLLPLWGIGGGFGGLFGILIFFAIANFLVQTFRRVSSGEVSEDVGYNSNPTVTVTRLQVGLLAQARDLQPELNHIAETADTNSPTGRTEVLQEASLALLRHPEYWVYAGVGTQQAKLNSAESQFNRLALAERSKFSEETLSNVNNQLKAARTKDALPGADEIDNPTRLITEGPGEYIIVTLLAATLGKFELPAVNSSDELRQALRQIGSIPAEQLLAFEVLWTPQAEGDTLTSDDLFAEYPDLKLV

SEQ ID NO: 7176 - protein, 411 aa, Pseudomonas aeruginosa PAO1
MSQNFSFRQAAVIGAGTMGRGIVMCLANAGLDVQWLDSNPQMLNQALGAVADTYAHNVRQGRIGEEEAAARRARITPVQHLAAMREADLVIEAVYENLELKQSIFRELDAALKPSAVLASNTSYLDIDAIAAVTARPRQVLGLHFFSPAHIMRLLEIVRGAQTAPAVLEAALALGERMGKVSVVAGNCHGFIGNRMLEPYATEARLMLLEGALPYQVDRALQAFGFAMGPFRMYDVVGIDLEWRARELAGVGQDQPAVQVDNRLCEMGRFGQKSGAGYYRYAPGSRQAEHDTEVDALVLRVAETLGYPRRDFADEEILERCLLALVNEGAKILDEGIAARSADIDTVYLNGYGFPAAEGGPMAWADRLGAADLLQRLRFLEQRHGARWKPASLVERLAAEGGAFADLQEVR

SEQ ID NO: 7177 - protein, 360 aa, Physcomitrella patens subsp. patens
RVASPAWRDDDKDGHYMFELGENITPRYKIISKMGEGTFGRVLECWDRENQEYVAIKVIRNVQKYRDAAMIEIDVLRTLAKNDKMGIRRCLQLKTWFDYRNHVCIVCERLGPSLYDFLRKNNYRPFSADLVRDFGRQLLESVAYMHELTLIHTDLKPENILLVSSEYVKVPDYKTSNTGKHVKRVPKSSEIKLIDFGSATFDNHYHCSVVSTRHYRAPEVILGLGWTYPCDIWSVGCILVELCSGDALFQTHENLEHLAMMERVLGPIPVHMIRRADRRLEKYFRHGRELNWPEGAVSRESIRAVRRLPGLRNLIMHHVDHSGGLLIDLLQGLLKFEPSERLTAKDALKHPFFKESNRRL

SEQ ID NO: 7178 - protein, 466 aa, Solibacter usitatus Ellin6076
MGKVTGFLEYTRELPTRRDPAERIKDWFEIYNPFPEESVKTQGARCMDCGVPFCHTGCPLTNIIPDWNDLVYRGRWKEAARQLHATNNFPEFTGRICPAPCEAACVLGINEPPVAIKQIEKTIIDRAFAEGYIRPEPAQVRTGKRVAVIGSGPAGLAAAQQLARAGHDVTVYEKNDRIGGLLRYGIPNFKMEKHLIDRRLEQMLGEGVRFETNAHVGGNVSVEDLRHRYDAILLAGGAEQARNLNVPGRELKGIHFAMEFLPQQNRVCEGDTVANQIMATGKNVIIIGGGDTGADCLGTSHRQGAKSVTQFELLPKPPDTRSPATPWPLWPMQLRVESSHEEGGTRDWSVSTVSFSGDAGGNVKKLHAVRVGPPPKVEAVAGTEFTLDCDLVLLAMGFTGPVKNGMLEQLGVELDLRGNVAADANHMSSVPGVFAAGDMRRGQSLVVWAIAEGRKAAAGIDRYLKA

SEQ ID NO: 7179 - protein, 525 aa, Schizosaccharomyces pombe 972h-
MLKKQALSGIRRFSLATKQSFVKTSYKLPRKSWLNTAKFNTIRYASTEAAKHNKGSIKQVIGAVVDCQFEDADSLPSILNALEVKLPDNKRLVLEVAQHVGENTVRTIAMDGTEGLVRGTAVIDTGSPISIPVGPGTLGRIMNVIGEPVDERGPIKAVKYSPIHADAPSFEEQSTTPEILETGIKVVDLLAPYARGGKIGLFGGAGVGKTVFIQELINNIAKAHGGYSVFTGVGERTREGNDLYREMQETGVIKLEGESKAALVFGQMNEPPGARARVALTGLTVAEYFRDIEGQDVLLFIDNIFRFTQAGSEVSALLGRIPSAVGYQPTLATDMGAMQERITTTKKGSITSVQAVYVPADDLTDPAPATTFAHLDATTVLSRSISELGIYPAVDPLDSKSRMMDPRILGEEHYNLAGSVQQMLQEYKSLQDIIAILGMDELSEADKLTVERARKVQRFLSQPFAVAEVFTGIEGRLVSLKDTIRSFKEILEGKHDSLPESAFYMVGSIDDAVKKAEKIAQELAA

SEQ ID NO: 7180 - protein, 500 aa, Amborella trichopoda
MRINPTTSGSGSGASTLAEKSVGRIAQIIGPVLDVAFPPGKMPNIYNSLVVKGRDTAGQQINVTCEVQQLLGNNRVRTVAMSATDGLMRGMEVIDTGAPLSVPVGEATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGPDELSEEDRLTVARARKIERFLSQPFFVAEVFTGSPGKYVGLAETIRGFQLILSGELDGLPEQAFYLVGNIDEATAKAINLEVESKLKK

SEQ ID NO: 7181 - protein, 545 aa, Neurospora crassa
MSSPAKTPSATAARRIHATANHLRPAAAALESTATSYPTTHDKIADVKDTPWFIDNKFVTSSTTQYIDLHDPATNNLVTRVPQNTDEELKAAVASAQKAFESWRNTSVLHRQAIMFKFVGLIRENWDRLAASITLEQGKTFADAKGDVLRGLQVAEAACAAPELLKGEVLEVAKDMETRSYRDPLGVVAAICPFNFPAMIPLWCIPIATVTGNTLILKPSERDPGAAMILAELVQKAGFPEGVVNIVHGAHRTVNFILDEPAIKAISFVGGNKAGEYIFARGSANGKRVQANLGAKNHAAVLPDCNKNQFLNAVVGAAFGAAGQRCMALSTLVMVGETKNWLPELAERAKALNVNGGFEEGADLGPVISPQSKERIESLIASAEQEGATILLDGRGYKPAKYPNGNWIAPTIISNVTPSMKCYREEIFGPVLVCLNVETLDEAIELINSNEYGNGVAIFTRSGPTAETFRRRIEAGQVGINVPIPVPLPMFSFTGNKKSIAGGGASTFYGKPGVNFYTQLKTVTAHWAAQDAIGQKADVAMPTHS

SEQ ID NO: 7182 - protein, 252 aa, Bacillus halodurans C-125
MNAHEIKKLFPVLDQEVNGSPLVYLDSAATSQKPIAVIEALDDYYRRYNSNVHRGVHTLGTLATDGYEGAREKIRRFIHASSTEEIIFTRGTTTAINLVAASYGRANLGEGDEIVITPMEHHSNIIPWQQVAKATGATLTYLPLQKDGTIKIEDVEKTISEKTKIVAIMHVSNVLGTINPVKEIAEIAHRHGAIMLVDGAQSAPHMKIDVQELGCDFFAFSGHKMAGPTGIGVLYGKKAHWRRWSRWNLVVK

SEQ ID NO: 7183 - protein, 175 aa, Triticum aestivum
  misc_feature (170)..(170): Xaa can be any naturally occurring amino acid
LVPNSARAGTEMNFTTDEKYASICDDKNMYVDYKNITKVIEPGRIIYVDDGVLAFDVLKIVDEQTIHVRCRNNGKISSKKGVNLPNTDVDLPALSEKDQADLRFGVKNNVDMIFASFIRRGEDIKHIREILGEEGKHIQIIAKIENRQGLNNFAEILKETDRVMGAKGDXGIEIT

SEQ ID NO: 7184 - protein, 285 aa, Mesembryanthemum crystallinum
MEGKEEDVRLGANKFTERQPLGTSAQTKDYKEPPPAPLFEPGELQSWSFWRAGIAEFVATFLFLYITVLTVMGVQRSSSKCASVGIQGIAWAFGGMIFALVYCTAGISGGHINPAVTFGLLLARKLSLSRAVFYMIMQCLGAICGAGVVKGFQPSQYEMLGGGANVVNHGYTKGSGLGAEIVGTFVLVYTVFSATDAKRSARDSHVPILAPLPIGFAVFLVHLATIPITGTGINPARSLGAAIIFNKGHAWDDHWIFWVGPFIGAALAALYHTIVIRAIPFKSRA

SEQ ID NO: 7185 - protein, 428 aa, marine gamma proteobacterium HTCC2143
MAASFGARVAVAEDRYMGGTCVNVGCVPKKLYVYASQFSNAFGDARGFGWTTSAPSFHWPTLRDNKVAEISRLNDVYQNMLGGAGVNIIDGRARFIDAHTVEVNGQSYSAERIILATGTWPFIPNIPGSEHAITSNEIFDLENFPQRLLVVGGGYIAVEFAGVFNGLGAETTQLYRGPLFLRGFDQDIREFAAQEIEKAGVNLRFNSNIAAIEKLADGSLEATLDDGTTIAADAILYATGRNPHLQDLGFENVNIALNDNGTVKVDDHFQTTEPSIYALGDITGGMELTPVALAEGMALAKTLYNDQPTSVDYDTIPTAVFCQPNIGTCGLTEQEGKDKYGEITVYESDFRAMKHTIGGRQERTYMKLVVDTATDKVVGIHMMGDDAGEIVQGMAIAMKAGATKALFDSTIGIHPTAAEEFVTMRTPR

SEQ ID NO: 7186 - protein, 352 aa, Chlorobium tepidum TLS
MMYKIVSIPGDGIGPEVVAGALDVLNAVAKKHGFEVSVEEHLFGGASYDVHGSMLTDETLEACKNCDAVLLGAVGGYKWENLPHDKKPEAALLKIRKELGLFANLRPARVYDALVASSTLKTEVVQGTDFMVFRELTGGIYFGQPRGYDETRGWNTMVYERYEVERIARLAFEYAQKRGNAKVTSIDKANVLEVSQFWRNIVHEVHQDFPEIELVDMYVDNAAMQVVRNPKQFEVIVTSNLFGDILSDISGMITGSLGMLPSASIGSEHALYEPIHGSAPDIAGQNKANPIATIASVAMMFENSFNRPEVAADIYAAIEGALAAGFRTGDIAAAGEAISSTTEMTAAIVARI

SEQ ID NO: 7187 - protein, 302 aa, Acinetobacter sp. ADP1
MTQWNIQSVVDGLQKARHDWRESQHRTKEMGDRELPSKEILKSIIDDLCGILFPMRLGPSELRQQTENYYIAYTLDRVLNELLIQTRMALNYEAKLHPESSHPDLDAYAKQIVHEFADALPQIRRLLDEDVIAAYEGDPAAHSVDEVLICYPGLLAIIYHRLSHQLYPHVPLVSRIISELAHSETGIDIHPGAKIGKGFFIDHGTGVVIGETCIIGERVRIYQAVTLGAKRFETDDQGGLKKDYARHPIVEDDVVIYAGATILGRIIIGKGSTIGGNVWLTHTVPAGSQILQSPSETCKNIG

SEQ ID NO: 7188 - protein, 360 aa, Polaromonas sp. JS666
MTANLADLRVQIDAIDKELLALLNRRAQVAEQVGDVKKLEGTPFFRPDRVAQVIEQIQQANTGPLKNEHVAAVWREIMSACLALESPVRVAYLGPAGTFSEQAALQFFGASIEHVPCISIDEVFRATAAGSAGYGVVPVENSTEGVVSRSLDLFLNSPLHIVGEISLMVRHNLLRLSDSLDDIEAVYAHPQALAQCQGWLTTHLPNAERRAASSNAEGARLASTNPAWAGIASDRAAAQFGLHTAAHAIQDDAFNRTRFAVVCLPQTLPSPPASGKDCVSLVVSVPNRPGAVHDILVPLKTHGVSMTRFESRPARSGQWEYYFYIDLQGHPSQPHVKAALADLQQLCAFYKVLGTYPVSD

SEQ ID NO: 7189 - protein, 159 aa, Chlorobium tepidum TLS
MKHLISVLVENKFGTLNRVAAMFSARGFNLESISIGETEDPEISRMTIVTRGEDRIISQVLKQLNRLIDTIKVTDLTHQPHVERELLLLSLKLSKSTQHEIFELANVFKGKVVDIKQKSITIEFVGSPDKINTAIDLFRPFGIRELARSGAVAIHRGES

SEQ ID NO: 7190 - protein, 252 aa, Olea europaea
MPISRVAIGSPAEFSQLDAIKAAVAEFISMLIFVFAGQGSGMAFAKLTDNESTTPAGLIAASIAHAFALFVAVSVGANISGGHVNPAVTLGAFVGGHITLFRSIMYWIAQLLGSVIACLLLKFATGGLETSAFALSSGVTVWNAVIFEIVMTFGLVYTVYATAVDPKKGNLGIIAPIAIGFIVGANILAGGAFDGASMNPAVSFGPAVVSWTWDSHWVYWLGPFVGAGIAALVYEILFINQSHQQLPTSAEY

SEQ ID NO: 7191 - protein, 509 aa, Nostoc sp. PCC 7120
MSNSELDRVIVRPVDEYNQKLVAYVHPPDWVNPQPADNYDLVVIGAGTAGLVVAAGAAGLGLGLKVALIEKHLMGGDCLNVGCVPSKTIIRSSRVVGEIWNGKNLGVNIPSQIDIDFPAVMARMRRVRAGISHNDSAERFASLGVDVFLGSGRFASSNTVEVAGKTLKFKKAVIATGARATKPAIIGIEQAGYLTNETVFSLIQRPEKLAVIGGGPIGCELAQAFRRLGSEVVLIHSGSHVLNKEDNDAAQIVQQTLIKEGIRLVLNAKVEEVVTVTEGKRLYFSTNGHRDSVTVDEILVGAGRSPNVEGLNLEAVGVKYDKRRGVEVNDYLQTTNPKIYAAGDICMDWKFTHAADAAARIVIKNTLFSPFGLGRSRLSSLVMPWVTYTDPEVAHVGLYESQDVETIKIPFSSVDRAIADGQEDGFLKIHHKKGSDEIVGATIVASHAGEMISEVTTAIVNKIGLNKLSNVIHPYPTQAEAIKKAADTYRRTLLTPRTKKLLGFLTKFS

SEQ ID NO: 7192 - protein, 156 aa, Magnetococcus sp. MC-1
MGDIIELEGHLTVDGKKFCLLLSRFNSFITERLLEGAIDCIVRHGGKREDITVARVPGAFELPLVAQKAAKSGKYDGIVCLGAVIRGSTPHFDYVSSEVTKGVASISLAYDMPIGFGVLTTDTVEQAIDRAGTKAGNKGWEATISVIEMINLLDGM

SEQ ID NO: 7193 - protein, 408 aa, Magnetococcus sp. MC-1
MSDFNSITEILEDFRQGKMVILVDDENRENEGDLIVAAEFCDAPAVNFMTKHGRGLICLSLTQARVEKLQLPLMVVDNDAKFKTAFTVSIEAKVGVTTGISAQDRARTIEAAIADTSGPEDISRPGHVFPLVAKDGGVLVRAGHTEASVDLARLSGLKPAAVICEILKDDGTMARVPDLIPLAKQMGIKLGTIADLIAYRRQTEQLVHRAVETRLPSAYGGEWKLVAYTNDVDQHQHVALVKGNVDDGSPVLVRVHSECLTGDMFGSLRCDCGPQLQAAMEQIGQEGRGVIVYLRQEGRGIGLINKMHAYNLQDEGQDTVEANEALGFSADLRDYGIGAQILKDLGVTHMKLMTNNPKKIVGLTGYGLDVVDRVPLEIKSGMTNERYLRAKKHKLGHMLRQFPESNES

SEQ ID NO: 7194 - protein, 330 aa, Physcomitrella patens subsp. patens
MTAFLGTEGSNVGVDLVVLMTHLQTACKHISSILASPTELQATLKGADSVHGVGRDARKPLDLVSNNIIKAALRSSGKVAAIASEKDDRPVWLGGGPYVVVFDPLDGSRNLDATVPTGTIFGIYRRLPEADHLPTDEKAFANVMQRGERLVAAGYVLYSSSTIMAISVGSGLHGFTLDYTIGEFAYSHHDIRIPERGQIYSVNEAKYFAWPVGLRRYIDNVRQGKGQTRKQYSARFIGSFVADLHRTIMYGGIAMNPRSHSRLLYEANPLSYLVEQAGGRGTDGKRRILEINPIEIHQKLPLFLGSAADVAELVSFGDIQQQTSPEVHTF

SEQ ID NO: 7195 - protein, 78 aa, Wigglesworthia glossinidia endosymbiont of Glossina brevipalpis
MSTIEESVKSIIAEQLGVKKEEVTNNASFVDDLGADSLDTVELVMALEEEFDTEIPDEEAEKITTVQAAIDFIKESKK

SEQ ID NO: 7196 - protein, 381 aa, Anabaena variabilis ATCC 29413
MTQIISINDNQRLQLEPLEVPSRLLLGPGPSNAHPAVLQAMNVSPVGHLDPAFLALMDEIQSLLRYVWQTENPLTIAVSGTGTAAMEATIANAVEPGDVVLIGVAGYFGNRLVDMAGRYGADVRTISKPWGQVFSLEELRTALENNRPAILALVHAETSTGARQPLEGVGELCREFGTLLLVDTVTSLGGVPIFLDGWGVDLAYSCSQKGLGCSPGASPFTMSSRAIEKLQRRRTKVANWYLDMNLLGKYWGSERVYHHTAPINLYYALREALRLIAQEGLANCWQRHQKNVEYLWERLEDIGLSLHVEKEYRLPTLTTVRIPDGVDGKAVARQLLNEHNIEVGGGLGELAGKVWRVGLMGFNSRKESVDQLIPALEQVLR

SEQ ID NO: 7197 - protein, 338 aa, Pseudomonas syringae pv. syringae B728a
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMADVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 7198 - protein, 330 aa, Zea mays
MATLQHQNQGAAAPMTTTGGGLRAMDLYEKLEKVGEGTYGKVYKAREKATGRIVALKKTRLPEDDEGVPPTALREVSLLRMLSQDPHVVRLLDLKQGQNKEGQTILYLVFEYMDTDLKKFIRGHRQNHEKIPAHTVKILMYQLCKGVAFCHGRGVLHRDLKPHNLLMDRKTMALKIADLIADLGLSRAITVPVKKYTHEILTLWYRAPEILLGATHYSTPVDIWSVGCIFAELVTNQPLFPGDSELQQLLHIFKLLGTPNEQVWPGVGKLPNWHVYPQWKPTKLSTLVPGLDSDGYDLLEKMLAYEPGKRVSAKKALEHPYFNDVNKEVY

SEQ ID NO: 7199 - protein, 357 aa, Schizosaccharomyces pombe 972h-
MSDTTSLNVPELESPPIERVELESLLVMNIIKHCRDSFPNMGTIGQLVGIDIDGVLQVSSSFESPSVLENEESAVNKSVSGKARQAHTEAMLNRLQYIGAVTGHVGWYLGAYVSSFLSSPFFVETQYAYQKANPNSIAFLYDLSQSSNGTLYMRAYQLTPEFMAAHEEKTWTASSLNSHNLTPSNVIRELPIVIHNSHLATCLLHSLSEPPTPASTLTAEAALEDCESNLPLTETFSNFEVSLGTRYRKNIELLLESTDEFHYEQGNLGFHQRQLAREQAKIQQWIAKRKAENANRAAENLQPLPLDDWKRIFKLPAEPRLLDSLLISSQIMKSTQIDEQSSAFLSKLAGVRNAYAS

SEQ ID NO: 7200 - protein, 371 aa, Tropheryma whipplei TW08/27
MIEKKLYSAMEKVYDPELHIPITRLGMVKTITTDSKTVSILIHITSPTCPAVDKIKQRVTDAASAVCPEHDIKIEIGVMSHQERQNLKEVLNLQKRSNPFKESKTRIIAVTSGKGGVGKSTIVSNLGVGLARMGFSVSVIDADVYGFSIPRMFGIDEDFIPQRENGMIMPANKFGVKLISIGMFMRRRGAVAWRGPLLHRTINQFLCDVNFADPDILLIDMPPGTGDAAITIAQLLPNSEVLVITTPQIVAADVAIRSGQFALSVKQNIIGVVENMSSCPESKLDIFGHGGGKFVAEFLDKQCKKESTAKDNRITNPHEAIDLITCIPLDVNIRKSGDEGVPLLVENKYEGSPGHTALKELYEKIALKLYG

SEQ ID NO: 7201 - protein, 93 aa, Brassica rapa subsp. pekinensis
MAAAHGLVVQKTEEEWRAILSPEQFRILRQKGTEIPGTGEYDKFFEDGIFSCVGCKTPLYKSSTKFDSGCGWPAFFEGLPGAINRTPDPDGIS

SEQ ID NO: 7202 - protein, 165 aa, Triticum aestivum
  misc_feature (34)..(34): Xaa can be any naturally occurring amino acid
  misc_feature (99)..(99): Xaa can be any naturally occurring amino acid
YTDSSLQASQIMKNHLIMSSVQDLLNSRDGKQPXQHELIVYSIGGTTDSTKSEAHLLLDLSYVLDKCGFKYAVVYSSHSYGLREHHLALALCMYLAERXRNTSDPVLERQHGEWQFKSDVLEGVSSGSLRSLMLTTKRTCEKRIRRPSTSETTPNKSGSEMKQRR

SEQ ID NO: 7203 - protein, 359 aa, Streptococcus suis 89/1591
MSKRRLILENGTIFEGEAFGADIDVTGELVFSTGMTGYQESITDQSYNGQILTFTYPLVGNYGINRDDFESIKPTCKGVVVSEWARRASNWRNQMTLDEFLKAKKIPAISGIDTRALTKIIRQHGTMKATLANVGDSVEHLTDQLRATVLPTNNIQQVSTKTAYPAPGVGRSVVLVDFGLKHSILRELAKRDCNVTVVPYDTTAEEILALNPDGVMLSNGPGNPDDVPEALDMIRGILGKIPIFGICMGHQLFAKANGATTYKMKFGHRGFNHAVREIATGRVDFTSQNHGYAVAREDLPECLMITHEEINDKSVEGVRHKYYPGFSVQFHPDAAPGPHDASYLFDEFMELMDSFKKGQ

SEQ ID NO: 7204 - protein, 469 aa, Schizosaccharomyces pombe 972h-
MDKNDYLHFERNPSLFPKSTLDKVQKTKKYIEHYYKVAVDHAVERNQRRINLEQRLATERGSEERKNRQLRASGEKESQFLRFRRTRLSLEDFSTIKVIGKGAFGEVRLVQKLDTGKIYAMKSLLKTEMFKRDQLAHVKAERDLLVESDSPWVVSLYYAFQDSLYLYLIMEFLPGGDLMTMLINYDTFSEDVTRFYMAECVLAIADVHRMGYIHRDIKPDNILIDRDGHIKLSDFGLSTGFYKQDQSASYMKPRTGNTVKRGQMVDAIWLTMSSKDKMATWKKNRRVMAYSTVGTPDYIAPEIFLQQGYGQDCDWWSLGAIMFECLIGWPPFCSENSHETYRKIINWRETLTFPNDIHLSIEARDLMDRLMTDSEHRLGRGGAIEIMQHPFFTGIDWDHIRETAAPFIPNLKSITDTHYFPVDELEQVPEQPVTQQPASVDPQTLEQTNLAFLGYTYKKFNYLTMKGAL

SEQ ID NO: 7205 - protein, 625 aa, Rhizobium leguminosarum bv. viciae 3841
MSDTERQSKDAASTGTGYRVLARKYRPKDFTDLMVGQEPMVRTLTNAFETGRIAQAYMLTGVRGVGKTTTARILARALNYKTSEIDKPTIDLRAPGEHCQAIMEGRHVDVIEMDAASHTGIDDIREIIEQVRYRPVSARYKVYIIDEVHMLSTQAFNGLLKTLEEPPEHVKFIFATTEIRKVPITVLSRCQRFDLRRISASDLVGLFTTIAAKEGIEAEPDALAMIARAAEGSARDGLSLLDQAIAHGAGVVQAEAVRGMLGLADRARIVDLFQHIVKGDVAAALGEFQNQYEAGANPVVVLTDLADFTHLVTRLKYVPDAANDPSLSEVERTKAAEFAKCVAVTTLSRIWQMLLKGIPETEGSSRTAGAAEMVLIRLAHAAHLPAPEDAARRLAEFSGDNTGPRPSSSPSGNGGGSGTRVPYQSSVAARAAETAPSQPPSSAPVAMLRAVPSSQSETMAVGRIEPKPAEAPKPLVPVNSVNDIVNLATEKRDPKLKAMVRTFLRPVRIEAGRLDVSLAPGAPTTLLNELAVKLKEWTGIHWIVSLSRDEGQPTLVEAEARTREQHVIDARQDPDVAAILAHFPGAKIIDVRVRAPEPEEEGEATPPAAAESEEGDILPGDDIEF

SEQ ID NO: 7206 - protein, 275 aa, Xylella fastidiosa Temecula1
MQKPAVNIMVKAARSAGNVLLRHINKLETLHVIQKSRMDYASDVDEMAEKVIVKELKRAYPDYGILGEEGGLQGNHRIMWVIDPLDGTSNYLRGFPHYCVSIALVENGEPTDAVIFDPLRNELFTASRGAGAVLNERKIRVANRKDLNGTMLNTGFSPRERSRAHAQLKCVDALLMQAEDIRRSGSAALDLAYVACGRADAYFEAGIKVWDVAAGMLLVREAGGYVCDFKGADAPRMDDKGPESCQLIAGNIKVAHALQQVIVSSGYGREFDPKR

SEQ ID NO: 7207 - protein, 389 aa, Methanococcus maripaludis S2
MDTYFLFFIILTSIFIVPQILKRFNVPTITATMLAGILIGPFGLNIIQSSATLDTFAAFGVIFLMFLAGLEVDNETLKDEFKNSLVLSLFSMLIPSIGGYLIGQYFGLDFIGSLLYAVIFSSHSVGIVYALMDELGLIKSRFGTTVISASVVIDLISLIVISILIKMGGSGITSDIIPFVVLIAAYIIALLIIIPLISKLILKELKKFHVQKIHFILLIILISIIVGEHIGIHPIIGAFIIGIAVSEELTKEEHDQILNENLNAIGYGIFIPLFFLNLGMTTDISVIFNFDNISLILVSVVTLIGLKISSGYFSLRILDYGKLKSFCGGLLTVPSLTASLVGATLGRDLGILPEKFFVSVVVIALLTSTVAPIYVKSLVSKNYDKLKLN

SEQ ID NO: 7208 - protein, 142 aa, marine gamma proteobacterium HTCC2143
MAIERTFSIVKPDAVAKNVIGKIYSRFEEAGLCLVASKMLQLSRGQAEGFYAEHKGRPFFPALIEFMTSGPVMVQVLEGESAISKNRELMGATNPKEAEAGTIRADFADSIDANAVHGSDSAESAAREIAYFFSTCDLCGRA

SEQ ID NO: 7209 - protein, 322 aa, Arabidopsis thaliana
MLRLSNAAVITTNAILALIGLAALSFSVYVYVQGPSQCQRFVQNPLIVTAALLFFISSLGLIAALYGSHIIITLYLFFLFLSILLLLVLSVFIFLVTNPTAGKALSGRGIGNVKTGDYQNWIGNHFLRGKNWEGITKCLSDSRVCKRFGPRDIDFDSKHLSNVQFGCCRPPVECGFESKNATWWTVPATATTAIIGDCKAWSNTQRQLCYACESCKIGVLKGIRKRWRILIVVNLLLILLVVFLYSCGCCVRKNNRVPWKRRREETLRANTLLEDTLSSNTIQTILVANVVVGALPSIVYFGLSHYFTNSRSLFRCFSYPQT

SEQ ID NO: 7210 - protein, 130 aa, Populus trichocarpa
MALSVVSGSITTTSQWALKSQKLRRETQLPSWLNRSTISKHNKQVLNVTRVVKASCLFNPSNEPILKDALKEPVAFMGGMFAGLLRLDLNEDPLKEWVTRTVEASGITEEDIDAEGSQPEERVPLEIEIE

SEQ ID NO: 7211 - protein, 632 aa, Rhodobacter sphaeroides 2.4.1
MRGTSLTFWDHFLPKIVTVFREGYGLRDLRADALAGLTVAIVALPLSTAIAIASGVGPERGLYTAIVGGFLVSALGGSRFQIGGPAGAFIVLVAACVMQTGIEGLILATFLSGFLLIAVGTLKLGSYIRFIPYPVTVGFTAGIAVIIAASQMKELLGLTLAGPEPSALVEKVAALWAARETITPAALGVAVGTIAMIEGLKRLSPRLPSLLIAIVLASVAVLVLKLPVETIGTRFGELPKMLPTPALPALDREAILAALPWAVSFTLLGAIESLLSAVVADGMAGTQHRPNAELIAQGWANVGSALFGGFCVTGTIARTATNVRAGSRGPVSGMLHALFVLGFMLVAAPLAAYIPLAALAGLLAVVAWNMFEKEEFWALLRTSRGDAMVVLATFLLVVFRDLTEGIVVGFALGGLVFIRRMSDAASAEPAQVPEAGGAVTAERVVYRLRGPYFFGAAAMLGSALDRFAERPRAFVLDFTEVPFIDSSGARSFELLAHKMHRGGRAALPDRGQSRGAPRAPRAGPARAAGALCARHCGRRRDPFRELTESQSRGGPRRQRHSAAGRSRVEGAAAPVPRALLVRAPAPASFARGQNVEKQAQMALSVFMIYSFSTNPVKKVTEKSWWQKELREN

SEQ ID NO: 7212 - protein, 163 aa, Glycine max
  misc_feature (28)..(28): Xaa can be any naturally occurring amino acid
LVINLNSPPRQCIFSSPARPQPLYQNPXTLFRVYYGTQSSASKLPEYEMPSVTWGVIQGRKEKLVSRVIIFDYLKGLGIIPDELHDLELPSTVDVMRERVEFLQKLGLTVDDINNYPLMLGCSVRKNMIPVLGYLEKIGIARPKLGGFVKNYPQVLHASVIVE

SEQ ID NO: 7213 - protein, 295 aa, Zea mays
MAMATAKLSSPATSLLAGGRARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLVPLPGSNNESWCQGLDGLASRCAEYYKQGARFAKWRTVVSIPCGPSALAAKEAAWGLARYAAIAQDNGLVPIVEPEILLDGDHGIERTLEVAEKVWSEVFFYLAQNNVLFEGILLKPSMVTPGADHKEKASPEAIAKYTLTMLRSRVASTSDCPPERNMIP

SEQ ID NO: 7214 - protein, 284 aa, Rhizobium leguminosarum bv. viciae 3841
MNIKTNRIAFQGEFGANSDMASRDMFPTMEPLPCQTFEDAFTAVDNGDADIGMIPIENTIAGRVADIHHLLPESRLHIIGEYFMPIRFQLMVLPGVTKDEIRTVHSHIHALGQCRKIVRANGWKPVIAGDTAGAAKLVQETGDRSMAALAPRLAADLYGLEIIAENVEDTENNVTRFVVLSRDEEWAQRNSAEEKVVTTFVFNVRNIPAALYKALGGFATNNINMTKLESYQLGGKFVATQFYADIEGHPNDPNVRRALEELRFFSEKVRILGVYKGHAMRGLL

SEQ ID NO: 7215 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGLPAFHGGAFRWLDTLGSAKYLDMAQQYQHLGPLYEVPEGLRNKARHNEPYYPPVEPARPVGDLKTA

SEQ ID NO: 7216 - protein, 413 aa, marine gamma proteobacterium HTCC2143
MSIAAVEMKKFDISGIRAQFPILSRQVDGKPLVYLDNAATTQKPQCVIDAIVDYYSTCNSNVHRGAHQLADEATRRYEDARDAVAEFINANAREEVIWTSGTTESINIVANGLAELLSVGDEVLVTEMEHHANLVTWQQACKSSGATLKIAPIDDSGDVVMDEYDALLNERTRLVAFPQVSNALGTVNPVEDMCKRARAVGAWVLIDGAQGIAHEPVDVQSLDCDFYVFSGHKLFGPTGIGVLWGRKQVLASWPVWQVGGEMISEVSYLDAVWNELPYRFEAGTPNIAGAVGLGAAVRWFSGLDFHLVRMHEAALLESATRQARDFDGLTIVGNAKRKVGVLSLIMDTGHPADIGFLLDRQGIAIRTGYHCAEPLMGRLGLPGTARASFSLYNTLEEVDVFFKALQKVKTMLT

SEQ ID NO: 7217 - protein, 244 aa, Hyacinthus orientalis
MSPDSSRSPPRTRRFRSERDRPSHRVTPYRRDPREHRGFRQDVICKNCKRPGHFARDCSHIAVCNNCGLPGHIAAECTAKTLCWNCKEPGHMANECSNEAVCHNCNKTGHLARDCSASGLSSFDTRLCNNCHRPGHIAADCTNDKTCNNCRKPGHLARECTNDPVCNVCNVSGHVARQCPKSNLPSEIHGGPFRDIICRVCNQPGHISRDCVGIVICNTCGGRGHMAYECPSGRLLDRGMFRRF

SEQ ID NO: 7218 - protein, 476 aa, Methanococcus maripaludis S2
MLFIAFAPFGAFALEANSKNDGYSLDDIKYYKIFENEDIPKIMYALRQGDFEIIAELKNEWEIEEEDVSFEYTTSKNPLGELIRDNLYELGQKYEVFEDESDFVSKMNVWATAFTKSMMKKSSEQKDKLIVQTVNALDNLDETLNLFSERLREWYSLYFPEMDNIVKKHDIYVSLVSEYGDREEYTRTKLKKTMPSNVARTISLAAKESMGADVSEFDLKIMKNLADEIKSMYEYRESLQEYLETSMNEIAPNLTKVAGASLGARLISLAGGIERLLRLPASTIQVIGAEKALFAHLRERALPPKHGVIFQHPLIQGSPWWIHGKIARAISCKISIAIRADAFGNDISDMLIEDMNKKVAEIKEKFPEPTRKRRPRPDTRSFGNKGGQDRDRRSQGDRKPSGNRGDSKKGGKPFGKKPAGKDDRRDNRKGDRKPFGGKPKNSGNQPPKERSGEKRRDSTKKVKAERKVIGKTSSQN

SEQ ID NO: 7219 - protein, 337 aa, Triticum aestivum
MGKIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 7220 - protein, 113 aa, Triticum aestivum
  misc_feature (79)..(79): Xaa can be any naturally occurring amino acid
  misc_feature (89)..(89): Xaa can be any naturally occurring amino acid
  misc_feature (100)..(100): Xaa can be any naturally occurring amino acid
  misc_feature (108)..(108): Xaa can be any naturally occurring amino acid
AKYWQQRYSLKEGIPSFLTNVAATILTTGKYLNVMRECGHNVQVSLSDNSKLMSFGSNHQYLECIKSAYDFASGELLTXWMKDKYDLIXGKLRSLKRYLXLDQGDFLXHFMGY

SEQ ID NO: 7221 - protein, 279 aa, Photobacterium sp. SKA34
MSIKIKTAEEIEKMRVAGRLAAEVLEMIEPHVKAGVTTEELDRICHDYITKDQQAIPAPLNYHGFPKSVCTSINHVVCHGIPAQADEEVPEANGKYIKPAVLKDGDIINIDVTVIKDGYHGDTSKMFEVGEVSLEDKRLCRVAQESLYLAIKKVKPGARVGDIGTAIQKFIKSGNSRFSIVKDYCGHGIGNEFHEEPQIVHYKNNDRTVLKEGMCFTIEPMINAGKFGCESDDQDGWTVYTVDGKKSAQWEHTLLVTKDGCEILTLRPEETLQRLMHNA

SEQ ID NO: 7222 - protein, 80 aa, Clarkia unguiculata
KGEVVNNHDELMSNFFAQPDALAYGKTPEQLKKENVSEHLIPHKTFTGNRPSLSILLPTLDAYRIGQLLAIYEHRVAVQG

SEQ ID NO: 7223 - protein, 290 aa, Yarrowia lipolytica CLIB122
MTTTEEIAFLGPLYTYSHAAAKQYQDTLAVPTTLRPAKSIEECFQLLDSGEVKLAVVPFENSTNGSVVWTLDFLRQRLLGDDYFYSATAELLVPVSHCFFSNVSDKKDITKIYSHPQVWGQCVEFLKQYPNVERIDVASTAKAAELAANEPNAGAISSEMAGAAAGIKLVETNIADKKNNTTRFLGLSSLDDVQNPPPTKDDLSLISFTTTHNNPGALCAVLEEFRKHDIDLSSINSRPSLQDSWHYIFFVECRAHVSEERMKNTLKAMESICSSLTVIGSFPRCPGRDA

SEQ ID NO: 7224 - protein, 368 aa, Magnetococcus sp. MC-1
MSHDPIDLNPSTLVELRDGIDAIDDRIHDLLMKRAELVMRVGELKGKGPAGTPFYRPEREAQIHRRLEGRHGGPLPVEAVHRIFREIISASLNLEKQLSVAYLGPEATFTHEAALKQFGSAFTMFSTRTITEVFHEVEIGRANFGVVPVENSLEGVVIHTLDRFVRSPLNICGEVLMPVELNLLARGGVLGEVRVIYGHFSALDQCAQWLSHYLPQVKRVEVASTAEAAERARREEGAGAICGPFAANRYGLVVIAEHIEDQARLENRFLVVGRESPAPSGADKTSIMVSFLDDPGFLHRILGVFAERGINLSRIESRPTQERAWDYLFFIDMEGHRQDEGVSAALEALGALSGVSVKILGSYPQHAL

SEQ ID NO: 7225 - protein, 181 aa, Glycine max
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 7226 - protein, 281 aa, Rhizobium leguminosarum bv. viciae 3841
MSSSASLLFRFGIIADPQYAAIAPHIAMDRYYANSLAKVAAAIEVFNGEELSFVMTLGDVIDRSFSSFDDILPVYEKLRHEALFLLGNHDFSVSSGHLSDVAARLGMSSPYYSFLRHGWRFIVLDGNEVSIFAPPEGHHHRALAAEMLAELQAKGARNAHRWNAALSDEQFAWLGDEIAKAAEAGEKVIVMNHYPVHPPGEHGMWDSERIVALLASSSNVVAYLNGHDHVGNYGMAGSCHFVNFKGVVDTETQNAFAIVEVHADRIEIRGFGREDSRTLSI

SEQ ID NO: 7227 - protein, 358 aa, Camellia sinensis
MERYELVKDIGSGNFGVARLMRNKETKELVAMKYIERGQKIDENVAREIINHRSLRHPNIIRFKEVVLTPTHLAIVMEYAAGGELFERICNAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTIHRIMAVNYKIPDYVHISQDCRHLLSRIFVANSARRITIKEIKNHPWFLKNLPRELTEAAQAMYYRRENPSFSPQTVEEIMKIVEEARTPPPVSRSIGGFGWGGEEDEGKEEEEDEEAEEEEDEEDEYDKTVKEAHASGVHLPRDD

SEQ ID NO: 7228 - protein, 320 aa, Schizosaccharomyces pombe 972h-
MSEKQTIKALPAHNPTQVKKLGPVSGFLSGGLAACGAVTLTNPFEVIKTRFQLQGQLTKLDPSKRIYKSVGQAFSLIARHEGIRGLQRGLGTAYVYQICLNGCRLGFYEPIRRTLNTWFLDDPKGNKLAINVASGAGSGLCGALFGSPFFLVKTRMQSYSPKFPVGQQYGYKHIFNAFSRIIKENGVKGLFVGADAAILRTVSGSSVQLPIYNWAKRMIEHYNLLEEGMIKHLTASAVSGFGVCCTMQIFDTVMTRMYNQKNKELYKNPIDCILKTIRSEGFFALYKGFGAHLARIAPHTIFCLTFVEQTNKLFLKFQKD

SEQ ID NO: 7229 - protein, 332 aa, Wigglesworthia glossinidia endosymbiont of Glossina brevipalpis
MTLNIALNGFGRIGRMIFRIAQTRNNFNIVAINDLCSINEISYMLRFDSTHGKFLKKIYIKENFIQIEDKKIYCFSEKDPSNLPWKKLNIDIVIEATGLSLTKKASENHIISGAKKVIITAPPKDNIPMFVMGVNNNLYNGEKIISNASCTTNCLAPIAKVLNDYFGIQEALMTTVHSVTSTQNTVDGRSLQAFRIGRSCLNNIIPTSTGAADSVGKIIPDLNGKITGTSFRVPTTNVSVVDLTVKFKKETSYKEVCNAIKYESKNKFNGILGYTEDNVVSSDFNGEFLTSVFDSKAGIELNKTFMKIISWYDNESGYSSKVLDLAQYIFNK

SEQ ID NO: 7230 - protein, 493 aa, Schizosaccharomyces pombe 972h-
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 7231 - protein, 582 aa, Triticum aestivum
RPVHSKESSVTPSAVTLLEGGKRKRGRPKRVPDSSVTPSSHSGLSVDVDSGDTSKRGRPKKIDTSLLHLPSLFSDDPRESADNVLMMFDALRRRLMQLDEVKQVAKQQQNLKAGSIMMNAELRLNKNKRIGEVPGVEVGDMFYFRIEMCLVGLNSQSMAGIDYMSAKFGNEEDPVAISIVSAGVYEDAEDDDPDVLVYSGHGMSGKDDQKLERGNLRHEALERSLHRGNPIRVVRTVKDLTCSTGKIYIYDGLYQIREAWVEKGKSGFNMFKHKLLREPGQPDGIAVWKKTEKWRENPSSRDRVILHDISYGVESKPICLVNEVDDEKGPSHFTYTTKLNYMNSPSSMRKMQGCKCTSVCLPGDNNCSCTHRNAGDLPYSASGILVSRMPMLYECNDSCTCLHNCRNRVVQKGIQIHFEVFKTGDRGWGLRSWDPIRAGTFICEYAGVIVDKNALDAEDDYIFETPPSEQNLRWNYAPELLGEPSLSDLNESSKQLPIIISAKHTGNIARFMNHSCSPNVFWQPVLYDHGDEGYPHIAFFAIKHIPPMTELTYDYGQSQGNSGCRRTKSCLCWSRKCRGSFG

SEQ ID NO: 7232 - protein, 330 aa, Rhizobium leguminosarum bv. viciae 3841
MTRFDVLTVGNAIVDIIARCDDQFLIDNQITKAAMNLIDAERAELLYSRMGPALEASGGSAGNTAAGVASLGGKAAYFGNVAQDQLGDIFAHDIRAQGVHYQTRPKGTFPPTARSMIFVTEDGERSMNTYLGACVELGPEDVETDVVADAKVTYFEGYLWDPPRAKEAILDCARIAHENGREMSMTLSDSFCVDRYRGEFLDLMRSGKVDIVFANRQEALSLYETDDFEEALNRIAADCKIAAVTMSEDGAVILKGRERFYVDAIRIREVVDTTGAGDLFASGFLYGYTQGRSLEDCGKLGCLAAGIVIQQIGPRPMTSLSEAAKRAGLI

SEQ ID NO: 7233 - protein, 79 aa, Xylella fastidiosa Temecula1
MSDIEARVRKIVAEKLNVDEEKVTNTSTFVDELGADSLDTVELVMALEDEFQCEIGDEAAEKMTSVQHAIDYIKSNAKC

SEQ ID NO: 7234 - protein, 347 aa, Sulfolobus solfataricus
MRAVRLVEIGKPLSLQEIGVPKPKGPQVLIKVEAAGVCHSDVHMRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYMYKLRRLNAVEAAPLTCSGITTYRAVRKASLDPTKTLLVVGAGGGLGTMAVQIAKAVSGATIIGVDVREEAVEAAKRAGADYVINASMQDPLAEIRRITESKGVDAVIDLNYSEKTLSVYPKALAKQGKYVMVGLFGADLHYHAPLITLSEIQFVGSLVGNQSDFLGIMRLAEAGKVKPMITKTMKLEEANEAIDNLENFKAIGRQVLIP

SEQ ID NO: 7235 - protein, 186 aa, Brassica napus
  misc_feature (157)..(157): Xaa can be any naturally occurring amino acid
DLDQSDLVVFTQGMDQYGLPVQRREMKHKGRNVVWSVGMDKCLIEALAFQAQNGNKVDRCFNENAYSAACLAVNTRFNLNLNSQKVINRLKTIKKRYRVMKDILSRDGFWWNATTKMIDCETDDLWKRYIAVHPDAKAFKGKQIEMYEELRTVCGDXHQAPGRYAKVKAESNHHLNDFKHFGRRIG

SEQ ID NO: 7236 - protein, 190 aa, Crocosphaera watsonii WH 8501
MAVIETVPSVVFKTRVRDESVPGPNPFRWQDVTTEEIFKGKKVIVFSLPGAFTPTCSSNHLPRYEELYEEFKGLGVDQIICVSVNDAFVMFQWGKQQEAKNVSLLPDGNGEFTRKMGMLVEKSNLGFGMRSWRYSMLVNDCKVEKMFVEPDFSDNCPTDPFEVSDADTMLAYLKGTESAGVSEPRKAFVG

SEQ ID NO: 7237 - protein, 317 aa, Populus trichocarpa
MANAWKRENNKQPKLLSPILLILSLSLLLLLFLFFFSARSPSNPPNSTLFVTQVYPIPSFNCLESPQAHPVIANIVENLKYPFLYSLSDFGSLPDKPHKNIVRLLKGKPFRKPDISATIQQLLEGMKGRNGLVVDVGANVGMASFAAAVMGFKVLAFEPVIDNLKRICDGIWFNRVADLVTVFEAAVSDRIGNITFYKLVGRLDNSAVSANGAKLAFKSNEEIAFQVRTIPLDELIPNSEPVLLLKIDVQGWEYHVLKGAVKLLSRKKDAAPYLIYEEDERLLQASNSSAKEIRDFLHGVGYSHCVQHGTDAHCTKG

SEQ ID NO: 7238 - protein, 401 aa, Arabidopsis thaliana
MPEFVPEDLSGEEETVTECKDSLTKLLSLPYKSFSEKLHRYALSIKDKVVWETWERSGKRVRDYNLYTGVLGTAYLLFKSYQVTRNEDDLKLCLENVEACDVASRDSERVTFICGYAGVCALGAVAAKCLGDDQLYDRYLARFRGIRLPSDLPYELLYGRAGYLWACLFLNKHIGQESISSERMRSVVEEIFRAGRQLGNKGTCPLMYEWHGKRYWGAAHGLAGIMNVLMHTELEPDEIKDVKGTLSYMIQNRFPSGNYLSSEGSKSDRLVHWCHGAPGVALTLVKAAQVYNTKEFVEAAMEAGEVVWSRGLLKRVGICHGISGNTYVFLSLYRLTRNPKYLYRAKAFASFLLDKSEKLISEGQMHGGDRPFSLFEGIGGMAYMLLDMNDPTQALFPGYEL

SEQ ID NO: 7239 - protein, 705 aa, Aspergillus oryzae
MQSDDRSVREGSDSSQTFLMKMAQPTGELTHPSQQQQLQLQQQSFQSIFGGASDTTEEIDTETDSNHRRPHSFGAAATTPAKLANKNVAPFLVKHIPEQYGPLGSRRTDKLEDLSSPNSKFCYRHRPDLKCRRQADEPSMDKLQRELETLPPSDQQGIAHVWSLFSAAPAKHRKLILQGIMAQCCFPQLSFVSATVRDLIRIDFLTALPPEISFKILCYLDTTSLCKAAQVSSRWRALADDDVVWHRMCEQHIHRKCKKCGWGLPLLERKRLRESKREIELRATTWDVSGPAQNAGGAECSAPHADDVITQKRKADSSDDETAIVKRHCSSLDARPEPDEDYYTTRYRPWKEVYKDRFKVGTNWKYGRCSTKVFKGHTNGVMCLQFEDNILATGSYDATIKIWDTETGEELRTLRGHQSGIRCLQFDDTKLISGSMDRSLKVWNWRTGECISTYTGHRGGVIGLHFDATILASASVDKTVKIWNFEDKSTFLLRGHTDWVNAVRVDTTSRTVFSASDDCTVRLWDLDTKACLRTFHGHVGQVQQVVPLPREFEFEDHDAECDNDNMSTTSGDTESNSLQATLGLESNATETSVFGPSFDNGRPAPPRYIVTSALDSTIRLWETTTGRCLRTFFGHLEGVWALGADTLRIVSGAEDRMVKIWDPRTGKCERTFTGHSGPVTCIGLGDSRFATGSEDCEVRMYSFRN

SEQ ID NO: 7240 - protein, 758 aa, Saccharomyces cerevisiae YJM789
MIIRAPIRTKTKSFRGDQMDFKFPSNESLPRGTLEEYHLNNHHLLNDVFAAENGVSRDEDGNSQILSDYTSTSNTNTNSGYSSNGYYSFANISDNTTSSPRIVINQNETARLTSSDSNKSDFFASHDFPGNDSLHYSSSSVVKNQLHSMEAIPEGNITGSISTAFQTIPTADNVSYDIAPSSASSLLPRKSTSKSAILPSTQEAKPMTKLNMEKDIKTIELNNSVVPKPKKKLNRVPTIRRVESSRFSNSRYSSSVSSKSSSSRCSLKRSKAIRCKGGLLYYFTSLGIKIKKKLRKLRLVLRRRLFSYNVQKVPSATNSKTTKSKANINNKSKKRGTNLVNKNSNSTPRQKKSQRYVSNLQRSISSKSLVPVLAPQKKTKPLTVDTKFKANHPQSEDSKVGSNTPRSPLVSYTPSLRRTNSSIRRAASILTASATMTPANNKNSFISVPDNVSHAVTRNSSMYSRSRLVRSKPSTALNAIARQPSIVVENKVIPLSMNRYSIKEEDEYVIDTSSMRELSPVNSVCSSDYDRESSESYSNYADAMETTEVDNKDRVECNNEIQNVNANNEETSNEESYNLMKHYLSTVIAQRIMLRVQIARIQNNKSNVVYMNKSAETNSTIYEDLADSLLTEYEADGSSSQIFDGVSVRADEEEEEDEDDEDDEEEEEENDDEEDEEDEEDDEDDEEEEEKRKEGEGRNLAKEVDELAELSPMRKQSDLSITLRSPFAMLNSAYSNSIISLPTGVVKRSLTLPVGMKI

SEQ ID NO: 7241 - protein, 507 aa, Candida albicans
MRSYKSSITDENELTKQRLRAKSIANLSSNHATAGQTSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNDDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSRVDLKTSFQQCGTLHFIQSSQNH

SEQ ID NO: 7242 - protein, 653 aa, Debaryomyces hansenii CBS767
MVSMKIGYGLVTLMVLPFIYASTVDGNLDIAAGEPKVRDYRLELTHAYGNPDGIYKSNFLINGQSPGPIIEGDEGDWVNITVVNYLPVSITIHFHGILQKGTPWSDGVPGITQYPILSGDCYSYLFQLKDQYGFYWYHAHYRGYLTDGLYGPIYIKPNKARERPYDLIVKSKEELDLIESLEKSPSYIIADDSFKLPMDDIMARMFHYGIDPLCILSILLNGKGRIYCHEYSTFHRLGSKSKLDRVPQFDSMGCIRSEKTNGYHDFKLDNFGLESPGFSRRCESTSRDNYVYFTNHSSWQYVNILNAGGQYTKAFSIDDHEFYVIAVDGVFIRPKLVHQLLIPVGSRYTVLLETNSSKHKNSKDPFAMRFAAIKTPQYIEALGYLIYGDNSTLSSVELQNIQQRNNINNGIKFQDLDGKLTEDNYDLVWPHETGPLSKVDQLNASKTGDHTFELYLNRTGVVEFSMFKDGTKLPAGFELSKPLLHMDFSDEENTFASFNGSLTDNIQEGDIVDIIINNFRTIDHPIHMHGHLFHLISYSETENFPYATVEEAAKNNYTNLNFENPPMFDIAYTPAKGHSVIRITANNPGIWLIHCHNLGHLLGGMGAVLFESIASIPKIPPLYLKQVHVEYNMQSDLGITELKNNTHDGSLQS

SEQ ID NO: 7243 - protein, 297 aa, Mesorhizobium sp. BNC1
MITIIGSINLDLIARVERLPAPGETIPGSGFSTAPGGKGANQALAARRAGAQVRMIGAVGADSFADQALALLREAGVDLSRVKKPSPLTGVAMILVGADGENVIAVIPGANADVVEEDVEAAGLSRDEFVLLQHEIPLPTIEAALRNARAAGAVSLLNAAPFQPQAADFLGLADYLVVNETEFDLYAQSLGLEGSDREQRARAYTARTGRTIVVTLGGDGVMAAAPDRFLRLPAFPITPVDTVGAGDTFCGYLAAALSDGLVLEAALRRAAAAGALACLKPGAQPAIPFRSDVDSRL

SEQ ID NO: 7244 - protein, 821 aa, Saccharomyces cerevisiae YJM789
MENITQPTQQSTQATQRFLIEKFSQEQIGENIVCRVICTTGQIPIRDLSADISQVLKEKRSIKKVWTFGRNPACDYHLGNISRLSNKHFQILLGEDGNLLLNDISTNGTWLNGQKVEKNSNQLLSQGDEITVGVGVESDILSLVIFINDKFKQSLEQNKVDRIRSNLKNTSKIASPGLTSSTASSIVANKTGIFKDFSIIDEVVGQGAFATVKKAIERTTGKTFAVKIISKRKVIGNMDGVTRELEVLQKLNHPRIVRLKGFYEDTESYYMVMEFVSGGDLMDFVAAHGAVGEDAGREISRQILTAIKYIHSMGISHRDLKPDNILIEQDDPVLVKITDFGLAKVQGNGSFMKTFCGTLAYVAPEVIRGKDTSVSPDEYEERNEYSSLVDMWSMGCLVYVILTGHLPFSGSTQDQLYKQIGRGSYHEGPLKDFRISEEARDFIDSLLQVDPNNRSTAAKALNHPWIKMSPLGSQSYGDFSQISLSQSLSQQKLLENMDDAQYEFVKAQRKLQMEQQLQEQDQEDQDGKIQGFKIPAHAPIRYTQPKSIEAETREQKLLHSNNTENVKSSKKKGNGRFLTLQPLPDSIIQESLEIQQGVNPFFIGRSEDCNCKIEDNRLSRVHCFIFKKRHAVGKSMYESPAQGLDDIWYCHTGTNVSYLNNNRMIQGTKFLLQDGDEIKIIWDKNNKFVIGFKVEINDTTGLFNEGLGMLQEQRVVLKQTAEEKDLVKKLTQMMAAQRANQPSASSSSMSAKKPPVSDTNNNGNNSVLNDLVESPINANTGNILKRIHSVSLSQSQIDPSKKVKRAKLDQTSKGPENLQFS

SEQ ID NO: 7245 - protein, 608 aa, Ustilago maydis
MSQAAHLQQQQIAASQQQGLQAPNSGYMQRAPGASPINRSPSPSARPLNAAPRSPQPHGQAQTYSQQQQQQQQQQQQQQFYQQQQQQQQQQQQQQQQQYTQSGGSTSPNPANEKPADYVYFERSTNGMQKSTIEAATGAKLKLENFYKVYVEQAVERIKRAAELEDRLTNPPDGVHLSDERKARQLAQLGRRESNFLRLRRTRLGLDDFRTVKVIGKGAFGEVRLVQKTDTGKIYAMKTLRKSEMFKKDQLAHVRAERDVLAESNSPWVVQLYYSFQDTAYLYLLMEFLPGGDLMTMLIKYDTFSEDVTRFYMAECVLALEGIHKLGFIHRDIKPDNILIDAKGHIKLSDFGLSTGFHKQHDSAYYQRLFEGTAAQNPAQTGRNSVAVNSINLTLSSKDTIATWKANRRKLAYSTVGTPDYIAPEIFLQQGYGNECDWWSLGAIMFECLCGYPPFCSENAHDTYRKILAWRETLQFPDDIHLSPEAEDMIRRLISAPENRLGRNSASEIKGHAFFAGVDWATIRQIDAPFIPQLKSITDTSYFPTEDYQDVPETPAALMSGSEARTSPCSATRIAGTRATRLSSSGTPRAHFNLPFVCHRKCELNPSS

SEQ ID NO: 7246 - protein, 539 aa, Polaromonas sp. JS666
MKYTPMPIPSAMDFTNPYASARSAVLGRNVVSTSQPLAAQAGLRMLLAGGNAVDAAIATAMALTVVEPTGCGLGSDGFAIVWDGKELHGLNASGRSPAAWSADRFAGHGAMPDKGWEAVTVPGAVSAWSALSRRFGRLPFTALAAPAIDYARNGFAVSPVIAHLWALGGARLGEQPGFAECFLPDGRAPRAGELFRSEAHASTLEAIAESHGEAFYRGAVAQRIAAHARAHGAALTEDDLANHRADWCGTLAQPFAGSVVHELPPNGQGIAALMALGMMEALGIGNQPPDHVDTVHLSIEAMKLALADLHQYNADIDAMQIPPSALLAPAYLAERARLIDRHRAADPGHGAPKPGGTVYVATADASGMMVSFIQSNYMGFGSGVVVPGTGVSLQNRGHGFSLEQGHANQVGPAKRPSHTIIPAFAMHADGTPQMAFGVMGGPMQSQGHVQMALRVLHYGQNPQAAADAPRWRVTGGRKVAVEPNFDADVVRELAARGHEVTVERGNGVFAFGGAQLVYKRGDSYVAGSDPRKDGQAVAF

SEQ ID NO: 7247 - protein, 358 aa, Saccharomyces cerevisiae YJM789
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSPPRGHIHDGTDKDDECNFEGHVHTTWGDCCGIKLPSAIAATEMNKKHHKSIPFD

SEQ ID NO: 7248 - protein, 253 aa, Picea sitchensis
MKFNIANPTTGCQKKLEIDDDQKLRAFYDKRLSQEVNGDALGEEFKGYVFKIMGGCDKQGFPMKQGVLTPGRVRLLLHRGTPCFRGFGRRKGERRRKSVRGCIVSQDLSVLNLVIVKKGENDLPGLTDTEKPRMRGPKRASKIRKLFNLTKDDDVRKYVNTYRRTFVTKSGKKCSKAPKIQRLVTPLTLQRKRSRIAEKKQRVAKAKLEAAEYQKLLATRLKEQRDHRSESLAKKRDRATRLSSAASKPSSTA

SEQ ID NO: 7249 - protein, 122 aa, Candida membranifaciens
RENEGDLIISAELITQEKMAFLVRYSSGYVCVPLSSDRADALDLQPMLANKTDKHGTNYTITCDYGIGTTTGISAYDRSLTANKLADSTSTPDQFIKPGHILPLRAKPGLLKTRRGHTESAV

SEQ ID NO: 7250 - protein, 79 aa, Triticum aestivum
  misc_feature (48)..(49): Xaa can be any naturally occurring amino acid
  misc_feature (53)..(54): Xaa can be any naturally occurring amino acid
  misc_feature (58)..(60): Xaa can be any naturally occurring amino acid
  misc_feature (68)..(68): Xaa can be any naturally occurring amino acid
  misc_feature (73)..(73): Xaa can be any naturally occurring amino acid
  misc_feature (78)..(78): Xaa can be any naturally occurring amino acid
SSLWFHSRVNPWCAFSQVHKAQNVASKRGKLLTEDFLYLIRKDMRKLXXATEXXSMNXXXKQARKAFXVNEEXLVVTXE

SEQ ID NO: 7251 - protein, 202 aa, Vibrio campbellii AND4
MANIIFIDNFDSFTYNLVDQFRSLGHSVKIYRNNIPAETVEQAINELENPVILLSPGPGAPSAAGSMPELIQRMKGKVPMVGICLGHQAIVEAYGGTVAGAGEIIHGKVSMMEHQDHAIYQNLPSPLAIARYHSLVATKVPESLTITAEVDDLVMSVVHEEDKVCGFQFHPESIMTTYGATLLANAIEWALEEQTSANPLTA

SEQ ID NO: 7252 - protein, 493 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKVDLPEELIFHINYLGADQPTFTLNFSKGSSQVIAQYYQLIRLGFEGYKNIMENCQENATVLKQGLEKTGKFNIVSKDNGVPLVAFSLKDSSRHSEFEISDFLRRFGWIVPAYTMPPDAQPVTVLRVVIREDFSRTLAERLVLDIEKVLHELDALPARVPSGDLAALAAAESSEREMEKQRQVISLWKRAVLAKKKTNGVC

SEQ ID NO: 7253 - protein, 340 aa, Brucella suis 1330
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 7254 - protein, 182 aa, Solibacter usitatus Ellin6076
MPRWINLANLFTLARLVLVPFVVGAILDGRNVAALELFFAAALTDVIDGFLARNFGQGTPFGAYLDPIADKLLLSGIYLALGATGAVPWWLVALVLGRDIYILLAVIGIMALTKVRSFPPSRWGKISTFVQIATAICWMVQNIWQIALFHAIAATMVWVCAIFTLWSGVHYTLRGTQSLRTR

SEQ ID NO: 7255 - protein, 317 aa, Arabidopsis thaliana
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEEKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 7256 - protein, 446 aa, Wigglesworthia glossinidia endosymbiont of Glossina brevipalpis
MNKSLEEINNTVPIPDRKDSKLKKLIAFSGPGALVAVGYMDPGNWITSIQGGSLYGYLLLSVILLSSLIAMLLQSMCAKLGIVTGMDLAQSTKNLVGKKISFILWIISELAIIATEIAEVIGSAIALNLLMKIPLIIGVAITVLDVFLLLILLKYGIRTIEALVFVLISTIFCIFLYEVALANPNINSIIYSFIPSKDILTAHVEQGESAFFIALGIVGATVMPHNLYLHSSIVQSRRYNRKDKNALKEAIKYAKIDSNIQLSFSFFINCLILILGSALFFGKNPEDIGRFTQLYDALQDNSMVGTIASSSLATLFALALLFSGQNATITGTLTGQIVMEGFINLKLSIWKRRIITRLIAITPVIICVYFWDGKEDLVEKLLVYTQIFLSLSLPVSMVPLLYLTSSKKIMGKFVNCISASAVGWLSTGVLIILNSQLILETIKSSF

SEQ ID NO: 7257 - protein, 151 aa, Wigglesworthia glossinidia endosymbiont of Glossina brevipalpis
MKIKEKMTDFGFSYVKKSKKNSMIEDIFNNVSYKYDLMNDIMSFGVHRIWKNILVYCNSTNPDQKILDLASGTGDITKRLSKLINKKGFIVSLDINRKMLKICRKKIRNSGTIRNIFYIQANSEYLPFKKNIFDSVIVSFGFRNFTEKKKQ

SEQ ID NO: 7258 - protein, 259 aa, Erwinia carotovora subsp. atroseptica SCRI1043
MSSRKLTLGVSLKMYFGYQQTLDWCQKIHEIAEQHPLASLPSARLFVLPAFPTLAPVVQRFAQSPVHVGAQDLHWTDNGAFTGEVSGTMLHEMGCRYVEIGHAERRRYFGETDEHFALKTAAAWRNGLTPVLCVGEEQRGSTQQAIDTCQAQLAAALNLAQKQQLTGDLVLAYEPQWAIGSTEPAPTAYISEVCQALKQHLPTQAGVREGRIIYGGSAGPGLLSQLGDAVDGLFLGRFAHDPAAFNAIMDEAFTLSSQA

SEQ ID NO: 7259 - protein, 95 aa, Salmonella typhimurium
ITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 7260 - protein, 400 aa, Schizosaccharomyces pombe 972h-
MTVVDIKIGNKYRIGRKIGSGSFGQIYLGLNTVNGEQVAVKLEPLKARHHQLEYEFRVYNILKGNIGIPTIRWFGVTNSYNAMVMDLLGPSLEDLFCYCGRKFTLKTVLLLADQLISRIEYVHSKSFLHRDIKPDNFLMKKHSNVVTMIDFGLAKKYRDFKTHVHIPYRDNKNLTGTARYASINTHIGIEQSRRDDLESLGYVLLYFCRGSLPWQGLQADTKEQKYQRIRDTKIGTPLEVLCKGLPEEFITYMCYTRQLSFTEKPNYAYLRKLFRDLLIRKGYQYDYVFDWMILKYQKRAAAAAAASATAPPQVTSPMVSQTQPVNPITPNYSSIPLPAERNPKTPQSFSTNIVQCASPSPLPLSFRSPVPNKDYEYIPSSLQPQYSAQLRRVLDEEPAP

SEQ ID NO: 7261 - protein, 119 aa, Triticum aestivum
MVDLQAAALVISVVAAEVFMLTGSTSAIRFGFVLGFALLALGISSLRSQRAGGRQPRLLLKGQAAIASVIFFKDLSVFFRHGWFPNVFAVLLSGMVVTFYIHRIVTGGHKGSTESSSDN

SEQ ID NO: 7262 - protein, 424 aa, Schizosaccharomyces pombe 972h-
MLVLKIVLFLSLVIWFNLKKRTDKKRIIVLVLGDIARSPRMQYHAVSFAKLGWKVDLLGYQHPGSSVGLFESHENIRFYPIPSLPAYLQPKNRLQFLFLGPLKVLHQFLALNWALFVRKPASFLFIQNPPCIPVFFIAQCLHILRGTKFIIDWHNFGYSILALKLGKQHTFVKLLKIYEKYMARGAYAHLTVSKRMKDVLQTWGMNPCYVCYDRPPNHFTPIKNEQKKQMSIKKIPCEYNPSSTKLLITSTSWTPDEDIYILWEALNEYDKTLDTPKLLVLITGKGPMKEEFSQYIKKHPLHKVRFCMPWLSIEDYPQVMACADLGVCLHTSSSGLDLPMKVVDLFGCGVPVIALSYPTISELVHDGENGLIVNDSKALSKKMQYLLTHANELNSLKLGALKESEYRWDDEWNKVIPPIVQGSN

SEQ ID NO: 7263 - protein, 291 aa, Xylella fastidiosa Temecula1
MSKALFTRWCQRTDSYLERTLSIPTQAPQRLQAAMRYTVLSGGKRIRPLLVYAAGHLFHVDEPLLDVPAAAVELIHAYSLVHDDLPAMDDDLLRRGRPTVHIAFDEATAILTGDALQTLAFECLADAPADTSLRIAWLQTLTHAAGVAGMCGGQALDIDATGQSQTLKALEAMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVERAH

SEQ ID NO: 7264 - protein, 210 aa, Schizosaccharomyces pombe 972h-
MSAEEKNIVRVFRAWKTAHQLVHDRGYGVSQAELDLTLDQFKAMHCGMGRNLDRTTLSFYAKPSNDSNKGTIYIEFAKEPSVGIKEMRTFVHTLGDHNHKTGILIYANSMTPSAAKIIATVTGQFTIETFQESDLIVNITHHELVPKHILLSPDEKKELLDRYKLRETQLPRIQLADPVARYLGLKRGEVVKIVRRSETSGRYNSYRICA

SEQ ID NO: 7265 - protein, 78 aa, Pseudomonas syringae
MSTIEERVKKIVAEQLGVKQEEVVNTASFVEDLGADSLDTVELVMALEEEFETEIPDEEAEKITTVQAAIDYVTSHQA

SEQ ID NO: 7266 - protein, 159 aa, Novosphingobium aromaticivorans DSM 12444
MTIAVGDKLPDVKIVKATAEGPEAVQSAEYFKGKKVALFSVPGAFTPTCSAKHLPGYVEKAADLKAKGIDEVACTAVNDPFVMKAWGAANGSSDVTMLADGNGDLAEALGLTMDGSGFGLGKRGQRFSMVVNDGVVEQLFVEAPGDFKVSSAEHMLENL

SEQ ID NO: 7267 - protein, 901 aa, Saccharomyces cerevisiae YJM789
MVNPVGSSKLEQNNIKSIIGSSYNRLYSQFTSDELTEVGNYKILKQIGEGSFGKVYLALHRPTHRKVCLKTSDKNDPNIVREVFYHRQFDFPYITKLYEVIVTESKVWMALEYCPGKELYDHLLSLRRISLLECGELFAQISGAVYYAHSMHCVHRDLKLENILLDKNGNAKLTDFGFTRECMTKTTLETVCGTTVYMAPELIERRTYDGFKIDIWSLGVILYTLITGYLPFDDDDEAKTKWKIVNEEPKYDAKVIPDDARDLISRLLAKNPGERPSLSQVLRHPFLQPYGSVVLDQTQKILCRQRSGGTQFKSKLERRLLKRLKQSGVDTQAIKQSILKKKCDSLSGLWLLLLAQGKKQENCKYPKRSRSVLSVKKVIESATHNDTNGISEDVLKPSLELSRAASLSKMLNKGSDFVTSMTPVSRKKSKDSAKVLNPTLSKISSQRAYSHSIAGSPRKSNNFLQKVSSFFKSKKSSNSNSNNSIHTNVSESLIASNRGAPSSGSFLKKNSGSIQKSRTDTVANPSRTESIGSLNENVVGAIVPRSANNTTLENKKTSGNEIGLKVAPELLLNEHIRIEEPRLKRFKSSISSEISQTSTGNYDSESAENSRSISFDGKVSPPPIRNRPLSEISQISNDTYISEYSTDGNNSSFKISDTIKPSYIRKGSETTSQYSASSEKMTNGYGRKFVRRDLSIVSTASSTSERSSRTDSFYDITTATPVVTTDNRRNKNNNLKESVLPRFGTQRPWTGKRTYTTSRHGKNARRSSKRGLFKITSSNTDSIIQEVSSSEEEDHNVIYSKGKGLPTPVLQTKGLIENGLNERDEEGDDEYAIHTDGEFSIKPQFSDDVIDKQNHLPSVKAVATKRSLSEGSNWSSSYLDSDNNRRRVSSLLVEDGGNPTA

SEQ ID NO: 7268 - protein, 159 aa, Triticum aestivum
  misc_feature (60)..(60): Xaa can be any naturally occurring amino acid
  misc_feature (70)..(70): Xaa can be any naturally occurring amino acid
  misc_feature (93)..(94): Xaa can be any naturally occurring amino acid
  misc_feature (98)..(98): Xaa can be any naturally occurring amino acid
  misc_feature (118)..(118): Xaa can be any naturally occurring amino acid
  misc_feature (131)..(131): Xaa can be any naturally occurring amino acid
  misc_feature (140)..(140): Xaa can be any naturally occurring amino acid
  misc_feature (144)..(145): Xaa can be any naturally occurring amino acid
MAPTVMASSATSVAPFQGLKSTAGLPVSRRSNGASLGSVSNGGRIRCMQVWPIEGIKKFXETLSYLPPLXSTEALLKAGGTTWIRSKWVPCLXXNKVXSSSRGAHASPRGTNDGRYWXTMWELPMFGCTDXTQVINEVEXVKEXXPDAYSASSVRQHRK

SEQ ID NO: 7269 - protein, 253 aa, Guillardia theta
MVNGLFIIGPAGSGKTSFCNELKKTIISQRKSVAIINLDPASEKLIYEPEIDIKNLIKCYEVGEELGLGPNGSLLFCMEYLLDNLNWLIKEISFFRNTNFLIFDFPGQIEIIMNNSYMNDLIYELEKKLEISLLKFFLLDAQFISDISKYIGGILTSFICMIINDQTQYNILSKANYVKNFPKEIINKYLNPCMSDFFFELNIIHGKSYKKLNFSVLKLLEDFSFMKFIPLEITNVNYLVNIYKLLVNNVEDS

SEQ ID NO: 7270 - protein, 130 aa, Photobacterium sp. SKA34
MTEPLQNRTRWMLFIAAMSGALTVGLGAFAAHGLKQHLSPYLLDVFKTGVQYQAWHTFALLGCGILTRFFSSKAVSYAALFFTLGIICFSGSLYALALTDIKWFGPITPMGGVCFIIGWVMLAVAAWRSA

SEQ ID NO: 7271 - protein, 500 aa, Rhizobium leguminosarum bv. viciae 3841
MTSALQKNRPGAAFPFDNSYVGLPPHFFAAQAPTAVAEPWLIKLNEALAAELGLDVEALRRDGAAIFSGNLVPEGAEPLAMAYAGHQFGGFSPQLGDGRAILLGEVVDRSGKRYDIQLKGAGPTPFSRRGDGRAAIGPVLREYIISEAMFALGIPATRALAAVTTGEPVYREEVLPGAVFTRVAASHIRVGTFQYFAARGDTDGVRALADYVIDRHYPALKEAENPYLALFDAVCERQAALIARWLHVGFIHGVMNTDNMTVSGETIDFGPCAFMDAYDPATVFSSIDQHGRYAYANQPGIGQWNLARLGETLLPLIDAEPDSAVDKANAVIKSYGERFQAHWLAGMLEKIGLAGEEDGDLDLVQALLSLMQAQGADFTLTFRRLSDLAGDDAAEPEFAASFREPDACGAWLTQWRERLSRDPQTASERAIAMRSVNPAFIPRNHRVEQAIEAAVDNGDFSLFEALLSVLSKPYEDQPGFAAYREPPKPSERVLATFCGT

SEQ ID NO: 7272 - protein, 285 aa, Ustilago maydis 521
MSNDRNAQELLKWGLANSGSTGVASFASQSVEQISADIEAGRRPDLADPNLYNAIMGKSEAQMMAEELSVAIDTSRTLPDRMTALDNFEMLIEQIDNANNMTSMKMWSPIISLLSAPEAEIQTAAAWIIGTAVQNNDKAQMAVLDFHPVAALLDLLHSHVDEVRAKAMYALSGLLKHNPAAMHQFDQLDGWNMLNMALVDPNLGLRRKTAFLINALLLQDPNSPTSSTPSSPRSSLRTPYPTHSHPLPPAPTATQTRASTSTLPKNPPPPSSPSPPNSHLPPHTP

SEQ ID NO: 7273 - protein, 350 aa, Physcomitrella patens subsp. patens
MADWQWQEALQSIIIGIVFAYMCGRLFTLISSIRDQKFRLERGGQDTATPLLSTTFDEQEYAPAAELNVPYAPIEEELDADDGGDEQEEGNETDDWEGVESTELEELFGAASTYVASLVSIPGVKPSSEAMLQLYAHYKIATEGPCSTSQPSAFQPSARAKWNAWQKLGNMPQEEAMQKYVGILTAIDPTWHQGQRKELGRNSSQASNKKMGPGPVFSSLVGNEDGGEEASTMDPLHAYARDGDIESIAKLLDQGSNINVKDSDGRTPLIWAVDRGNLRAVEILVAKGAEIYAKDLEGQTALHYATVCELEEVAKYLFEHGADMNLPDNEGNTPLSQCPGHWQWVQRAAG

SEQ ID NO: 7274 - protein, 406 aa, Photobacterium sp. SKA34
MTTQFDISTILAQFPALQHTDGELPPVYLDSAATAQKPAVVIDTITEYYRGYNANVHRGSHSLTANATLRFEQARETVQHFIGAAHSKEIIWTRGATEALNLIAQTYARANLTAGDEILVSELEHHANIVPWQMIAAETGARVIKIPMRDDCTLDLDAFYSLLSDKTKIVAVAHITNVTGTRNPIEEIIHAAHQHNAIAVIDGAQGIAHEDIDVTALDADFYVFSGHKIYAPAGIGVLYGKQTLLEAMPPWHGGGKMVEKVSFQGTTFAALPGKFEAGTPNVAGCLALATAINWLKQLDRQGAEAHIENLRHKAIKGIKNIDGLRIIGLQPKASLFSFVVDGVHHQDIATLLDQQNIALRAGHHCAHPMLDALGLTGTLRVSLALYNTEQDVERFIAALHKACDLL

SEQ ID NO: 7275 - protein, 345 aa, Escherichia coli O157:H7 EDL933
MESRIMSTMNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPVLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITAGMMLTHRYPFATLAETYERDVINNRELIKGVITF

SEQ ID NO: 7276 - protein, 551 aa, Bordetella pertussis Tohama I
MSVDAFATGQSATSTYTAHRPVIAANRHAVSSGHYLASHAAFQILESGGNAVDAGVAAGLVLGVVHSDQVNIAGVAPMMIYLAAEDRVITIDGLGSWPAAASCERFEREFGGVVPEGLLRTVIPAAPGAWITALQRYGTRSFAEVAQYAIRFAREGFIMYPFLADRLQEAEAKYRRWPSNAAIYLPGGRPPRVGERFVQSDLAASLQYMADQETATAGSRVRKLQAARDAFYQGDIASKIVAFHQENGGLLTAADLAGYAPTIEAPLSTRYGDMDVYACNFWCQGPALLQALNILKSFDLKEMGHNSTRYIHHVAEALKLTFADREHYYADPRFIDVPAQTLLSDAYARQRAQLVRADRAWPEMPPCGEIAGYETLRAIHGNISREIDPPLDTSYVCVVDRYGNAFSATPSDVSSDTIVIPGTGLCPSSRGSQSRADASHPASLAPGKRPRLTPNPAMAIQRGKRILPLGSPGGNSQVQAMLQVLLNITLFGMDPQTAIEAPRFISYSHPDSFAPHAYYPGRLSVEGRIPAQTEQTLAALGHDMQRWPDWL

SEQ ID NO: 7277 - protein, 269 aa, Photobacterium sp. SKA34
MRELDTPASDSYNQRFGGTRRLYGNSEVDILRAAHVCVIGIGGVGSWAAEALARSGIGELTLIDMDDVCVTNINRQIHAMTGTVGKSKIEVMAERIHLINPECKVNLIDDFITPENQAEYLSKDFDYVLDAIDSMKPKAALLSYCKSNKIKVITTGGAGGQMDPTQIQIADLTKTIQDPLAKKLRDTLRRHHNFPKNPKRKFGIDCVFSTEQLKYPQADGSVCVVKATAEGPKRMDCASGFGAATVVTATFGFVAVSQILRKLIEKHKQ

SEQ ID NO: 7278 - protein, 355 aa, Physcomitrella patens subsp. patens
CDLVKGSWVPDPRPPQYTNSSCRYIQGHQNCMKNGRPDTGFMYWKWQPQQCDLPRIDAQAFLIAMRNRSMTFAGDSIARNQFQSLLCILSQVEVPDHTYNAPDDRDNIYVFRTYDFTVAIYWSPYLVHVEDKDITWPDNKTQSVAHIHVDKLDRAWTDRISGVDILQISTGQWWFKRGLFLKGNKPMGGHICDGWKECEKEIGFADPYRLAIHSLLKNSLSIPGYTGTTILRSFAPDHFEGGAWDSGGRCVRTTPGGVSISSLTNWMYEIQTEEFQNVTGAMSESEKQRIKLLDITNLAQIRADGHPDVYMKFQPFSKEMKQPPQKDCLHWCLPGPIDTWNDLLVESLHDKIHNY

SEQ ID NO: 7279 - protein, 579 aa, Xanthomonas oryzae pv. oryzae KACC10331
MRRRRRLRSPQQTSGVACSARHHRRLGAITRTKEEHMLEIYGKPTPINVRNVLWLCDELALDDTLHAYDRTRFATIWLHAANATSWTDSFAVLRWATLAHCVESREVRMSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGASLPHELIAGPHAGGIANLPAVVITFLVAGMLMAGTKESATLNAVLVVLKIIALGVFVAIALPTFKSANLQPFMPYGISKAMGPDGVERGVMAAAAIIFFAFYGFDAISTAAEETKNPGRDLSIGIVGSMIGCTLIYVLVALAAVGAMRFTVFGKSPEPLALILRELGHGKAALVIGAVAIIALPTVLLAFLYGQSRIFFVMSRDGLLPRGLSKVNARTGTPVAITLLTAVLVAALAGVARLDEIAALANAGTLAAFTAVAACLLVLRVREPGRARAFRTPLAWVVGPVAILGCLYLFWSLPSNTQGWFLLWNALGVVVYLAYGRRNSRLNSAG

SEQ ID NO: 7280 - protein, 398 aa, Wigglesworthia glossinidia endosymbiont of Glossina brevipalpis
MFELTELSPLDPVLGMIDIIKNDKRDGLINLGIGVYKDIKGNTPILDSVKKAENILIESEKTKNYLNIEGLESFIQHSKSLIFGKENLSELNDFIASVQCPGGTSALKIAAEFLIRHTKIRKIWISDPSWPNHEKLFSFAGFKVHKYPYFNKEKNQLDFYNMKKCLENIKDDSAVIFHSSCHNPTGIDPSFEQWLELAKISRNKKWIPIFDSAYQGFSNGLKDDVFGIKIFLKYINEFVVCNSFSKNFSLYNERVGTCNFITKNKKHASNVFSQLRSIIRVNYSNPPAHGANIINVIFSKKDLFNLWKSELNEMRNRIKQIRSLFADTLFKINNKKNFNFIKNQHGMFSFIGLNRKNVMDLRNNFRIYVIDSGRLNFAAITNKNIYEVCRSINCVLNN

SEQ ID NO: 7281 - protein, 759 aa, Erwinia carotovora subsp. atroseptica SCRI1043
MDEQLKQSALDFHQYPIPGKIQVSPTKPLATQRDLALAYSPGVAAPCLEIAADPLAAYKYTARGNLVAVISNGTAVLGLGNIGALAGKPVMEGKGVLFKKFSGIDVFDIEVDELDPDKLIDVIASLEPTFGGINLEDIKAPECFYIEKKLRERMKIPVFHDDQHGTAIICTAAVLNGLRVVEKNISDVRLVVSGAGAASIACLNLLVALGLQKHNIVVCDSRGVIFHGRDENMEETKAAYAIEDNGARKLADVIPDADIFLGCSGPGVLTPDMVKTMAPRPLIMALANPEPEILPPLAKEVRPDAIICTGRSDYPNQVNNVLCFPFIFRGALDVGATTINEEMKLACVHAIADLALAEQSEVVASAYGDQELSFGPDYLIPKPFDPRLIIKIAPAVAKAAMNSGVATRPIEDFDAYVEKLTQFVYKTNLFMKPVFAQARQQPKRVVFAEGEDARVLHATQELVTLGLAFPILIGRPSVIEMRLQKLGLQLTIGKDFEVVNNESDPRFKEYWSEYFELMKRRGVSQEKAQRAVIGNPTLIGSIMVHRGEADALICGTIGTYEEHFDVVEKVFGYREGVHTAGAMNALMLPSGNTFIADTYVNADPTPEQLAEITLMAAESVRRFGIEPKVALLSHSSFGTSDSPTAQKMRATLALVNKLAPELEIDGEMHGDAALVEAIRREQMPDSPLKGSANILIMPNMESARISYNLLRVSSSEGVTVGPVLMGISKPVHILTPIASVRRIVNMVALAVVEAQTQPL

SEQ ID NO: 7282 - protein, 158 aa, Brassica napus
MMIRQAAKKALGITSRQSTPCSVGIFRSYHENVIDHYDNPRNVGSFDKNDPTVGTGLVGAPACGDVMKLQIKVDEKTGQIIDARFKTFGCGSAIASSSVATEWVKGKAMEEVLTIKNTEIAKHLSLPPVKLHCSMLAEDAIKAAVKDYKEKRVKTNGA

SEQ ID NO: 7283 - protein, 314 aa, Cryptococcus neoformans var. neoformans B-3501A
MSPEPPAKRMKETKRVEMAFLGPRGTYGEQAARAFATSYSDPIDLVPCTTITDVYNHSAPLIVLPLENTLQGCVLETLDCLLSVLKPSKPEDPKPLERKIVADFVLPIRHCLVVRKGTKMEQIKWVRSHEQALGQSSSFLAERLPGVKLEKWSSTAGAAVSLLQNTGNADDKGAAICSKAVLDLYPDHLEVLHEGTQYGNENYTRFILLTVPAPTIVPKSDKQLSSADRTSFIAVPNPSLGAILLSLHPSSSASSSVSVTAIHTRPAVEGMAHKDEKFPRWCLLEVVNEPTKEMEDAVSLGSLRESLGPEILCK

SEQ ID NO: 7284 - protein, 150 aa, Salmonella typhimurium
GEIPVMAAETVHRFGIGPKVALLSHCNFGSSNSPSASKMRETLERVRERAPDLMIDGEMHGDAALVESICNDRMPDSPLKGAANILVMPNMEAARISYNLLRVSSSEGVTVGPVLMGVSKPVHVLTPIASVRRIVNMVALAVVEGQTQPL

SEQ ID NO: 7285 - protein, 482 aa, Lentisphaera araneosa HTCC2155
MSQADIGLIGLAVMGQNLVMNMNDNGYTVAVYNRTTSKVDDFMNGPAKDSKVIGTHSVEEFVSQLKTPRRVMLMVKAGEVVDKFINTIVPHLEAGDIIIDGGNSLYTDSNRRVEELAAKGLRYIGAGVSGGEEGARFGPSIMPGGDPEAWPAVKNIFQDISAKVDGGEACCEWVGKGGAGHYVKMVHNGIEYGDMQLICEAYQLLKNAGFSNDEMHQIFKKWNTGVLDSFLTEITTDILGYKQEDGTHLVDYILDTAGQKGTGKWTGINALDLGMPLTLIAESVFARCVSALKDQRIEASKVLNGPDIKFNGDKEAFVNDVEQALYASKIISYAQGYMLLKEASETYKWDLDFGAIALMWRGGCIIRSVFLGNIKDAFDENADLENLLLNDFFKDAIHKSQEGWRRTVVKGIELGIPTPCFSTALAFYDSYRSEVLPANLLQAQRDYFGAHTYERLDKPRGEFFHTNWTGKGGNVSSTTYDV

SEQ ID NO: 7286 - protein, 420 aa, Oryza sativa
MYIFRRAAARAVSAPRQLRATPCVNSFQSSIPSLTRSFHQSRIWRAEEQKKETETAAQDAVSESSGTTSEPLGQSEGVSSSETTTTPSSSTTSEPVGQSERQSKPVLEQASEIAEKAKDTVSDAAAKAAQAVGEFTQDPKERAQDAAASATEQASQTASKVSEQASEVTSQIREQAQSAAAEATRYARNTAASTRETFQERRPYESRPPAPPSKILYIGNLFFEVTAPQLEAEFAKFGEVTNSRVVTDDRGLSKGFGYVEFINQQQADAAREALDQKVFQGRRISVQYHRRREANNNTKRNQRSTAEPSKTLFIGNMSYQMSDRDLNDLFRSIKNVLDVRVAIDRRSGQPRGFAHADFTDVESAVTAKKALEQKSVYGRQLRVDYSGQAKEDGDRPARRERSDRYERRERRDRDDSNDLD

SEQ ID NO: 7287 - protein, 456 aa, Erwinia carotovora subsp. atroseptica SCRI1043
MMQTQSSSFPLLDQWVARQRQHLAGYAPVEKKGRVMAVSGILLECSLPQARIGDLCWVARQDDSQMMAEIVGFSPDNTFLSALGALDGIAQGATVTPLYQPHRIQVSERLLGSVLDGFGRALEDGGESAFVEPGQVTGRTQPVLGDAPPPTSRPRISQPLPTGLRAVDGLLTIGQGQRVGIFAGAGCGKTTLLAELARNTPCDTIVFGLIGERGRELREFLDHELDDELRSRTVLVCSTSDRSSMERARAAFTATAIAEAYRAEGRQVLLILDSLTRFARAQREIGLALGEPQGRGGLPPSVYTLLPRLVERAGQTEDGAITALYSVLIEQDSMNDPVADEVRSLIDGHIVLARRLAEQGHYPAIDVLASLSRTMSNVVDTDHTRNAGGVRRLMAAYKQVEMLIRLGEYQPGHDELTDSAVNAHSEITQFLRQSMREPMPYGVIQQQLAGVSRYAP

SEQ ID NO: 7288 - protein, 370 aa, Brucella suis 1330
MASRKLLLLPGDGIGPEAMAEVRKVIAFLNSDLNLGFETEEGLVGGCAYDAHGQAISDADMEKALAADAVLFGAVGGPKWDSVPYEVRPEAGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQVVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 7289 - protein, 547 aa, Neisseria meningitidis MC58
MNAFTRAWYALERHYQDTRHVLLRDRFACEPDRFERMHERLDGMLFDYSKNRLGEDTLQLLCNLADAADLEGKMRALRTGAKVNGSEGRAALHTALRLPDGADAVYVDGRDVLPEIRRELNRALKFAHSLDDGSYQGITGKRITDFVHIGIGGSDLGPAMCVQALEPFRRHITVHFAANADPACLDAVLCRLNPETTVFCVASKSFKTPETLLNAQAVKAWYRGAGFSESETACHFCAVSADTAAAAAFGIAAERVFAMYDWVGGRYSVWSPVGLPVMVAVGGARFRELLAGAHAMDRHFFSTPTRHNIPVLMALIAVWYNNFQHADGQTAVPYSHNLRLLPAWLNQLDMESLGKSRASDGSPAVCKTGGIVFGGEGVNCQHAYFQLLHQGTRLIPCDFIVPMTAQGREDGRSRFTVANAFAQAEALMKGKTLDEARAELADLPEAERERLAPHKEFPGNRPSNSILIDRLTPYNLGMLMAAYEHKTFVQGAIWNVNPFDQWGVEYGKQLAKTIIGELEGGTSVHDASTEGLMAFYRECRLKGGGAA

SEQ ID NO: 7290 - protein, 197 aa, Oryza sativa
SSLATNLSKPFDCRVKNSRRLVLGYAYPAYDCYKTLELNKPQIDQLRFWCQYWILLAFLTTLETITYFTVSWLPMYGEAKLALVLYLWYPKTRGAKHVYESYLQPVLARHEADIDRGLLQLRASAKDATASHLQAAVSLGRACFAEVAGRVSSQLQAARSSGGGGRAGQADQLQKRQKINPEEEEEDEDATVSKTRR

SEQ ID NO: 7291 - protein, 402 aa, Zea mays
MSAEPTSPPLSTAQVRGSLIPPLPDDLAVHCIALLPRAAHPSLALVSRAFHALLCRHPEPLLAARRTLRCSEPHVLLSLRPPSSASPIFFLLLPHPGWPPLPLPSPPVPVSSSASAATDGARLFLVGGSVSAVPSASVQILDPRARSWSAGPRLSSTREFAAAVAHSGALFVAGGCIPSSPFWAEALDLSTPNAKWRAVASPAHLREKWMHGCASLDGKVVVVADRGGLSYDPSAPPAEAWAPVSPVLDMGWKGRAAVVEGILYSYDYLGQVKGYDPYTDSWSTVEGLEGELPKFLCGATLADVGGLLYLVWEGKWKGKLKEVQRSHIALHWSCDAADADVKQVTLISILKVPISSFSCTAACLREVPTMIQAVCSTYIGFQGLLANGTIFPKYRNAFIATP

SEQ ID NO: 7292 - protein, 256 aa, Novosphingobium aromaticivorans DSM 12444
MSHRPYIVGNWKMNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 7293 - protein, 137 aa, Zea mays
MKTYYFQQFEPALLLRSAPFRPGRTHPRRRANPSERESPEPRDQPAMALRALYNEIRSMKVRDVPAYLKPRLTWDNVKKSADQAVDRYIEKYIDTSSPDPLYHVCIGGMIFSYFVNLPWERAHLAHLEEMERTGGKH

SEQ ID NO: 7294 - protein, 228 aa, Ralstonia metallidurans CH34
MLTLTKSTSLPDSTAALAPSDADARPLAERIAQALDAMRDGRPVVLLDDDDRENEADLILAAERLTNSNMAMMIRECSGIVCLCLTPEKVRQLGLRPMVENNRSQYGTAFTVSIEAREGVTTGVSAADRITTIRAAIADEAGLDAVVSPGHVFPLVAVEGGVLARRGHTEGSVELARMAGLSPAAVLCELMNPDGTMARRPEALAFAEMYQLPVLTIADLVAWREINA

SEQ ID NO: 7295 - protein, 367 aa, Escherichia coli CFT073
MRQVRFPRTICWITLSGKFAQGKPCRRSMTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 7296 - protein, 310 aa, Saccharomyces cerevisiae YJM789
MTSIDNRPLPFIYQFTAGAIAGVSELLVMYPLDVVKTRMQLQVTTKGHPAVVAAKAAVDHYTGVMDCLTKIVKKEGFSHLYKGITSPILMEAPKRAIKFSGNDTFQTFYKKIFPTPNGEMTQKIAIYSGASAGAMEAFVVAPFELVKIRLQDVNSQFKTPIEVVKNSVVKGGVLSLFNGLEATIWRHVLWNAGYFGIIFQIRKLLPAAKTSTEKTRNDLIAGAIGGTVGCLLNTPFDVVKSRIQRSSGPLRKYNWSLPSVLLVYREEGFKALYKGFAPKVMRLAPGGGLLLVVFTNVMDFFREVKYGKKQ

SEQ ID NO: 7297 - protein, 381 aa, Vibrio vulnificus CMCP6
MKTFILPDLGEGLAESEIIKWHVSVGDKVEVDQVILTVETAKATVDVPAPWAGTIITRHGNEGDVVNIGALLLEIEDGDVTENSDQKVQQREDAATVVGHVSNQMHQVKVDDFWIGGNQNHTTEKRVTALPSARLLAQKLGVNLEMVSGTGPSGLIMDHDVYDEAGKQRPGTEVLKGARRTMMTTMTESHLQVAAVTITEEALLEHWSSQEDITVRLVQAVVYACQQEPALNAWFDADTVTRCVHHTVNIGMAVDSAHGLYVPVMRHADEFSPDDIRSWINQTVSGIRERKIGREQLQHATITLSNFGAIAGIYATPVVSPPQVAIVGAGRIIEKVVLREGKAVAVKAMPLSITFDHRACTGGEAARFTKALAEHLRKPSV

SEQ ID NO: 7298 - protein, 493 aa, Xanthomonas oryzae pv. oryzae KACC10331
MSRKQAFQFLDLPRTMPTRIPVELRTSGDWGELYGKFDKAEAQYQSGRCLDCGNPYCSWKCPVHNAIPQWLQLVQENRIEEAAALCHSTNPLPEVCGRVCPQDRLCEGSCTLEEFGAVTIGAVEKYIVDTAFKMGWRPDLGNVHPTGHRVAVIGAGPAGLACADRLARAGIEAVVYDRYEQIGGLLQFGIPSFKLDKSVIGKRREILEGMGVQFRLGVEIGRDISIEQLLGEYDAVFLGTGAYRYTDGGLPGQDLKNVLPALPFLVQNSRIVSGNDPHGRPIAGWENQLALPDLTGKRVVVLGGGDTGMDCVRSAIRLGAAKVTCAYRRDEASMPGSAREVANAREEGVRFLFNRQPLSIESGADDEAIGVTVVETKLGEPDASGRRNAVPVEGSESLLEADVVIIAFGFSPSLPDWLASQGVEAGSNGRIVAPADGHGRLPYQTSNPRLFAGGDCVRGADLVVTAVAEGRDAACSIVQLLGVKAQVKEPAAA

SEQ ID NO: 7299 - protein, 117 aa, Zea mays
FTFITYTSHSTSSYSPSIHNSSYTPSIHTAPCNCGSPLLRHSTFSHFYTFSHLKSLHPHSGGYYSCRTSRISVVVTSASCIVDTGTCIIGGSPPSSIIDTGSHGTRFICISFPSISG

SEQ ID NO: 7300 - protein, 206 aa, Rhodopirellula baltica SH 1
MFREFRGRGKKMGLTGVSGWFTLRSQLSTTFGLVGLFWKRFPVKRARMREASCLVGDGLQGIRLVTNIYVGNLSFKATEEELRGAFEQYGEVSAVNIIMDRETGRSRGFAFVEMADAEGAKDAIENLNGHEIDGRSVTVNEARPREPRSGGGGGGGGYGGGGGGRGRGGGGGGYGGGGGNRGGGYGGGGGGYGGGGGGGYGGRGDR

SEQ ID NO: 7301 - protein, 326 aa, Mesorhizobium loti MAFF303099
MKAVQFSRFGGPEVLEIVELPAPVPQAGEVLVRVHAAGINFFEVLMRADRYAVTPQLPMFPGVEVAGIVEAVGEGVDAAFLGRRVAAPLFASQRPYGGYAEQVTISADLTVPLPDDVSFEAATALMVQGLTALHLLRQSPPEGRTVLVPAAAGGVGSLLVQLAKAKGAAKVIAAAGGAGKIELALSLGADAAVDYIGSDWPARVRALTGGEGADIIYDTVGGALTALSLQALAPGGELVFAALGRYGLEPSDLEAMIGRNQSLRGFALLPLLSPQVLRASLSELFQLAASGRLRVAIGGRFPLGQAGEAHRLLDERRSTGKVVLVP

SEQ ID NO: 7302 - protein, 963 aa, Vibrio campbellii AND4
MSTVFEVDDTIANYFSSQVPVVEGKYDLTPDQVLLEQAEHESEVRSYPRRLPIAIKRAYGCLVEDTRGQIFLDCLAGAGTLALGYNHPEINQALKAQLDSGLPYQTLDIATSAKTHFIKSVKGFLPQELSDNCVIQFCGPSGADAVEAAIKLAKQTTGRNTMLAFRGAYHGMTNGTMGMMGNLGTKARRTGLMSDVHFMPFPYNLRCPFGLGGDEGAKASIRYIERLLNDDEAGIMKPAAIIVEPVQGEGGVIPAPAFWLRELRRICDDQDILLIFDEIQCGVGKSGYNFAFEEAGIVPDILCLSKAIGGGLPMSLLVINKQHDTWKPGEHTGTFRGNQLAMVSGAKALEIIQRDNLVKHANNAGQYLRLGLESMQKRVNCIADVRGKGLMLGVEIKNPNGELNKFGEPLSDGQLTLDIQYAALERGLMVEKGGRDGSVIRFLPPLIISLEQIDFALRVLEDAIIAAGGSHVETSSQEEWKKHFIHTGELGGAEFASVMNHTTAAMKSVFEHVRAPYSGLDPKRLEAAIYAVDLDHKNAPLKAVIDEAIELVAKNAIFTQHPDCIAHLHTPPLMPAVAAEAIIASLNQSMDSWDQASSATYVEQKMINWLCDKYELGEKADGIFTSGGTQSNQMGLMLARDWIADKLTGHSIQNLGLPEYAAKLRIVCSEKSHFTVQKSASWMGLGEKAVMTIDVNADGTMDVTQLDQALIQAKSEGLIPFAIVGTAGTTDHGAIDDLDFIADMAARHEMWMHVDGAYGGAMILSSHKSRLKGIERAHSVSVDFHKLFYQTISCGALLINDKSNFKFLLHHADYLNREHDELPNLVDKSIATTKRFDALKVFMTMQNVGPSVLGEMYDHLLVLTQQVADMVRAHERFELLAEPTLSTVLFRATNGRMTSASADLDELNKTLRLEALTRGIAVLGETIVDGKTALKFTILNPCLTTADFESLLLKINLLVVELV

SEQ ID NO: 7303 - protein, 363 aa, Bordetella pertussis Tohama I
MALQCGIVGLPNVGKSTLFNALTRAGIAAENYPFCTIEPNVGVVEVPDPRLDKLAEIVKPERILPATVEFVDIAGLVAGASQGEGLGNQFLSHIRETNAIVNVVRCFEDPNVVHVAGKVDPIADIEVIETELALADLQTAEKALHRHSKTARSGDKDAQRLVTVLEKCIAQLNQAKPVRGLDLSDEEQTLIAQLCFITAKPAMYVGNVSDDGFTDNPLLERLAEFAKSRNAPMVAICAAIESEIVDLPEEDRQAFLSDMGMEEPGLNRLIRGAFTLLGLQTYFTAGVKEVRAWTIPIGATAPQAAGVIHTDFERGFIRAQTIAYEDFIACKGEQGAKEAGKMRAEGKEYVVKDGDVMNFLFNV

SEQ ID NO: 7304 - protein, 429 aa, Rhodopirellula baltica SH 1
MIMDLNNTIALILGGGRGTRLFPLTKIRAKPAVPLAAKYRLIDIPISNCINSGLNRAYVLTQFLSESLHRHLRQTYTFDHFSGGFVELLAAQQTVNSGTDWYQGTADAVRKNLVHLRESWIKHVLILSGDQLYRMDFRDMMKTHIESGAAATIAGIPVTRKDASALGIMQVDDTGRVTGFVEKPQTEEEIAKVRMEPSWIDARGIESQGRDLLASMGLYIFDKDLMVDMLENSLHSDFGKEVFPEAINTHKVQLHLFDGYWEDIGTIRSFYEANLSLASKNPPFDIRNRHSPIYSRPRFLPPTIMGDAKITGSLIADGCRIGDNVTIENSVIGLRTVIGDNVTIKDSVVMGADFIEMRGAERDGKLPVGVGAGSVIQGAILDKNCRVGENVRILNEAKVDHQGEDDDLQIRDGISIVIKDGQIPDGFSC

SEQ ID NO: 7305 - protein, 213 aa, Photobacterium sp. SKA34
MSKIYEDNSLTIGNTPLVRLNRVSNGKVLAKVEARNPSFSVKCRIGANMIWDAEKKGTLKEGVELVEPTSGNTGVALAFVAAARGYKLTLTMPESMSLERRKLLKALGANLVLTEAPKGMKGAIDKAEEIVNSDPSKYLLLQQFNNPANPEIHEKTTGPEIWDATDGEIDVFVSGVGTGGTLTGVSRFIKQQKGKAITTIAVEPLESPVITQT

SEQ ID NO: 7306 - protein, 316 aa, Bordetella pertussis Tohama I
MANDSFMIFTGTANTRLAVDVVNHLDMSLGKMTVGRYSDGEVMVEINENVRGKDVFVLQPTCAPTNDNLMEIMVMVDALRRASAGRITAAIPYFGYARQDRRPRSARVAISAKVVANMLQVAGVDRVLTMDLHADQIQGFFDIPVDNIYAGPILLGDIWRRNFSNLVVVSPDIGGVVRARALAKQLEADLAIIDKRRPRANVSEVMNIIGEVDGRTCIIMDDMVDTAGTLCKAAQALKDRGAGAVYAYCTHPVLSGGAIERIETSSLDELVVTDTIPLSEQAQACGKIRQLSCAALLGETILRISNAESVSSLFAD

SEQ ID NO: 7307 - protein, 479 aa, Wigglesworthia glossinidia endosymbiont of Glossina brevipalpis
MHRIIRRTKIVATLGPSTDLNNNLEKMILAGANMVRMNFSHGNFYDHARRTKQVRNISHKLGKNIAILGDLQGPKIRISTFMTGKVFLSPGDQFILDASLSKDLGTVESVGIDYKYLPKDVFPGDVLLLDDGRIQLKVKKIVNKKIFTTVYIGGYLYNNKGINKLGGGLSANSLTEKDKKDIICAAKIGIDYLAVSFPRTGKDLKYARNLLNNVESHAKIISKIERAEAVANNDIIDEIITESDAIMVARGDLGIEIGDPELVGVQKKLIQRARDLNRAVITATQMMESMVYNPMPTRAEVMDVANAVLDGTDAVMLSAETAIGKYPVETVESMSNVCIGAEKISNINSLKNRLNIKFKTVEESMAVSAMYIANHLNMIKAIISLTESGKTPLIMSRISSGLPIFALSKHEHTLNLTALYRGVTPVYFKNNEKGISAADSAINLLKEKKFLFSGDFVVITQGDVMGTIGKTNTSRILIV

SEQ ID NO: 7308 - protein, 208 aa, Physcomitrella patens subsp. patens
MQGLVRLVQAQGKALPGIVLQHVRVGGSGFGSGFQTRWESGQAKAKEGLEEHGFESTTISDILKEKGRNADGSWLWCSVDDTVYDAVKSMTANNVGALLVVKSGTEKTLAGIITERDYLRKIIVQGRSSKTTKVGDIMTEENKLITVSPDTKVLRAMELMTNNRIRHIPVVEGKGMKGMVSIGDVVRAVVDEHREELQRLSSFIQGGY

SEQ ID NO: 7309 - protein, 386 aa, Cryptococcus neoformans var. neoformans B-3501A
MSGNGSSSFAAPPSARILVIPPQFHSMTAGAGAGLVSSIVTCPLDVVKTRLQAQAASVHHKDYQTVEMIIKDIWTSGGFRGFYRGLGPTLAGYLPTWGIYFTVYDLVKDRLGAWAAHSDLPTKPSMVHIVAAMTAGATGTCMTSPLWVIKTRLMAQVGPSDQARYRNTLEAIVDIYRNEGFRAFYKGLLPSLMGISHVAVQFPLYEKAKSWSDNNTEGDHSSLTPSTILICSAFSKMVASIATYPHEVLRTRLQIRKSSPKSNSSSSVFSSNPSKPSHPPLPFSSMPFNYLPSADGKSHPPLDASDSTASHAHPPSDRQTRPLWRSLIKFRKEGGIIDTFLSIKNQDGWRGFYRGLSINLIRTVPSSAVTMLTYELIMRRLSSPTL

SEQ ID NO: 7310 - protein, 293 aa, Erwinia carotovora subsp. atroseptica SCRI1043
MTTLEQCIGNTPLVKLQRMTQGLKSEIWLKLEGNNPAGSVKDRAAFSMILQAENRGDITPGDRLIEATSGNTGIALAMIAALKGYRLRLLMPDNMSYERQTAMRAYGAELVLVNRKLGMEGARDRAKQMVLAGEGKTLDQFNNPDNSLAHFLTTGPEIWQQTAGKLTHFISSMGTTGTISGVSRYLKQQNPAICTVGLQPAEGSHIPGIRRWTPDYMPGIFRADLVDRILDMTQVDAENTLRQLARQEGIFCGVSTGGAVAGALRIAAENPGSVIVAIACDRGDRYLSTGVFD

SEQ ID NO: 7311 - protein, 411 aa, Zea mays
MGVGSVLPVQVYLGFAVGCLFWSLRYCIVQLLVLVYQGFRGYTYTGLSCQVLDLIISVLLIRMGVYLSTPKTDKLSENGENDRLKFGLSSMQGWRATMEDAVSFLIKAINIILFALAGVKLRSPIDYPVHEGCNFVMSGALRLHSALLDLDSETAFFGVFDGHGGRVVAKFCAKYLHGQVLKSEAYSTGDLGTAVHRAFFRMDEMMQGQRGWRELSALGDKINKFSGMIEGLIWSPRGSDSNNQQDDWASEEGPHSDFAGPTCGSTACVALIRNTQLVVANAGDSRCVISRGGKNKFLPPEKQIVTANPDINVVELCDDDDFVVVACDGIWDCMSSQQLVDFIHERINTESSLSAVCERVLDRCLAPSTIAGDGCDNMTMILVQFKKPVDRNKKAEAAGQSASNVDEAKSR

SEQ ID NO: 7312 - protein, 541 aa, Crocosphaera watsonii WH 8501
MDRTVKLWTFDGEPLRTLNTNKPVYDVTFSPDDQILIAATGNDLQIWTVEGKLLKTLEEHDAEVYDVEFSNNGQFFLSSSKDKTIKLWNKNGQLLKTFRDHNNTVWEVEWGEDDSYFLSASEDGTIRKWNLDGTVIKTIVAHNSAVMDIEIVPQSKVFFSVGEDKTIKFWSPQGELIDSFDGHQDGILDLAIHPKREFWVSASWDKTVKLWKPNKPLWINYLEHQGEIRGIAFSPDQNRIVTASRDHTLKLWNPQQDSIISLEDHEDGVSTVVYSPDGQFFASGSRDETVRLWNNQGENFRTLEGHTDWVLTVAISPNNQLIASGGLDRTIKLWRKDGTLITTITEHERGVLDLAFSPDGKYLVSSSRDQTIKIWRLDGSLVRNIEGHQAPVRTIAISPDGSKIVSGSRDNTVKVWSWDGELLHTLQEHQERVWDVAFSPNGEMIASGSDDGTVRFWNLDGQLIKTLYSYSSMVRSLAFSPDGQQLAVGSRESMLILWDLNEVLALDELRYGCAWIKDYLEFNASLSESDRRLCDGIKVVH

SEQ ID NO: 7313 - protein, 203 aa, Triticum aestivum
TIKQKRASFNISSSGCHIAHRVFFVQAFWDYSEKKLIQKAKAEWSVISEWSPDGRHFMTATTAPRLQIDNRIKIFDHTGSLQFIKEFEKLYQVDWKPESPERFGDIAELTISLNGIKIEETKKQGQGSKSAQTSGKAPVNVATKPAGAYRPPQSKHTAALQDKLFGGLAPTGGEMSKTALRNKKRREKQKEKKAGEGSSADDS

SEQ ID NO: 7314 - protein, 323 aa, Candida shehatae
MSPSPIPAFKLNNGLEMPSIGFGCWKLDKSTAADQVYNAIKAGYRLFDGAEDYGNEQEVGEGVKRAIDEGIVTREEIFLTSKLWNNYHDPKNVETALNKTLKDLKVDYVDLFLIHFPIAFKFVPIEEKYPPGFYCGDGDNFVYEDVPILETWKALEKLVKAGKIRSIGVSNFPGALLLDLFRGATIKPAVLQVEHHPYLQQPKLIEYAQKVGITVTAYSSFGPQSFVEMNQGRALNTPTLFEHDVIKAIAAKHNKVPAEVLLRWSAQRGIAVIPKSNLPERLVQNRSFNDFELTKEDFEEISKLDINLRFNDPWDWDNIPIFV

SEQ ID NO: 7315 - protein, 211 aa, Rhizobium leguminosarum bv. viciae 3841
MSGTLVLVRHGQSDWNLKNLFTGWKDPDLTELGIQEANTGGAALAEYGIKFDVAYTSVLVRAQHTLKLILDKVGQPDLLTIRDQALNERDYGDLSGLNKDDARAKWGEEQVHIWRRSYDVPPPGGESLRDTGARVWPYYLTEILPRVLRGEKVLVAAHGNSLRSLVMVLDKLSREGVLALNLATGVPMVYKLKADSTVASKEVLGDMSGAH

SEQ ID NO: 7316 - protein, 438 aa, Populus trichocarpa
MPVAASAVYFLNLRGDVLINRLYRDDVGGNMVDAFRTHIMQTKELGTCPVRQIGGCSFFYMRISNVYIVIVVSSNANVACAFKFVVEAVALFKSYFGGAFDEDAIRNNFVLIYELLDEIMDFGYPQNLSPEILKLYITQEGVRSPFSSKPTDKPVPNATLQVTGAVGWRREGLVYKKNEVFLDIVESVNLLMSSKGNVLRCDVTGKVLMKCFLSGMPDLKLGLNDKIGLEKESQLKSRPAKSGKTIELDDVTFHQCVNLTRFNSEKTVSFVPPDGEFELMKYRITEGVNLPFRVLPTIKELGRTRMEVNVKVKSVFGAKMFALGVVIKIPVPKQTAKTSFQVTSGRAKYNAAIDCIVWKIRKFPGQTEPTMSAEVELISTMAEKKSWTRPPIQMEFQVPMFTASGLRVRFLKVWEKSGYNTVEWVRYITKAGSYEIRC

SEQ ID NO: 7317 - protein, 450 aa, Acinetobacter sp. ADP1
MSTMSLNINDLLNQAKFSKFHLSVVFWCTLINICDGYDLVIYGVVLPRLMEQWSLTSVQAGMLASTAMCGMLVGALSCGILADKFGRKRVLLLCVFFLSTFTLLGSFASTPTEFAILRFLAGLGIGGAMPNVVALTSEYSPKKSRVTMVSIMSCGYAVGAIISALVGSILVERFGWQIMFILAGIPLLFIPIIWKYLPESLVFNVKKNNTEKAHALIAKVDPTVLVSQHTKLVLNESLEKAYGSRRVLFQEGRAAGTLKFWIAFFMCLLVVYALSSWLPKLMYNAGYPLGKSILFLLAMNVGGIIGGTTSGMLADKFKIKPVVISLFCIAALSLIALGFNTSAIILYTLVAVAGASIQGASILLYSYVAQFYPLVANSTGIGWASAIGRTGAIMGPILAGMLLVLNLPHLMNFVLISVPALIAAISIGFLTTSKKKVEQPVALVTQQSLE

SEQ ID NO: 7318 - protein, 311 aa, Ralstonia metallidurans CH34
MSIDILAYGEPLIEFNQQPDDPSRYLQGFGGDTSNFCIAAARQGATTGYITAVGADSFGERLLALWTRERVDTRHVVVNASAPTGVYFVSHDNHGHRFDYLRERSAASRYHHEQLPLATIAQARFLHLSGISLAISTSACDAGLAAMEHARKAGAKVSLDTNLRLRLWSLARARGIMREAFSLTDICLPSWDDITILTGLDDRDAIVDYLLGCGVELVALKLGEEGSYIATQESRALVAPFPVRPVDATGAGDCFGGSFIARLAADADPFDAARYANIAAALSTTGYGAVAPIPHAETVRARLEQGVTVIA

SEQ ID NO: 7319 - protein, 198 aa, Helicobacter pylori 26695
MLVTKLAPDFKAPAVLGNNEVDEHFELSKNLGKNGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 7320 - protein, 270 aa, Populus trichocarpa
MAERPPAERGSFGRGFGGRGGRGDRGGRGRRRGGRKEEEEKWVPVTKLGRLVKDGKISSVEQIYLHSLPIKEYQIIDTLIGPALKDEVMKITPVQKQTRAGQRTRFKAFVVVGDCNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKATFDCLLKTYGFLTPDFWKETRFIRSPFQEYTDLLAKPTSKVLIAEVQQE

SEQ ID NO: 7321 - protein, 208 aa, Helicobacter pylori 26695
MIVIKDAHFLTSSSQLFQCPASLTSEMVVLGRSNVGKSSFINTLLGKNLAKSSATPGKTRLANFFSTTWEDKENALRATFNVIDLPGFGYAKVSKSLKKEWEGFLWELLSVRVSIKLFIHLVDARHLDLEIDKNAKENIQALLRPDQAYLSLFTKFDKLNKNEQHRLFLNAPKPFLINTAHFNALSSKYPTLEIVRQTLLKHLLTNPL

SEQ ID NO: 7322 - protein, 182 aa, Arabidopsis thaliana
MTTNSWHSILVIYLASLALDWSLEMGIHLEKSAYLALAGNFLRSNELSKVIDVVKEMVKSQHSLGVYHGAMLIHMLGFGRRPSLAAEALDLLPDDQKGLSAYTALMDVYISAGSPEKAMKILGEMREREIMPSLGTYDVLLSGLEKTSDFQRETSSLRKEQKSLVASTRFREIVHVEDKICM

SEQ ID NO: 7323 - protein, 705 aa, Chlamydomonas reinhardtii
MAPQPEAQYRVDPDGVAVITLNYPPLNALHPLLLRSLFEALRRAHADPAVKAVVLTGANNNFCAGFDISQFQNPDAGSGGGIDNSINDAICKYLEGGAKPVVAAVQGVALGGGLEVAMGCNARVAVRGTKLGLPELTLGIIPGFGGTQRLPRLVGLAKGCEMMLTSAPIKAEGREGRGIPALFRCPPPPYHSPLPLPPFLHSLHRPSLSTPSPPDKLPPLGEALALLDMARAEAGRRARGLAHPQLCLDAVQAGVERGGQEGLAAEGRAFAAAAALDTHKALVHIFFAQRATKKVKGVTDVPGLKPRPIRCVAVLGGGLMGSGIATALALAGVEVILKEVKKGAMSQAAADAALGRVSGALDYAGFARADMVIEAVIEDIPLKQKIFADLEKACRPDAILSTNTSTIDIELVGAKMSGGAAARRRLLGAHFFSPAHIMPLLEIVRTKDTGAQVGAWGACGRGLRGRRAVVEWARRGLLVEAHACDRTPQLENSRNTRWVTVATERITAPVHPLLQLNDLVGSDIGLHVGANFVTSFPDRVYVSRLIPALNEAKRLGEKTGKGFYKFDAKTRKASPDPEGLAPLLEGSRREAALVPAGAKPPALSDQDILDWIFFPVVNEGCRVVAEGIVDKAADLDVASVMAMGFPPVRGGLIFWADLVGAPRIVARLKQFAAMHAGFFAPCDYLLQAAASGRKLSAGPPAAAKL

SEQ ID NO: 7324 - protein, 404 aa, Neisseria gonorrhoeae FA 1090
MDKFPKSAKLDHVCYDIRGPVHKKALQLEEEGNKILKLNIGNPAPFGFEAPDEILVDVIRNLPTSQGYCDSKGLYSARKAIVHYYQNKGLRDITVNDVYIGNGVSELIAMSMQALLNDGDEILIPAPDYPLWTAAATLAGGTVRHYLCDEENGWFPNLADMEAKITSKTKAIVVINPNNPTGAVYSKEILLEIAELARKHGLIIFADEIYDKILYDGAVHYHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYHQ

SEQ ID NO: 7325 - protein, 515 aa, Escherichia coli CFT073
MMADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDAVRGFGGEVLLHGANFDEAKAKAIELSQQQGFTWVPPFDHPMVIAGQGTLALELLQQDAHLDRVFVPVGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIAQHNIRGERLAHILSGANVNFHGLRYVSERCELGEQREALLAVTIPEVKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTHWNISLFHYRSHGTDYGRVLAAFELGDHEPDFETRLNELGYDCHDETNNPAFRFFLAG

SEQ ID NO: 7326 - protein, 396 aa, Bacillus sp. SG-1
MGYTHVFILLLIGYVVFTIDKKQKNFPVPMVLLLIGIGLSFTPFFADIEITKDMIFDVFLPALLFVSAYQFKINGLKKNMGVISVLSTLGLILTVFILGASVYFVGIVSLSFMGALLIAAILTPTDPVSVVSILKKSSNSPKIAEVVEGESMVNDGTSVVLFTVISHLYLSNEELKLVSALWSFVSVSFGGLLIGIVFGWLVSRIYHFTHHRQYQVMLSIVLAYGSFYLAEHLGVSGVLASVSSGIMLSWKLQTTDNEKDYRSYLDAFWEVIEPSILSILFLLIGIEFMKHIDFQNIGFTFIIFGLSLIVRFVVLAGILKLFKKWRKEFLWDDISLITWSGIKGTMSVALLLGLASESTGQADAILSLTYGAIVLSLIIQSPLVYPLSRMFSKHSR

SEQ ID NO: 7327 - protein, 339 aa, Zea mays
  misc_feature (113)..(113): Xaa can be any naturally occurring amino acid
  misc_feature (175)..(175): Xaa can be any naturally occurring amino acid
  misc_feature (190)..(190): Xaa can be any naturally occurring amino acid
  misc_feature (209)..(209): Xaa can be any naturally occurring amino acid
MKAVGYNLYDSSGTDDDLPPAQNRGLRGRVFSGNGRASAGAFPYMRANNDLESEIHRVERDAYTGVLRAFKVQSDAISWEKESLITELRKELRVSDEEHRELLNKVNEDGSIXQMGELRQAGGIPSGLHRGNRVLYDAEPGPTTKRQRASHSIPSQSAAVQSPMMPSHSVSSAKXGPLSARGKKAKMVNXKFAWLIITLPLIIQLKIDXTLLKQMAPEDIRWEFDGHLSNHDGWGPSGPMLKRHMTNNGAMAGSIRGRGRLSINEPIKDYAPPQNDINRNFDYIDIPNTESVVTEVERVLANPNMPEIEKARKLLKDQEQSLLDAIARLDEASDSDSGN

SEQ ID NO: 7328 - protein, 347 aa, Guillardia theta
MKLLLYDDLKTLFNYKIKKKNNTIVHFLYLLYENVHESLNINNTRNFLWCFMIKFSVEIKKRIKFDYKSCHINFYSFFDNLLEAGNVLNFEKLILNILFNFRKIQFLYIPFTNVMKVQTEINKNMRKILIDWIIDVHHKFKLLSKTLFLTINIIDRFLCLKKIGKQKLQLLGITSMFIASKYEEIYAPEIRDFIYICDNAYSKEDIIKMEQLICFVLRFKFNLPSPQSFLSLWMKILCLKLDSIFFSNKCLELCLIEINTLRYNFEIISLSCIFLSLKFSGNISLKILMNIFRIDSKKNFSLVKSCGLIGSLLLLYQSSYCGQNHLHFKYSSNKHKEFMSRRFHIYF

SEQ ID NO: 7329 - protein, 258 aa, Triticum aestivum
  misc_feature (202)..(202): Xaa can be any naturally occurring amino acid
  misc_feature (226)..(226): Xaa can be any naturally occurring amino acid
HYRTSLYKKAGWYRSGIPGISSTHASAQEVAAPAATATKEPSANGNGTNGTPAAAPKTKAPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKEXLPPHRLAEIRRFFEDYQKNENQEXVAVNDFPAVGGTPTRPSSTPWDPYATQPLRGA

SEQ ID NO: 7330 - protein, 812 aa, Physcomitrella patens subsp. patens
MTMPEHVHGRKGTKRDFTTAILERKKATNRLVVDEAVNDDNSVVALNTETMDKLQLFRGDTVLIKGKKRKDTVCIVLADETCEEPKIRMNKVVRANLRVRLGDVVSVHQCADVKYGKRIHVLPLDDSVEGVTGNIFDAYLKPYFMEAYRPVRKGDLFLVRGGMRSIEFKVIETDPAEYCIVAPDTEIFCEGEPVKREDEERLNEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTQGEVERRIVSQLLTLMDGLKSRAHVIVMGATNRPNSIDPALRRFGRFDREIDIGVPDEVGRLEVLRIHSKNMKLAEDVDLEKVAKETHGFVGADLAALATEAALQCIREKMDVIDLEEDSIDAEILNSMAVTNEHFQTALGTSNPSALRETVVEVPNVTWEDVGGLDNVKRELQETVQYPVEHPEKFEKFGMSPSKGVLFYGPPGCGKTMLAKAIANECQANFISVKGPELLTMWFGESEANVREIFDKARGSAPCVLFFDELDSIATQRGGSGGDAGGAADRVLNQLLTEMDGMNAKKTVFIIGATNRPDIIDSALLRPGRLDQLIYIPLPDEASRLRIFQACLRKSPIAKEVDLEALARHTQGFSGADITEICQRACKYAIRENIEKDIEKEKKRAENPEAMEEDETDEVSEIKAAHFEESMKFARRSVSDADIRKYQAFAQTLQQSRGFGSEFRFPDRPATAPGTTASAAVGGESAFAAAAADEDDLYN

SEQ ID NO: 7331 - protein, 626 aa, Wigglesworthia glossinidia endosymbiont of Glossina brevipalpis
MNNSKNKNEIKFSILKKINNPIELRKLPKKKLIFLCEELREFLIDSVSSSSGHFASGLGVIELTVALHYIYNTPFDYLVWDVGHQAYPHKIITGRRDQIRSIRKKNGLHPFPFREESEYDILSVGHSSTSISASLGMSISARKEGMGRKVVSVIGDGAITSGMAFEAMNHAGDIKSDLLIVLNDNEMSISENVGALNKYSNNFISKKIFPFLKKNGEKLLNKIPRFKKIIEILENKINNYFSPKYLFEELGFNYSGPYNGHDVLLLSNILKKLRLKKGPNILHVITKKGMGYAPAEKDPIGWHAVPKFNLQIGIPPKKQNSLNTYSSIFGKWLCDTAKKDKKLIAITPAMREGSGLVNFSKMYPNQYFDVAIAEQHAVTFAAGLAIGGYKPIVAIYSTFLQRAYDQIIHDIAIQKLPVLFAIDRAGIVGPDGPTHQGFLDLSYLRCIPNMIIMTPSDENECRLMLHTGYQQLGPSAVRYPRGYGIGVKFSNLYKIPLGKGIVLRKGKKIAILNFGVLLIQANIVAKELDATLVDMRFVKPLDNLLLIRMAKTHKALITIEENVIMGGAGSAVNEFIMYNKLLVPVLNIGIPDNFVSHGSQTEVRSSLGLDSIGIKEKIKNWLNFLV

SEQ ID NO: 7332 - protein, 300 aa, Wigglesworthia glossinidia endosymbiont of Glossina brevipalpis
MNNFLLSLTKIQNHINLILKKYLNIFSKKNMNLTLAMKYALLNGGKRLRAFLVYCIGKMLNVSSNNLDCIAASIECIHAYSLIHDDLPSMDNDRFRRGRESCHVKFNEYIAILAGDSLQSLAFNILSTVNMPDVSVNNRMKMISILSYASGAKGMCLGQSLDLENQGSLISIKQLEEIYKYKTSFLIYAATRMTILSSNIKNKKILINLIKYSKSIGLAFQIQDDILNVIGSKKITGKCQGSDKKLNKNTYSSLIGIKLSKEKAFNLYKKSLSYLEYINELGYNTESLIKLAHYIIIRNK

SEQ ID NO: 7333 - protein, 575 aa, Erwinia carotovora subsp. atroseptica SCRI1043
MISGILVSPGIAFGKALLLKEDEILINRKKISADQVEQEIERFLTGRSKASAQLEAIKKKAGETLGAEKEAIFEGHIMLLEDEEFEQEIIALIKDEHASADAAAFSVIENQAKALEELDDEYLKERAADMRDIGKRLLRNILNMAIVDLGDIQDEVILVATDLTPSETAQLNLDKVLGFITDIGGRTSHTSIMARSLELPAIVGTTDVTRQVKNGDYLILDAVNNKIYQNPTADKIEELKAVQQQYHAEKYELAKLKDLPAITLDGHQVEVCANIGTVRDVAGAERNGAEGVGLYRTEFLFMDRDSLPTEEEQFQAYKAVAEAVGAQAVIVRTMDIGGDKDLPYMDLPKEENPFLGWRAIRICLDRKEILHAQLRAILRASNFGKLRIMFPMIISVEEVRELKAELEMLKAQLREEGKVFDESIEVGVMVETPAAAVIAPHLAKEVDFFSIGTNDLTQYTLAVDRGNELISHLYNPMSPAVLTLIKQVIDASHAEGKWTGMCGELAGDERATLLLLGMGLDEFSMSAISIPSIKKIIRNANYEDAKALAEQALAQPTAQELSNLVSRFIKEKTLC

SEQ ID NO: 7334 - protein, 517 aa, Solibacter usitatus Ellin6076
MRHLFEQLEKLASRLREGGGAARIEKQHKAGKLTARERIAALLDPGSPLLEIGLLIAYDRYDGQAPAAGVVTCVGRIEGRPAVIVANDATVKAGAWWPETITKILRAQEIAMRNRLPIVYMVDSAGVNLPYQDSIFPGQYGAGRIFYYNSVMRRKLRIPQIAAVMGPCIAGGAYLPALSDVIFMVEGTSFMGLGGPNLVKGATGHVIDSEPLGGARLHTSVSGVAHYMPKDDAECLRMIRERFRQLPAPSPAPTGATAPARDAAQIYGALPADHRLPYEMEDVIFRIFDAADYREFQPEIAPEMLCANARLNGRPVAVIANRRGFLKAQGKPRIGGIIYTESARKVAYFVENAERAGTPLVYLQDVSGFMVGPEAEKEGIIRAGAEMVETMACTTVPKIVLTLNHASGAGYYAMAGQGFDPNFTFNWPTARIGVMEGDSAVVALFSAELEKYKGVEMPEELKAAVERTRADYERWLDARYAAARGHCDAIIDPLGTRETLAFALEACMQHGCGTERA

SEQ ID NO: 7335 - protein, 366 aa, delta proteobacterium MLMS-1
MPASPAATANDKELGEIRRQIDAIDDQFLDLLRRRIRLAREVGAIKSRNHRAKWDPQREREILSRLLAENNGEFPEPALVTVIQEIIATCRLSQKEIEIAYLGPEATFSHLAGVKHFGSAASFRPMETIEDTFIEVERERVNYGIVPVENSIEGAVTSTLDAFRNHRVRICGELNLAISHNLVNQSGRREDVRQVVSHSQPLAQCRQWLQRNLPEIPRQSVISTGVAAKMAAEDPGVAAIASSLAVRTYQLQMVVKGIEDYRGNTTRFLLLGKQSPTPSGDDKTSLLVALRDKPGALYEALSLLAAHDINLTRIESRPQKDEPGRYLFFIDLLGHIEQEPIRQACDNLRQTCSLFEWLGSYPRFRD

SEQ ID NO: 7336 - protein, 322 aa, Erwinia carotovora subsp. atroseptica SCRI1043
MSKIYEDNSFTIGHTPLVRLNRIGNGRILAKVESRNPSFSVKCRIGSNLIWDAEKRGVLKPGIELVEPTSGNTGIALAYVAAARGYKLTLTMPETMSIERRKLLKALGANLVLTEGAKGMKGAIAKAEEIVASDPSRYLLLQQFSNPANPEIHEKTTGPEIWEDTDGEVDVFISGVGTGGTLTGVSRYLKNTKGKAIISVAVEPTDSPVISQALAGEELKPGPHKIQGIGAGFIPGNLDLELIDRVEKVTNEEAISTARRLMEEEGILAGISSGAAVAAALNLLKEKEFDGKTIVVILPSSGERYLSTALFADLFTEQELQQ

SEQ ID NO: 7337 - protein, 218 aa, Solibacter usitatus Ellin6076
MFRAIREQIDTIFREDPAAKSVLEIVLCYPGFQAILLHRVAHRLYGWGWPLLPRVISQFSRFFTGIEIHPGATIGRRFFIDHGSGVVIGETTEIGDDVLLYQGVTLGGTGNEKGKRHPTIGNSVVVGTGAKILGNIRIGDNVKVGAGSVVVHPVPDNSTVVGIPGRVVRIRPEGGTLEHGRLPDPEGQAIDDLARRVAELESMLRKMIAEHEVEHHRQ

SEQ ID NO: 7338 - protein, 336 aa, Neisseria meningitidis MC58
MNDNTHTLPPRHLSVAPMLDWTDRHYRYLARQITRNTWLYSEMVNAGAIVYGDKDRFLMFNEGEQPVALQLGGSDPSDLAKAAKAAEAYGYNEVNLNCGCPSPRVQKGSFGACLMNEVGLVADCLNAMQDAVKIPVTVKHRIGVDRQTEYQTVADFVGTLRDKTACKTFIVHARNAWLDGLSPKENRDVPPLKYDYVYRLKQEFPGLEIIINGGITTNEAIAGHLQHVDGVMVGREAYHNPMVMREWDRLFYGDTRSPIEYADLVQRLYTYSQAQIQAGRGTILRHIVRHSLGLMHGLKGARTWRRMLSDATLLKDNDGSLILEAWKEVERANMRE

SEQ ID NO: 7339 - protein, 710 aa, Oryza sativa Japonica Group
MAAGRHGGYRDYEARERELDAEASRRSKEQQHHHHPSGRHQRGDSDPRCEADRRRDGGRSRGGRELSNGYGHRRSPPPRSRLSARLGDREPGEVLSGSASDDSGGRPHRARENGVSSSSRDGESVVAASASSPSKKRKFSPIIWDRDSPKPMHSDVAKGKKAVDSVPTELPLPPPPPLPPQDHIPERLAVEKSPMDVEPAVASESPEQLQEHAESRVMEEEEEYSTMRNISTSRWAGANDDEEEGAPHRKKKSASPADSAELGQRKKALSPELGEVVASDISGGRTMSRSSDSGRLGADENEDLEVDKDDYMDVDRDDDGNSDIANHQSGMDSEYEVRRSETPEPVKPPHRCINMLQGCRSVDEFERLNKINEGTYGVVYRARDKKTGEIVALKKVKMEKEREGFPLTSLREINILLSFHHPSIVDVKEVVVGSSLDSIFMVMEYMEHDLKGVMEAMKQPYSQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPNEKIWPGYAKLPGVKVNFVKQPYNRLRDKFPAASFSGRPILSEAGFDLLNNLLTYDPEKRLSADAALQHEWFREVPLPKSKDFMPTFPALNELDRRTKRYLKSPDPLEEQRLKELQGNIGNRGLFG

SEQ ID NO: 7340 - protein, 609 aa, Enterococcus casseliflavus
MTFSQKDRKETIQETAKTTYDVLIIGGGITGAGVAVQTAAAGMKTVLLEMQDFAEGTSSRSTKLVHGGIRYLKTFDVEVVADTVRERAIVQQIAPHIPKPDPMLLPIYDEPGATFSLFSVKVAMDLYDRLANVTGSKYENYLLTKEEVLAREPQLQAENLVGGGVYLDFRNNDARLVIENIKRAQADGAAMISKAKVVGILHDEQGIINGVEVEDQLTNERFEVHAKVVINTTGPWSDIVRQLDKNDELPPQMRPTKGVHLVVDREKLKVPQPTYFDTGKNDGRMVFVVPRENKTYFGTTDTDYTGDFAHPTVTQEDVDYLLTIVNERFPHAQITLDDIEASWAGLRPLITNNGGSDYNGGGKGKLSDESFEQIVESVKEYLADERQRPVVEKAVKQAQERVEASKVDPSQVSRGSSLERSKDGLLTLAGGKITDYRLMAEGAVKRINELLQESGASFELVDSTTYPVSGGELDAANVEEELAKLADQAQTAGFNEAAATYLAHLYGSNLPQVLNYKTKFEGLDEKESTALNYSLHEEMVLTPVDYLLRRTNHILFMRDTLDDVKAGVVAAMTDFFGWSEEEKAAHVLELNQVIAESDLTALKGGKKDE

SEQ ID NO: 7341 - protein, 283 aa, Bacillus sp. SG-1
MKIAYLGPQASFTDLAVRKAFPKRETVPCVTIPDCIEAVIEEKVDYAVVPLENALEGSVHITVDYLFHEENLSIVAELTSPIQQHFMVHPKHFDCGIKPDKILSHSHALAQCHKFLHSNFRDTPLEQTTSTSAAAKYLSEHPEENLASIGNELSAREYGLKILHENIHDFAYNHTRFIVLHKKPVRLQLLNKKSTEKTSLMVTLPKDRSGALHQVLSAFAWRQLNLSKIESRPLKTGLGDYFFLIDVDQSMDDILLPGAIREMEALGCEVKMIGTYSCYLLND

SEQ ID NO: 7342 - protein, 172 aa, Nostoc punctiforme PCC 73102
MKHTLSVLVEDEAGVLSRISGLFARRGFNIESLAVGPAEQGGVSRITMVVPGDDRVIEQLTKQLYKLVNVLKVQDITETPCVERELMLLKVNASSSNRSEVIELSQIFRARVVDVAEDSLTLEVVGDPGKMVAIVQVLQKFGLREIARTGKIALTRESGVNTELLKSLEAKV

SEQ ID NO: 7343 - protein, 288 aa, Crocosphaera watsonii WH 8501
MVISLAHLGPVGTNAETAALAYAHWLEKTQAKSCLLCPCPSIAQTLHSVAQGDTKKAVVPVENSTEGSVACTLDTLWKLDHLKIQQELVLPIIHALFSRGSSINGIKTVYSHPQALAQCQRWLQEHLPDIALIPTNSTAEALDKISLEPTAGAIAAPRAAKLYNVPILANHINDYPDNCTRFWVMTLDPTPTVSSRISLAFSVSENVPGSLMKPLQVFSERNINLSRIESRPTKRSLGEYLFYLDIEGNHEDPNIINALDALTHHTEIIKIYGSYPVLFLEETDIEQL

SEQ ID NO: 7344 - protein, 310 aa, Saccharum officinarum
MSEQRGYRVTFDPSNIVLTAGATSANEALMFCLADHGDAFLIPTPYYPGFDRDLKWRTGAEIVPVHCTSGNGFRVTRAALDDAYRRAQKQRLRVKGVLITNPSNPLGTTSPRADLEMLVDFVAAKGIHLVSDEIYSGTAFAEPGFVSVLEVVAARVNADGLLSERVHVVYSLSKDLGLPGFRVGAIYSSNAGVVSAATKMSSFGLVSSQTQHLLASLLGDRDFARRYIAENTRRIKARRDQLAEGLAAIRGIECLGSNAGLFCWVNMRGLMRTPSFEGEMELWKKVVFEVGLNISPGSSCHCREPGWFRV

SEQ ID NO: 7345 - protein, 372 aa, Clostridium tetani E88
MKGLCTYMKLGIVGLPNVGKSTLFNAITSAGAEAANYPFCTIEPNVGVVTVPDKRLDVLEKMYNTKRKLYATIEFYDIAGLVKGASKGEGLGNKFLSHIREVESIVHVVRCFDDGNVVHVEGNVDPVRDIETINLELILSDIEALQRRMERTTKAFRSGDKNAKLEMELMEKLKAHLEAEKPVRTFDATEDEKEIIKGLFLITSKPVLYVCNLSEEDLISGNLENEYVKKVKEYAKGEEAEVVAISAKIEEELSTLEEEEKLEMLKEYGIEEPGLYKLIQASYKLLGLISYLTAGVQEVRAWTIKEGTKAPGAAGKIHTDFERGFIRAEVVSYDELVECGSEAAAKEKGCYRLEGKEYVVKDGDVILFRFNV

SEQ ID NO: 7346 - protein, 131 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 7347 - protein, 497 aa, Vibrio vulnificus CMCP6
MTQSVPLFIQGSFVESQSNEWIDVTNPATGEVIARLPCATPAEMTNAITSASEAFQSWKEVAVSERARLMLRYQHLLKENHDALAQLLSQETGKTLADAKGDVWRGIEVVEQAANIASNMMGETVENVATDIDSYSLIQPLGVCCGITPFNFPAMIPLWMFPIAIASGNTFVLKPSEQVPLTSVRLAQLFADAGAPDGVLQIVHGGKAQVDFLLTHPDVRAVSFVGSVPTAQYIYQTATQNFKRVQAFAGAKNHMVVMPDANKAQVLSNLVGASVGAAGQRCMAISVAVLVGDAKHWVADIKAELATVKPGAWDDATAAYGPLISAAAKQRVLGLIAEGKAQGAVCELDGSQCQVAGYPNGNWVGPTLFSGVTTEMSIYQQEIFGPVLVCLEVDSLEEAIALINRNPYGNGTSIFTANGAAARKFQHQIQVGQVGINVPIPVPLPFFSFTGWRGSFYGDLHAYGKQAVRFYTETKTVTARWFEEDMPSGPNMTIQLR

SEQ ID NO: 7348 - protein, 525 aa, Novosphingobium aromaticivorans DSM 12444
MFGRVKPLDAILATAEKKSLHRSLGPVQLTLLGVGAIIGTGIFVLTAAAAQKAGPGMMWSFVIAGFVCAVAALCYSELASMVPVSGSAYTYSYAVVGEMLAWMVGWALILEYAVAASAVSVGWSGYFMGLLKSLTGFELPAMLQAGPTWTMNGLLPHADFSTGLINVPAIVVALLVTWLLMLGTKESATFNAILVAIKVAALTMFIVLTLPAIEREHFAPFAPNGWFGPAGTTGMGIVGAASSIFFAYVGFDAVSTAAEETKNPQRNVPIGLIGSLAICTVFYLLVAAGAIGSIGAQPTALGVAPGSAEFTQQCAALLASGQEPLVCSNEALAHVLRAINYTYAGDLIGLAANLALPSVILMMLYGQTRIFFVMARDGLLPEKLATVHPKWKTPHIVTAMTGVFVAIAAALLPVGQLADISNSGTLFAFFMVAIAVMLLRARDPNRVRPFRTPAVWVVGPIAAIGCIFLYWNLPFEAKMVLPVWGAIGLVFYFAYGYRKSHVGQGHVEVHEGDADVPPMPVPPID

SEQ ID NO: 7349 - protein, 324 aa, Rhizobium leguminosarum bv. viciae 3841
MSTPQAPIGSGFGAASTAADVIAGHDLLGKVAIVTGGYSGLGRETARVLAEAGARVVVPARNLGKAKAAVESIPGLAVEKLDLMDPGSIDDFADRFLESGEPLHLLINNAAVMANPLTRDARGYESQFSTNHLGHFQLTARLWPALVKAEGARVIAVSSRGHVFSGVDFDDPNFENREYAPYLAYGQSKTANALFAISLDALGAKHGVRAFSLHPGGIVTTNLVRHQSSDFLKASGYVDEDGKPVIDPENNKKTIEQGASTTVWCAVSEKLEGLGGVYCENCDIAAAVPGDSTEMLGVRPWATDPEFAERLWQLSERLTGFITS

SEQ ID NO: 7350 - protein, 397 aa, Rhodopirellula baltica SH 1
MAKKTIDQIDVQDKTVLMRVDFNVPLDESLAITDDRRIRMALPSIKSVIDRGGKVILMSHLGRPTGGEGDEKYSLAPAAKRLGELLGSTVHFATDTVGDDASSKASSLAAGEVLVLENLRFNPGEKKGDSEFAGKLAAMADAYCNDAFGTCHRKDASMVAVPEAMAGKPRVVGHLVAKEIQYLTDAISKPERPFVAILGGAKVSDKINVINNLLGICDAVLIGGAMAYTFSLASGGKVGKSLVEKDKVELAKELMAKGGDKLQLPVDTHCGDDFGNIAGCNKKVVAAGEIPDDMEGLDIGPETAKKYAEVIKSAKTIVWNGPMGVFEKPPMDEGTKAVAQAIADGDAVSIIGGGDSAAAVDQLGFADDVSHVSTGGGASLAMLEGQAFAAVDLLDEA

SEQ ID NO: 7351 - protein, 221 aa, Zea mays
  misc_feature (198)..(198): Xaa can be any naturally occurring amino acid
MVKICCLGAGYVGGPTMAVIALKCPDIQVVVVDITKSRIDAWNSDTLPIYEPGLDEVVKQCRGKNLFFSNDIEKHVSEADIIFVSVNTPTKTRGLGAGKAADLTYWESAARMIADVAKSDKIVVEKSTVPVKTAEAIEKILTHNSNGINFQILSNPEFLAEGTAIQDLFNPDRVLIGGRETPEGQKAVQTLKAVYAHXVPEDQILTTNLCPAELSKLAANA

SEQ ID NO: 7352 - protein, 510 aa, Oryza sativa
MICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIHPPKTYFEKIQAVLKKYDILLIADEVITAFGRLGTMFGCDMYDIKPDLVSIAKALSSAYMPIGAILVSPEITDVIYSQNNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRG

SEQ ID NO: 7353 - protein, 521 aa, Bordetella pertussis Tohama I
MPTPLPSSSAWLAFADAARHSSRRGARLRVIEAAGLRVDLTAQAHSDDLDSAAEDLLAQQDFDNARAQLFDGGPANWTEHRPAWHTALRAARPPTPVAGAILGERDRLRRFVQDADMRGAYRHVLHLGIGGSDWGPRMVTRALRHNGLKREVRFASNVDSHAVADALHHLDPHDTLIIVASKSFTTTEPLANAEVAMNWLRNAGVADPVRQVVAITANVDAALDFGISPQHIFRFWDWVGGRYSLWSAIGLPVALALGCDALDELLAGAAAMDQHFLHTPMRRNAPLQMALAGVANRSVLGYGSLAITPYDSRLTHLVPWAQQLEMESLGKVAGHDGSPAGVPTGPVVWGMTGTDCQHTFFQWLHQDTAGAPVDFIVCEQADHPYDHFHKLLIANCLAQRAALLRGKPFDEALKEARLVESDPQQAEILAHHRVHPGGRPSTLIMLPRLSAHALGALLAMYEHKVFAQGVLWGINPFDQWGVEYGKALARNIIRELENPSSEVNQQDPSTRYWIDALRKQP

SEQ ID NO: 7354 - protein, 217 aa, Erwinia carotovora subsp. atroseptica SCRI1043
MNQTLLSEFGNPTERVERALDALRHGRGVLVLDDEDRENEGDMIFSAESMTVEQMALTIRHGSGIVCLCLTEERRQQLELPMMVEKNSSHYQTAFTVTIEAAEGVTTGVSAADRLTTIRAAIADNARPSDLNRPGHVFPLRAQPGGVLTRGGHTEATVDLMTLAGLKPSGVLCELTNDDGSMAHAPEVIAFAKQHDMLVLTIEDLVAYRIAAERKAS

SEQ ID NO: 7355 - protein, 420 aa, Escherichia coli CFT073
MSFATISVIGLGYIGLPTAAAFASRQKQVIGVDINQHAVDTINRGEIHIVEPDLASVVKTAVEGGFLRASTTPVEADAWLIAVPTPFKGDHEPDMTYVESAARSIAPVLKKGALVILESTSPVGSTEKMAEWLAEMRPDLTFPQQVGELADVNIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPFWVIDQVKAAVADCLAATDKRASELKIACFGLAFKPNIDDLRESPAMEIAELIAQWHSGETLVVEPNIHELPKKLTGLCTLAQLDEALATADVLVMLVDHSQFKVINGDNVHQQYVVDAKGVWR

SEQ ID NO: 7356 - protein, 282 aa, Physcomitrella patens subsp. patens
MNEASGGLTQSQHDTLTKFREILSEQGLLRKRDDDHTLLRFLRARGFDIPKAKAMFEVMLEWRAEIGADTIRETFEFPERKAVRDLYPHFHHKTDKLGRPVYIERLGQLNVDELLKLTTMDRMLLYHVKEWEVLLNSKFPACSEKAGTCVSQSLAILDLKGVNMKHMSKQVRHFIQKITKVDQDYYPECLGKMFIVNAPTAFKAMWAVIKPWLDKRTQKKIELHGGHFSSRLLELVDCENLPEFLGGSCNCLGGCENSDAGPWNEAPNCSDALYDEPCNADE

SEQ ID NO: 7357 - protein, 555 aa, Leptospira interrogans serovar Lai str. 56601
MKGSLMSEAKYSLENPFQSTSEPEVLKPRGLYEEANELGKELLNKPLLGGGVDRILVQHSKDRMTVWERIKVLTDQEPNILYQNWGKSLDGASLVTGILNINGRDVAVYGHDFTLRAGSMDATNGSKLARLIYMAGEHGIPLIGMNDSAGAYVPAGVGGLDGYSEAFTALRKISGVVPSLMLMFGFNAGGGAYLPRQGSFMIQCDNTFFGLTGPGVVKSVLGEDISADDLGGPKVHGQSGVVDIVTGDELGSLRTALRLLSYLPDNNHSFAPFHATSDPTNRFIYEEEILFKKTFNSPTGMNTPFDITLYLQNICDHGQYFEIQGQRSRNLVTAFGRIGGHVVAFVANNSAVASGQIDIGAARKGTRFIRFCNLYNIPIVFLEDTTGFLPGKEQEQNGIVLEGRKLLDSIIDIRTPRLTLIIRNAFGGAYACFNSYHTGADMVFALPTARIAVMGPAGKDYVYKDEVSSIQKEYQENVKKGMSEKEAIVIRDKKLQTLSTQYEKELMNPKEALSLGSVSRIVLPGTTRNILFQNLDYLIRHYKPAPLSGPQREFE

SEQ ID NO: 7358 - protein, 410 aa, Physcomitrella patens subsp. patens
MTQAVIDAEARLFVPTYVRSPVVFERGEGCKLYDTEGKEYLDLAAGIAVNSLGHGDPTWLKAINDQAANLAHVSNLYHTVPQVKLAERLVKWSFADRVFFTNSGTEANDAAIKFARKYQTVISNRKGDTRWIKFGKLRPASELVSFSSGFHGRTSGAQSHFSKLNLEPLAPGAHCVEFGDLETTAKAIRRDRTAAVLVEPIQGEGGVHTASAEFLRGLRRLCDEAGALLIFDEVQCGLGRTGLLWAHQAYGVQPDMMTLAKPLAGGLPIGAVLVTEAVASTISAGDHGSTFAGGPLVCQAALSVLDRIQAPGFLEHVAAKGGHLRAQLREKIGTNPHVKEIRGVGLLIGVELDVPAAPLVEAALQAGLLILTAGNGYVVKLAPPLTISEAELNRAVDIIAGCMSSLFLNL

SEQ ID NO: 7359 - protein, 472 aa, Neisseria meningitidis MC58
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 7360 - protein, 724 aa, Mentha x piperita
MASSCGVIKSSFLPSLHSEDSTFLSRAPTSLPLKNHKLNVVAALQQDSSNDVVPSGDRLSRPKSRALSFTGEKPPIPILDTINYPNHMKNLSVEELANLADELREEIVYTVSKTGGHLSSSLGVSELTVALHHVFNTPDDKIIWDVGHQAYPHKILTGRRARMHTIRQTFGLAGFPKRDESAHDAFGAGHSSTSISAGLGMAVARDLLQKNNHVISVIGDGAMTAGQAYEALNNAGFLDSNLIIVLNDNKQVSLPTATVDGPAPPVGALSKALTKLQASRKFRQLREAAKSMTKQMGAPAHEIASKLTQYVKGMMGKPGASLFEELGIYYIGPVDGHNVEDLVYIFKKVKEMPAPGPVLIHIITEKGKGYPPAEIAADKMHGVVKFDAKTGKQMKTKNKTKSYTQYFAESLVAEAEHDDKIVAIHAAMGGGTGLNIFQKQFPDRCFDVGIAEQHAVTFAAGMAAEGLKPFCAIYSSFLQRGYDQVVHDVDLQKLPVRFMMDRAGVVGADGPTHCGAFDTTYMACLPNMVVMAPSDEAELMNMIATAAIIDDRPSCVRYPRGNGIGVALPSNNKGTPLEIGKGRILKEGSKVAILGFGTIVQNCMAAANLLEQHGISVTVADARFCKPLDGDLIKKLVQEHEVLITVEEGSIGGFSAHISHFLSLNGLLDGNLKWRPMVLPDRYIDHGAQSDQIEEAGLSPKHIAGTVVSLIGGGKDSLHLINNL

SEQ ID NO: 7361 - protein, 612 aa, Streptomyces seoulensis
MAVSVTLPALGESVTEGTVTRWLKAEGERVEADEPLLEVSTDKVDTEIPSPVAGVLASIKVAEDETVEVGAELALIDDGSGAPAAEAPAAEAPAAEAPAPAAEEAPQSAPSTEQEAPAEAPTAEAASGGGSAEGTDVVLPALGESVTEGTVTRWLKSVGDSVEADEPLLEVSTDKVDTEIPAPTSGTLLEIVVGEDETAEVGAKLAVIGAAGAAPAAAPEAPKAPAAEAPAAPAPAAPAPAAPAAPAPQAPAPQAPSAPAPQQQTAPAPDPAPAAPAPAPAPAPAQAPAAAPSAPTATQATDEGAYVTPLVRKLAAESSVDLASVKGTGVGGRIRKQDVIAAAEAAKAAAAPAPAAAQAPAAAKKAPALEASPLRGQTVKMTRIRKVIGDNMVKALTEQAQLSSVVEVDVTRLMKLRGKAKDSFAAREGVKLSPMPFFVKAAAQALKAHPVINARINEAEGTITYFDTENVGIAVDSEKGLMTPVIKHAGDLNLAGIAKATAELAGKVRANKITPDELSGATFTISNTGSRGALFDTIIVPPNQVAILGIGATVKRPAVLETEEGTVIAVRDMTYLTLSYDHRLVDGADAARYLTTVKQILEAGEFEVELGL

SEQ ID NO: 7362 - protein, 390 aa, Carboxydothermus hydrogenoformans Z-2901
MLEATRVRNLPPYLFARIERLIAEKKEAGVDVISLGIGDPDTPTPKHIIEELYLAAQNPENHQYPSSVGMLSYRQAVAAWYARRFGVELDPKTEVVSLLGSKEGIAHISWCYVDPGDLVLVPDPGYPVYEGGTILAGGTTYKMPLKPENGFLPDLDSIPEEVARKAKLMFINYPNNPTGAVADLGFFEKVVHFAKKYEILVCHDAAYSEITFDGYRAPSFLEVKGAKDVGIEFHSLSKTYNMTGWRIGWAVGNAKAIDALGRLKSNIDSGVFQAIQYAGIKALEGPQDVVKELCDLYAQRRDLVIETLNKLGWNLSKPKGTFYIWAPVPKGFTSASFAEYLIEKAGVVITPGNGYGTNGEGYFRISLTIPTSRLKEALQRIEQHLGKVEF

SEQ ID NO: 7363 - protein, 338 aa, Lentisphaera araneosa HTCC2155
MKKILVTGGAGYIGSHTCLELLNSGYEVVVVDDLSNSVTESLTRVEQLANGKKIKFHKVDLLDKEALNEVFVKEGNVHAVIHFAAKKAVGESVEKPLYYYSNNITGSLNLFEVMKANNVDKIVFSSSATVYGDPESVPIKEDAHIGATNPYGHTKAMMEQILMDTGKATDWGVALLRYFNPVGAHESGTIGEDPEYPNNLLPFVSQVAAGIREQVTIFGDDYDTPDGTGVRDYIHVVDLAQAHVKSIEKLDTQDKGTLIYNIGTGRGYSVKEMVEAFRRISGQEIKAVVGPRREGDIGECTADATLANNDLAWHAKYDLDDMIASAWKWQSENPNGYK

SEQ ID NO: 7364 - protein, 534 aa, Vibrio vulnificus CMCP6
MAVLPTKARKEDALYQSNYQTLAELVRKLSANLNLVHQGGGVKAQQRQREKGKLPVRERIAKLLDENTSLLEIGQFAAWNVYDEPIACAGVVAGIGQIQGIECMVIANDPSVKGGTYFPLTVKKHLRAQEIAMKCQLPCVYLVDSGGANLPHQAEVFPDKDHFGRIFYNQARMSAAGIPQIAVVLGPCTAGGAYIPAMADVSIIVRQQGTIFLGGPPLVKAATGEIVSEEELGGADVHCKKSGVADYYALDEQHALQLARQAIESCNAPALPCAPKAVLEPRYPADEIYGVVNANLRLSFDVREVIARMVDDSDFDEFKAMYGPSLVCGFAHLLGFPIGIVANNGILFSESAQKGAHFIELCAKRKIPLLFLQNITGFMVGKKVEAEGIAKHGAKLVMAVACADVPKFTVIIGGSYGAGNYGMCGRAYDPTMLWMWPNARISVMGGEQAAGVLTQVRRDVKARQGEHWPEQDEHDYRQSILELYESQGNPYYASARLWDDGIIDPVETRAIVGRALRASLNAPIGDSEFGIFRM

SEQ ID NO: 7365 - protein, 477 aa, Neisseria gonorrhoeae FA 1090
MNEYSQLIKHPDISLSPISDGIGVGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALAVLAYEAGVPQDLLPVVSGRASEISHEFATNPTVRKISFTGSTEVGAKIFAGSAADIKKLSLELGGNAPFIVFDDADLDKAVEGALASKFRNSGQTCVCTNRVYVQSGIYDVFCRKLSEKAAALKLGDGLDEGVNQGPLIEEKAVEKVEQHIADALSKGAVCLTGGKRSALGGTFFEPTVLSGVTAQMAVAREETFGPLCPVFRFETEAEVIEAANNTEYGLAAYLFTSDTARQWRVGEVLEYGMVGINTGLISNEAAPFGGVKRSGLGREGSKYGADEYLELKYLCIDAG

SEQ ID NO: 7366 - protein, 196 aa, Onion yellows phytoplasma OY-M
MIKKATFVRSIVHFKDIPLKKQPEIVLMGRSNVGKSTFINALTQRKKLAKISQTPGKTITLNYYDINESFYLIDTPGYGYAKKSKEIQKQLLPMIISFLEQTSHLKAVFQLIDFKVGATQEDDRIHQALLQAGFEVVLLFVKKDKVKKNLVPKQLKMLVNHFPQIKYFFLISSKQQEGLEELKLFLSQLMDPNAND

SEQ ID NO: 7367 - protein, 185 aa, Vibrio vulnificus CMCP6
MINTTIKPFSATAYKDGKFVDITEQDVLGKWSVFFFYPADFTFVCPTELGDLADHYEELQSRGVEVYSVSTDTHFTHKAWHDSSDTIGKIKYFMVGDQTGNITNNFGVMRPGQGLADRATFVIDPQGVIQAVEITAEGIGRDAEDLLRKIKAAQYVAAHPGEVCPAKWKEGEQTLAPSLDLVGKI

SEQ ID NO: 7368 - protein, 181 aa, Zea mays
  misc_feature (52)..(52): Xaa can be any naturally occurring amino acid
MTMKSVGSVALKMEEEVRRQFNTIPGLMEGTAKPDYATCVKISTDASIKEMXPPGALVMLTPLIVGTLFGVEILSGVLAGALVSAGFMDFCLMFAIFAPNTGGAWDNAKKYIEAGASEHARTLGPKGSDCHKAAVIGDTIGDPLKDTLGPSLNILIKLMAVESLVFDPFFATHGGLLFKYL

SEQ ID NO: 7369 - protein, 378 aa, Novosphingobium aromaticivorans DSM 12444
MSAEIDFYELLEVERTADDKVLKSAYRKLAMKYHPDKNPGCADSEARFKQINEAYACLSDPQKRAAYDRYGHAAFQQGAGGGAGGGGFGGGDFGDIGDIFETIFGGAFGGGGRQQPRRGADLRYDMEISLEDAFHGKDAEIEVEVSQKCDPCGGSGATPGTSARRCNLCGGHGKVRAQQGFFMVERPCPNCHGRGEVIEKPCKHCRGEGRVDAEQRLQVTIPAGVDNGTRIRLAGKGEAGPFGAPPGDLYIFLHIQRHRVFEREGTTLLTRCPISFTTAALGGEIEIPGLDGKVHAIEIPAGIQSGKQLRKRGAGMPVLQGRGIGDLVVEIHVETPTKLSARQKELLREFQATETGEECPQSKGFFERIKDAWTDLTE

SEQ ID NO: 7370 - protein, 322 aa, Vibrio vulnificus CMCP6
MLLASVAIVLGFALLVWSADKFVEGAAASAKYAGMPALLIGMLVVGFGTSAPEMVVSAMAALDGNPALALGNALGSNIVNISLILGTTALIAPIVVHSNIIRKEIPLLLLITLLLGGMLWNQTISLMEALVLLAGFFAVIGWSIWSAMRAKKDALATEFEQELDVPQLSKGMAIFWLIAGLVLLIVSSRMLVWGAVNIAQQLGISDLLIGLTIVALGTSLPELAASIVAARKGEHDIAVGNVVGSNMFNSLAVVGIAASIEPIENIGLEVFWRDWSTMLFVTLLLLVTAVRFGKKQTITRTEGAVLLGCYVVYNGYLVYGAL

SEQ ID NO: 7371 - protein, 122 aa, Streptococcus pneumoniae TIGR4
MALNIENIIAEIKEASILELNDLVKAIEEEFGVTAAAPVAVAAADAADAGAAKDSFDVELTSAGDKKVGVIKVVREITGLGLKEAKELVDGAPALVKEGVATAEAEEIKAKLEEAGASVTLK

SEQ ID NO: 7372 - protein, 274 aa, Triticum aestivum
MRKRERENPCGVCGHYHKCEEGEICGVCGHRPAAADAVAPARVDSAFPSEVLKGFLFLGSYDNASRSEVLKTLNITHILNTVPDCHNLYRNSFTYHCLQDDKTLDFDGATQFLEQCERGASRVLVHCMSGKNRSAAVVTAFLMKSRGWRLAPSLQWVKDRRPQVQITEASQCQLVEYEQKLFGPSAGSPAQTTVLTESFPSLGFGFPQPSGDIQVPAFNQTPVPSIFERAGPNNVPSNFTFGADGSMGVGVGPAAGINNGAVTPASTDNQMDSS

SEQ ID NO: 7373 - protein, 424 aa, Bordetella pertussis Tohama I
MRIDDVKLAVVGLGYVGLPLAVEFGKKRPVIGFDINERRIAALKAGHDHTLEVEDDELARAAQLSYTAEREELGKANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQAIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAIILAVSHHQFVEMGAEAIRKFGKAEHILYDLKYVLAPEQADLRL

SEQ ID NO: 7374 - protein, 175 aa, Guillardia theta
MSSHKYHYQNPWTLWYDSSSNNVISYEWNQLLIRISTFDNLEDFLFLLTNIAYLTDLPLGSSYHVFKNNIEPSWEDESNKNGGKWILLLPKNSCCNINKIWEKSLSFTVFYENCNLINGIVGSVKKNHLRISIWTSKSEAKNDQINLGKNWYFFLKNYFDDFHFKIEYSPHKSFN

SEQ ID NO: 7375 - protein, 461 aa, Escherichia coli CFT073
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 7376 - protein, 838 aa, Neurospora crassa
MASRTNKIRPIRKPITNRDQSEFEPCWALLRDAMTDIHLQNAGRLSFEQLYRASYKIVLRKKGALLYERVRDFEQEWFRDHIMPNIAALITKNLINISLLQHPGSSSHERREMGEKFLRGIRDSWTDHNRSMNMIADVLMYLDRVYTLETKQPSLFAVTIGLFRNNVLRSHIGAAAEDIEQDFVVFDILCAVILDLINMERDGDIINRNLVRKITAMLESLYETDDEIENHRLYLTLFEPRYLEASTEFYRKECEKLVQEANCSTWLRHAQRRLNEERERCGTTLSIMTTDKIASVVEKELIEAKLDVFLAMEGSGLKPMIDNDRLDDLSILYQLISRVDSTKSALKVILQRRVRELGLEIEKALKNTDFSVAGAAAGDGEDAGEAAEKAKPQTLNPAQQQTAAAIKWVDDVLQLKDKFDRILSDCFCDDLLLQSAITRSFSDFINSFNRSSEYVSLFIDDNLKRGIKTKTEAEVDAVLDKAIVLLRYLTDRDMFERYYQKHLAKRLLHGKSEIHTEKEMVSRMKSEMGNHFTSKFEGMFKDMELSKDLTDNYRDHIASLGDADYKMVDLNINVLTTNNWPPEVMGGGTSKGEGAKLDCFYPPEIKRLQESFYKYYLKDRSGRVLTWVSSAGNADIKCVFPKVPGKETGPLSKERRYELNVSTYGMIVLMLFNDLVDGESLSFDEIQAKTNIPAPELMRTLASLSSVPKCRVLLKEPATKNVKNTDKFSYNAQFVSKAIRIKAPVISSISKVEGDEERKETERKNDQTRAHVIDAAVVRIMKQRKLLAHTKLVNEVISQLMGRFKPDVPLIKKRIEDLLAREYLERVEGDSSTYRYLA

SEQ ID NO: 7377 - protein, 172 aa, Zea mays
MADQEAAEPGPPSWPPWTSLLLRAMSKRRTWAALFLAVYAALLSSSWSLLASVRVWYYAAAASAGAAAAWPAALYASVMYGAVFGLLSMGAALAVAAPAMLVTWITVLVLLAFAGKPRRSLVAEARRATADIARLALRVLLCEGNAVAAVCAVASFAALLFGRRDDAERRLI

SEQ ID NO: 7378 - protein, 441 aa, Bordetella pertussis Tohama I
MNAPASPPDLSHLWMPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVDTALKIALAYHRARGDAQRTRLVGRERGYHGVGFGGISVGGISANLKTFSGALLPAVDHLPHTHSLKHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 7379 - protein, 339 aa, Idiomarina loihiensis L2TR
MTEKIKALRLNKPFGLDNIQVTEMEDPGQPGPGEIRVKVKASSLNFHDYGVASGFIPTEDGRIPMSDGAGVVEAVGEGVEEFAVGDNVVSTFFPYWQSGPAPVGDFHNTPGDGIDGYAREVVVRPTQFFTHQPKGYSHTESATLTTAGLTAWRALVVDGGIKPGNTVLVLGSGGVSVFACQLAKSLGATVFATSSSNDKLQQYKELGADHLINYKEDPEWGKTVRKLTGGRGVDHVIEVGGPGTLPQSINAVAIAGHIALIGVLTGSEGEVPTAKLMAKQARLQGLIVGSCDNQKDFVRALEANGVKPVIDKIFALEELADAFRYEESGKHFGKICVEF

SEQ ID NO: 7380 - protein, 442 aa, Brucella suis 1330
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRRVFPQIPADHLRHTLDIEKNAFSKGLPANGIELANDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 7381 - protein, 454 aa, Malus sylvestris
FNSHGEDSSYFLGWQEYEKNPYHEVLNTNGIIQMGLAENQLCFDLLESWLAKNPEAAAFKKNGESIFAELALFQDYHGLPAFKKAMVDFMAKIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGKQPFKPLKKTVAHKVGFPAILR

SEQ ID NO: 7382 - protein, 291 aa, Acinetobacter lwoffii
MIKKAILPVAGLGTRFLPASKSIPKEMVTVVDRPAIEYVVREAVEAGIEQIILVTHSSKASIENYFDRNFELETILEQKKKFDLLKEITDILPKHVSVISVRQPQPLGLGHAVLCAKDVIGNEAFAVLLPDVLVKDAEADNDLSRMIRRFEQSNAAQIMVEAVPDHLVDQYGIVDVENSPNEGESIVMQGIVEKPSVGTAPSNLSVVGRYILPAQIMALLENTPRGAGNEIQLTDAIAALQQSETVEAYRMKGQTFDCGSKIGYLKAVLHYGIEHPKLGEEFKGLIRELAL

SEQ ID NO: 7383 - protein, 416 aa, Acinetobacter lwoffii
MKIAVFGNTLYAGVMSALLSESGHSVYWCSNTDDKENTVQYSFHDENVSRLLDKQLNSGFLYYANFKHIPLDIDVYLFSFNQTQEQQVLALLTELQQRPIIHPKLMVNASTFGLHSTEKFKQILPEDEWVYLPDIIQEGNALQSFTQAKQLIVGFTEPSAQQKVKELLRPFFPFEQQFLFMPVLDAEFTKLSISGMLATRINDLAVVAEKLGIDITSVRQGMAADNRIGTAYLSPGAGFGGENFSHDVLTLANTVANTGVKSQLLAQVWEINEQQKEILFRKLWNYYHGDLHGKTIAIWGASFKENTSSIQHSPIHLMLKALWAQGVKVQLHDPQALEEIQMIYGQRDDLILCQQQYEALENAHGLCVLTAWKQYWSPDFKQMMQRMAHPLVLDGRNIYDPQYVKAQQFAYMGVGR

SEQ ID NO: 7384 - protein, 403 aa, Bacillus sp. SG-1
MHRVNQGKLESKSKVEVKNAKDLSLAYSPGVAEPCKVIYDKPETVYEYTMKGNMVAVVSDGTAVLGLGNIGPAAALPVMEGKAVLFKSFAGVDAFPICLDTNDVDKIVETVKLMEPTFGGVNLEDIAAPNCFVIEERLKKETNIPIFHDDQHGTAIVTVAGLVNALKIVEKKMSEIKVVANGAGAAGIAIIKLLHNYGVRDIVMCDTRGAIYEGRPNGMNDIKNEVAKFTNRDRVEGGLEDVIKDADVFIGVSVAGALTEEMVSSMNEDPVIFAMANPVPEIMPEKAKAAGAKVVGTGRSDFPNQVNNVLAFPGIFRGALDVRATHINEKMKQAAVEAIAALVDEKDLNEDYVIPAPFDARVAPAVAAAVAQAAMETGVARQKVDPEEVRKKTEQLAVIGKGE

SEQ ID NO: 7385 - protein, 338 aa, Acinetobacter lwoffii
MAKILVTGGAGYIGSHTCIELLNAGHEVIVFDNLSNSSEEALRRVQKLTNKSLVFIQGDIRNQSELDLVFQDHQIDAVIHFAGLKAVGESQQIPLTYFDNNIAGSIQLTKSMEKAGVFKLVFSSSATVYDEVNTSPLNEDMSTGIPNNNYGYTKLIVEQLLQKLAHADRRWSIALLRYFNPVGAHKSGQIGEDPQGIPNNLMPYVTQVAVGRREKLSIYGNDYDTVDGTGVRDYIHVVDLANAHLCALSNRLSAQGCRVWNIGTGNGSSVLQVKNTFEQVNGVSIAFEFVSRRAGDVATSFADNTRAQLELGWKPQYSLEDMLTDSWNWQKQNPNGYN

SEQ ID NO: 7386 - protein, 318 aa, Acidovorax sp. JS42
MPSIQNPLGALPARFRRQRVLIIGCGDVGLRVVRSLNGPQGGSGRPRVLALTSSPTRVPQLRGAGVTPLLGNLDDAATLARLAGVATRVLHLAPPPGEREVGPRWWLDPRSTALARALRRRTLPQSLVYASTSGVYGDCAGAWVPESRPVAPATPRAQRRVNAERAMRHLGRAGVPVSILRVPGIYAPDREGGTPEARLRRGTPVLAEPDDVYTNHIHADDLARACMLALWRARAQRIYNVADDSQLKMGDYFDFAADLYGLPRPPRVQRSTAQEQLPLSLLSFMGESRRLTTTRMARELRLRLRYPTVREGLQAPHP

SEQ ID NO: 7387 - protein, 252 aa, Arabidopsis thaliana
AAKKCGTMVMLGVLQLPCRLHHSLFYSSSQIASSRPQGVAKVVLKKGKTQLFKDGSPMVYSGAVDRIIGKPPPQTGDVVIVADGTENPIGWGLYNSVSMFCVRLMQLQHESTRDPSCALNIEKLLQTRIAEAVQLRKSLALPSANTNAYRLVNSEGDRLSGLIVDVFGDIAVVASSAAWLEKYRIEVESCLRSIDGINHINWRPSLDVLKEDGFDISSLKQTQSSTLPQRSMVRCVVPLIRLWKMGSHTQFR

SEQ ID NO: 7388 - protein, 350 aa, Acidovorax sp. JS42
MTSAETAFQITVQPSGRAFEAQAGETILSAAIRGGVGMPYGCKDGACGSCKCKKLSGSVVHGEHQQKALSTEEEEAGFVLTCCAQPLTDVVLESRQVTDESAYPIKKLPVRVAALTRASHDVMQVRLQLPAADTFRYHAGQYIEFILRDGARRAYSMANAPHTQEGAPGVELHIRHMPGGRFTDHVFNAMKEKEILRVEGPFGSFFLREDSDKPMVFLASGTGFAPIKALIEHMQHKGITRPATLYWGGRRPADLYMDGWIRERLAALPNLRYVPVVSDALPEDGWAGRTGFVHQAVMEDIADLSGYQVYACGAPIVVDSARAAYSAERGLPPDEFYADAFTSEADKHGG

SEQ ID NO: 7389 - protein, 279 aa, Aeropyrum pernix K1
MKTGAVPKGLRVAVLGVGKIGGAIVKSLLSCGAVVTGTGRRRETLERISRLGAEATVDNRLAAKVSDVVILSVKPYQLPRLLEEIRDVMEGKIVVSVVAGVRLSTLSRALEGSHVYRAMPNINALIGRSTTAVAEYTGDKRASFVESILSCMGSVYWIPEEWMDVWTALVGSMPAYVAVMIDSLTLGGVSAGLPREVAFKAVIDTLGATAEHLGKRDIHPSVLRDEVTTPAGTTIEGLKVIEGEGVDAALIRTVEAAARRAAAIGEAIDNEVRRSLNLR

SEQ ID NO: 7390 - protein, 675 aa, Glomerella lindemuthiana
MADRLPTSTSSGRRRRDGDASIGEFVIGGEIGKGSFAQVYSGHHKNSKAAVAIKSVEMGRLNNKLRENLYGEIQILKTLRHPHIVALHDCVESATHINLVMEYCELGDLSFFIKKRDRHGTNAATEDMARKYPVTPGSGLHEVVTRHFLQQLASALKFLREKNYVHRDVKPQNLLLLPSPGFRKENSRPILTASNDSLIPNAGLASLPMLKLADFGFARVLPSTSLADTLCGSPLYMAPEILRYERYDAKADLWSVGTVLYEMITGRPPFRARNHVELLRKIEATEDKVKYPKDAVVSKDLVKLIGKLLTRNPVERMRFEDFFNDPVVVGPIPGVVEDDIPKVEQKPSRDLRSLEADPQREQSELAKSPRERPLRSPQLPSPDEVRVPQANVSARTGQSPGREIGEGLGIRRPPMPQPSTSAPSRPHRLSNASLNRPPIRASASPPTSYLNERKLRPVTERSMTEQDKAAQDVAFERDYVVVEKKHVEVNAFADEMAANPRLTSLSPKNGQMVRRATQQGPPTSTTGAGRMQPSSAVQIAQGKGRPGHDHPCVSLASRSLNTSSAARAPLRPCTTRSPRIRHRHPLLLLDSSVTADRAHHLTKMHGSSSSSKTSHIVVIVYMALPKSSLSNFSLWHLPWITPWVAPLPTKSMRMVLLSRQRWLCLRRLSCFTSRL

SEQ ID NO: 7391 - protein, 292 aa, Chlamydomonas reinhardtii
MLAQRQDAGQAAGTSGGPKRRWTIDDFDIGKPLGKGKFGNVYLAREKQSKYIVALKVLFKSQLQQSNVEHQLRREIEIQAHLRHPNILRLYGYFYDKEKVYLILEYAARGELYKELVRCNHFDERTSATYILSLARALHYCHTKHVIHRDVKPENLLVGLNGELKISDFGWSVHAPSNRRKTLCGTLDYLPPEMVEGKEHTTSVDNWSLGVLTYEFLFGGPPFEAPGHQETYRRIVRVDIKFPDKPAVSDSAKAFISKLLVKDAHRRLPLLEVQNDPWIKANADPDMLARGN

SEQ ID NO: 7392 - protein, 810 aa, Oryza sativa
  misc_feature (802)..(802): Xaa can be any naturally occurring amino acid
MASQGEPSSSSDPKGKKDFSTAILERKKSPNRLVVDEATNDDNSVIGMHPDTMEKLQLFRGDTVLLKGKKRKDTICIVLADDTCEEPKIRMNKVVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKARSHVIVMGATNRPNSIDPALRRFGRFDREIDIGVPDEVGRLEVLRIHTKNMKLAEDVDLEHIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIEMEKRRKDNPEAMEEDEVDDIAEIKAAHFEESMKYARRSVSDADIRKYQAFAQTLQQSRGFGTEFRFADQPASGAGAAADPFASAAAAXADDDDLYS

SEQ ID NO: 7393 - protein, 363 aa, Physcomitrella patens subsp. patens
MEFSYLWTILGCLAFLRGLLPLEIAEAINRGLRRLNSHWMPYVVFEIPEFEGASINELYKNVQLHLTAKGLCRSARKTVLCRMKNSANTISTLAGGEAVMETFEGAKIWWTHTVHGNKATDGSSQDQRSYTMKVHKHDRDRVISAYLDVIRENAYNFQHKNSNRISTQVRSNSELKQLLIQTTNKSVIVIEDIDCSVCLAHPRLRRKKPSYYETSSLESSEEGTPEGVEKRITLSGLLNFTDGLWSCCGNERILIFTTNHIEKLDDALLRPGRMDLHIHMSFCTYAAFKTLVLNYLMVDSHLLFPKVETLLRSGAKVTPAQVSEIMIQRRDNPSGALEELVSSLEHQILSTGKIHPESHKSTY

SEQ ID NO: 7394 - protein, 312 aa, Streptococcus pneumoniae TIGR4
MAEIYLAGGCFWGLEEYFSRISGVLETSVGYANGQVETTNYQLLKETDHAETVQVIYDEKEVSLREILLYYFRVIDPLSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 7395 - protein, 446 aa, Clostridium tetani E88
MDWSVSMELLDFNYINKKIKETDYYSYEGVVKKVIGLTIEVEGIKAFIGEVCTIYNQQNNPIVCEVVGFVEDNVILMPLGELIGIAPGCRVIPSGNPLSVKCSEELFGKVLDGLGSPLNGEKIKTGVPYPLDREPPDPLKRRRIKDVIPTGVRAIDGYLTCGEGQRIGIFAGSGVGKSTSLGMIAKYAEADVNVICLIGERGREVLDFVEKDLGEEGMKKSIVICATSDKPALVRIKGAFTATAIAEYFRDKGKKVILMMDSVTRFAMAQREVGLAIGEPPATKGYTPSVFAMLPRLMERSGMSDKGSITAFYTVLVDGDDFNEPIADAVRGILDGHIVLSRDLAAKNHYPAIDILSSISRLMNEISVKEHKESASIGRDLIATYKEAEDLINIGAYVKGSNEKIDIAIKYIDSINEFLTQKVDEHNNFEESIQWLNSIFKNLRSN

SEQ ID NO: 7396 - protein, 476 aa, Physcomitrella patens subsp. patens
MKSSSTGILGKPLRDIKLHYTLGRELGRGQFGVTYLCTDKETGISYACKTIAKRKLTNKDDIEDVKREVQIMHHLSGTPNIVELKDVFEDKQNVNLVMELCAGGELFDRIIAKGHYSERDAADMCRVIVTVVHRCHSLGVFHRDLKPENFLLASKDKNAPLKATDFGLSIFFKPGDEFHDIVGSAYYVAPEVLKRSYGPEADVWSAGVIVYILLCGVPPFWAETEKEIFDTIMRGHIDFKSDPWPKISDEAKDLVKKMLNSNVKERLTAQEVLNHPWMQRDGVPDVPLDNAVLTRLRNFSAANKMKKLALKVIADNLSEEEIVGLRELFKSIDTDNSGTVTIDELKKGLLKQGTRLTEADVRKLMEAADVDGNGKIDFNEFISATMHMNKTQKEDHLHAAFQHFDTDNSGYITIYELQEAMEKQGMGDPETLQEIINEVDTDHDGRIDYDEFVAMMRKGNPGTEDGGNLKSPRHRW

SEQ ID NO: 7397 - protein, 197 aa, Gossypium anomalum
  misc_feature (45)..(45): Xaa can be any naturally occurring amino acid
VVEHVGLNVNGEPFVACHECNFPICKSCFEYDLKEGRKACLRCGXPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 7398 - protein, 197 aa, Gossypium somalense
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKIEREAEIPPEQQMDDKPAPDASQPLSTIIPIPKSRLAPYRTVIIMRLIILGLFFHYRVTNPVDSAFGLWLTSVIC

SEQ ID NO: 7399 - protein, 164 aa, Triticum aestivum
  misc_feature (155)..(155): Xaa can be any naturally occurring amino acid
MAAPSREAEPASSLGDLTRVDFPILDQEFDGNKLVYFDNGATSQKPSHVMKALDDYYRFYNSNVHRGIHALSAKATDAYESARRKVANFINAADSREIIFTRNATEAINLVAYSWGLSNLKQGDEIILTVAEHHSAIVPWQFVSQKLVPSLKYVXLTKEEVPEH

SEQ ID NO: 7400 - protein, 337 aa, Ralstonia eutropha JMP134
MKVSLKKIGSQVIVLTGATSGVGLVTARKAAAMGARLVLVARSEDSLHKLAEELREKGAEVITVTADVGRHEDVARVAHAAIERFAGFDTWVNNAGVTIFGRHADVPLEDQRRLFDTNYWGTVHGSLAAAAHLRERGGAIINIGSEASDGPLPLQSAYAASQHAIKGFTDSLRLELEQEMAPISVTLIKPAGLETPLAMHAKNFLDVEPRLPPPLYDPALAAEAILFAAEHPRRDLFVGGAAKAFSAAAYHAPRTFDQVMRRFMGRAQQTRHPAGPLEDNTLYGGGNDLQERTGNRVALQSCPYTTSARHPVLTTALVVGASAALAAVMQVRRGRHD

SEQ ID NO: 7401 - protein, 606 aa, Guillardia theta
MNLLKTCIHIDYYEFVLGISKKVIRYNKKTIDHKYNNFSKENNCFSRIENPKQDFLNFNFNYSKNFFLSEPRLPSFRFVDFIGIENYFKKISDILEFYINHTNNYKNPSVPHKNVIILSGPSGTGKTLFTNALAGEIGINLIDVKIEEFSSLKSKKILYEFKKYIKFRKCLLLIDNIDHFFDEDNFNSPNKKYQNLLSSLMFLKENFLDNHLLFIILENSKNIKTMLKKFDFSFNEIEFKIPSVDIRFQMIRNYSKKFFLNGDDDIFFLTRRTNGLVCKDIINVFIKASEHSYYRKTKRVLGGFYRKPRKDIIPILKELRPMDIDYAFDFFNYNFDKITTHNFSDVTWSEIGGLENTKKVISKFIIEPILYNNHIGSNFGQGNGILINGPPGCGKTMIAKAAAKESGANFSYIKGPEILDKFLGESEKAIRKIFLNAKENSPTIIFFDEFDSLALKRDSFHGDSNSGERIVNQLLSEIDNFNRKSKIFLIAATNRLDIIDKAFLRPGRFDHVLNVNYPSYREKISIFKTTIRKVEVLPGINSKLISYFFLRINFTGADISWIIKKATVQSKDDRIFYCQPFTSNKGLFINRNSKISLKNLVTDYVK

SEQ ID NO: 7402 - protein, 340 aa, Erwinia carotovora subsp. atroseptica SCRI1043
MKSIVIQQPNSLVIEERSIPQPAAGEVRVKVKLAGICGSDSHIYRGHNPFAKYPRVIGHEFFGVIEAVGDGVDAARLGERVSVDPVVSCGHCYPCSIGKPNVCTSLVVLGVHRDGGFSEYAAVSAKNAHVIPDEIPDEFAVMVEPFTISANVTAQVKPTEQDIALIYGAGPMGLTSVQVLKGVFKVKEVIVVDRIPERLEMALRSGADRVINNASLSLKDELETLNIKPTLIIDAACHPSILQEAITIASPAARIAIMGFSSEPCQISQQGITSKEISIFSSRLNANKFPIVIEWLKEKRIDPAKLITHRFDYQQVVQAIEVFEKDQKRCCKVLLTFNEA

SEQ ID NO: 7403 - protein, 322 aa, Bacillus cereus E33L
MKVLEAISNIAGKYFAFWVICIATIAYFIPAPFLGLNSYITILLGVVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNPMSMFLSIIQVIIIPIILGLVVKKFFPKTVTKGMTVIPFISVLAIIIIVSAVVSANVSSITSSGLLIFIAVMLHNAFGFLLGYITAFVLGLEEGTRRAISIEVGMQNSGLGVALATAHFGPAAALPSVLAAVWHNIAGPILATIWSKNAKNTFSDENVSVNIEK

SEQ ID NO: 7404 - protein, 501 aa, Calocedrus decurrens
GGLLLLLLCCWSVANGQQQQRREGLMQQQQSCRTQHLSPQQPYETIRSEGGTIELSTRQDNDELDCAGVEFMRETIERHSLALQRFSNVPEIRYVVEGEGLLGVVFPGCPETFRRSPFGEEGECRRRRGRREGRGEGGREEEEEEERGRGREEECSRHERERAREESSQKIRRVRRGDVVAIYAGVAYWWYNDGDKPLRTVAIADASNHQNQLDKRYRPFFLAGSPATRERSERAGEGEKYGGNVLAGFDANMLAEALGVRRQVVIDIQENNRESGLIVRVNDPRRAGPGGEGAPLFLNTVAEASEDMKSWGINPGGLHQFYCNMRLRHNADRPDDADIFVRDGGRLNTVNRFKLHALSHLNLAAERGVLRPGAMFAPSWVACHAILYATRGDARIEVVENRGRRVFDGRVQEGQFLVIPQFYAVMKRPGDQGFDWITFTTCHSPIRSSFTGRNSVLKGMPQEVVMNAYNISRREAHELRWNREHEFLILPPRGGQRESEQ

SEQ ID NO: 7405 - protein, 330 aa, Escherichia coli
  misc_feature (40)..(40): Xaa can be any naturally occurring amino acid
  misc_feature (43)..(43): Xaa can be any naturally occurring amino acid
  misc_feature (118)..(118): Xaa can be any naturally occurring amino acid
  misc_feature (128)..(128): Xaa can be any naturally occurring amino acid
  misc_feature (172)..(172): Xaa can be any naturally occurring amino acid
  misc_feature (228)..(228): Xaa can be any naturally occurring amino acid
  misc_feature (267)..(267): Xaa can be any naturally occurring amino acid
TIKVGINGFGRIGRIVFRAAQKRSDIEIVAINDLLDADYXAYXLKYDSTHGRFDGTVEVKDGHLIVNGKKIRVTAERDPANLKWDEVGVDVVAEATGLFLTDETARKHITAGAKKVVXTGPSKDNTPXFVKGANFDKYAGQDIVSNASCTTNCLAPLAKVINDNFGIIEGLXTTVHATTATQKTVDGPSHKDWRGGRGASQNIIPSSTGAAKAVGKVLPELNGKLTGXAFRVPTPNVSVVDLTVRLEKAATYEQIKAAVKAAAEGEXKGVLGYTEDDVVSTDFNGEVCTSVFDAKAGIALNDNFVKLVSWYDNETGYSNKVLDLIAHISK

SEQ ID NO: 7406 - protein, 759 aa, Pseudomonas putida KT2440
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARSQSLVYADNTILVSEELTPAMLGEVPEGKLVGLVSVLGSGNSHVAILARAMGIPTVMGLVDLPYSKVDGIELIVDGYKGEVFTNPSEVLRKQYSEVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKALSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTKELARQVDFLSVGSNDLTQYLLAVDRNNPRVADLYDYLHPAVLQALNTVVRDAHGEGKPVSICGEMAGDPAAAVLLMAMGFDSLSMNATNLPKVKWMLRQINMGKAKELLAEALSHDNPQVIHSSLQLALKNLGLARMIGPGANKTL

SEQ ID NO: 7407 - protein, 498 aa, Calocedrus decurrens
GLLLLLLCCWSVANGQQQQRREGLMQQQQSCRTQHLSAQQPYETIRSEGGTIELSTRQDNDELDCAGVEFMRETVEKDCLALQRFSNVPEIRYVIEGEGLLGVVFPGCPETFRRSPFGEEGECRRRRGRREGQGQGEREEEEEERGRGREEEYSRDERERRREESSQKIRRVRRGDVVAIYAGVAYWWYNDGDRPLRTVAIADASNHQNQLDKRYRPFFLAGSPATRERSERAGEGERYGGNVLAGFDANMLAEALGVRRQVVTDIQENNRESGLIVRVNEPRRPGPGGRGAPLFSNTVAEDSEEEEREGINPGGLHQFYCNMRLRHNADRPDDADIFVRDGGRLNTVNRFKLHALSHLNLAAERGVLHPGAMFAPSWVACHAILYATRGNARIQVVENRERRVFDGRVQEGQFLVIPQFYAAMKRAGDQGFEWITFTTCHSPIRSSFTGRNSVLKAMPEEVVMNAYNISRKKAHELRWNREHDFLILPPRGEQRESE

SEQ ID NO: 7408 - protein, 263 aa, Vibrio campbellii AND4
MTQTNQAPLVIKLGGAALSCTQTLSQLFAAIAAYQKSAQRQIAIVHGGGYLVDELMAKLQLKTVKKNGLRVTPYDQIPVIAGALAGTANKILQGQAISNGLNAVGLSLADGGLCHVEELDPELGAVGKASPGDSTLLQAVLNAGALPIISSIGLTEKGQIMNVNADQAAVAVAGALDAELVLLSDVSGVLDGKGHLIKTLSEQEADALIQGQVITDGMIVKVKAALEAANDLGRSIEVATWRYPEKLTQLFAGESIGTQFLPQ

SEQ ID NO: 7409 - protein, 508 aa, Calocedrus decurrens
LLLLVCLPFSWSIADVVISGQQQEHYGRQLQQQQSCRVRHLRAQQPSEMIRSEGGTLELSTRQDNEQLDCAGVEFIRETIERDGLSMPRFYNTPGLFYVVEGQGRLGVVFPGCPETFRRPPFGAGEVECQRRRRESREGGRGEEEEEERGRSEEEERSRHEQECVREESSQKVRRVQRGDVVAVFAGAAFWWYNDGDKPLRLVAIADTSNYQNQLDRRHRQFYLAGSPATRERRERLGEGRKLGGNMLAGFDPNTLAEAWGVERDTVRRIQENNQGRGLIVRVNQPRQQRRDHENPPISFWDSNVITGGEEEEERDGFNPSGLQQLICNMRLRHNADNQEDAEVFIRDGGRLNTVNRFKLNALTHINLAAERGVLHPRAMFAPSWLASHAVMYVTRGDARVQVVDNRGRRVFDGSIREGEFIVIPQFYSVVKRAGDQGFDWITFTTSHSPIRSSFVGKDSVLKAMPQEVVMAAYNISCGEAQDLRWNREYEFFILPPRRQQFGGRGSA

SEQ ID NO: 7410 - protein, 586 aa, Bacillus sp. SG-1
MRKTKIVCTIGPASESVEKLTELIEAGMNVARLNFSHGDHEEHGARIQNIRTASEKTGKTVGILLDTKGPEIRTNNMENGSIELEKGSEVIVSMKEVLGTQEKFSITYESLIDDVEEGSKILLDDGLIGLEVLSLDKAAGEIKTKVLNSGTLKNKKGVNVPGVSVNLPGITEKDAKDIIFGIEQGVDFIAASFVRRASDVLEIHQLLEDHNAGDIQIIPKIENQEGVDNIDEVLEVSDGLMVARGDLGVEIPAEEVPLVQKALIKKCNALGKPVITATQMLDSMQRNPRPTRAEASDVANAIFDGTDAIMLSGETAAGVYPVEAVQTMHNIASRAETALDYKEILSNRSKDTGHNMTDAIGQSVAHTAINLSVNAIVAPTESGHTAKMISKYRPKAPIIAVTANDSVSRKLALAWGVYSQKGRKVATTDEMLEMAVEESVNSGMITHGDRIIITAGVPIGESGTTNLMKIHVVGDILAKGQGIGRKTAFGKAVVAKNAAEANEKVKPGSILVTVGSDKDMVPALEKCSALITEEGGLTSHAAVVGINIGIPVIVGVENAMSILKDGQEITVDSSRGVIYDGHASVL

SEQ ID NO: 7411 - protein, 504 aa, Pseudomonas putida KT2440
MLEQYVKKILTSRVYDVAVETPLQSAGQLSKRLGNQILLKREDLQPVFSFKIRGAYNKLAQLSPEELARGVVTASAGNHAQGLALAAREMGIKATIVMPKTTPEIKVEGVRSRGGKVVLHGDSFPEALAYSLKLVDEKGFVYVHPYDDPHTIAGQGTVAMEILRQHPGRLDAIFVPVGGGGLIAGIAAYVKYLRPEIKIIGVEPDDSNCLQAAMAAGERVVLPQVGLFADGVAVAQIGQHTFDICRHHVDEVVTVSTDEICAAIKDIYDDTRSITEPAGALGVAGIKKYVELYGVSGQTLVAIDSGANVNFDRLRHVAERAELGEKREAIIAVTIPERPGSFKAFCEAIGKRQITEFNYRKHTSDEAHIFVGVQTHPENDPRAALVQQLTEQGFPVTDLTDNELAKLHIRHMVGGHSAGASDEMVLRFEFPERPGALFNFLNKLGGRWNISMFHYRNHGAADGRVVAGLQVPEDERHLVPAALAKIGYPYWDETENPAYKLFLG

SEQ ID NO: 7412 - protein, 224 aa, Pseudomonas putida KT2440
MTQDQLKQAVAQAAVDFILPKLDEKSVVGVGTGSTANFFIDALAQHKTAFDGAVASSEATAQRLKGHGIPVYELNSVSELEFYVDGADESDAHLHLIKGGGAALTREKIVAAVAKTFICIADGSKLVPVLGAFPLPVEVIPMARSHVARQLVKLGGDPVYREGVVTDNGNVILDVYNLQITNPVELEAQINAIVGVVTNGLFAARPADLLLLGTAEGVKSLKAE

SEQ ID NO: 7413 - protein, 252 aa, Leptospira interrogans serovar Lai str. 56601
MIFIKNKSEIEKMRAAGKLAARLLDYISSYVQPGVSTLQLNDLCEEFTKKHGARSAPLGYKGFPKSICTSVNQVVCHGIPKANEVLKEGDIINIDVTPILDGYHGDSSRTFIVGGNTSSEVKTLVQDTEKAMFIGIEQVRPGNRVHDIANAIDDFLTPKGYGIVRDLMGHGIGRGFHEDPQIPHFRQNRKLAKLEPGMVFTVEPMVNLGTWQVNFSKEDHWTVTTRDGKWSAQFEHTVLVTEKGYEILTVSD

SEQ ID NO: 7414 - protein, 441 aa, Ralstonia eutropha JMP134
MTHVFHRNPRQTLPVAVAGSGVELVDSEGRRYLDASGGAAVSSLGHGHPRVIAAIKAQLDTIAYAHTSFFTTEVSETLAQTLAQAAPGDLEHVYFVSGGSEAVEAALKLARQYFVELGQGSRRHFIARRQSYHGNTLGALAIGGNAWRREPFLPLLVPAHHVSPCYAYRDQVAGETDAQYAQRLADELEAKIQELGAENVAAFVAETVVGATAGAVPPVGDYLKRIRAVCDKYGVLLILDEVMSGMGRTGYLFACEEDGVVPDIVTIAKGLGGGYQPIGAMISTRRIYDTIVAGSGFFQHGHTYIGHATACAAALAVQRTIAEDNLLANVRQRGEQLRARLRESLGNHPNLGDIRGRGLFVGVEFVADRDSKATLDPKLKTHARLKSTAMQHGLLVYPMGGTVDGVHGDHVLFAPPFICTAQDIDKIVERFTAAVAAVLPA

SEQ ID NO: 7415 - protein, 251 aa, Nocardioides sp. JS614
MNRLQGKVAIVTGGAQGQGAGISRAFVAEGARVVIADIAKEQGQELAAELGDTAHFIDHDVSDQASWTALVEDTGQRFGPVNVLANNAGILRFGEIEKMPVDEVELLWRVNQLGCFLGMNAVSRTMREHGGGSIINASSVEGLAGMAGCTAYAATKWAIRGMTKCAAMELGPQGIRVNSVHPGMIDTPMTRVHGGDAAMEYGAAKVPLRRVGYPDDIAPLYVYLASDESAYVNGAEIAIDGGVTATHAFGG

SEQ ID NO: 7416 - protein, 422 aa, Bacillus sp. SG-1
MSEGQKITVENGSLNVPNNPIVPFIEGDGTGPDIWASASRVLDAAVEKAYNGERKLVWKEVLAGEKAYNQTGEWLPSETLDAVREYFIAIKGPLTTPIGGGIRSLNVALRQELDLFTCLRPVRYFEGVPSPVKRPEDTDMVIFRENTEDIYAGIEYAKGSDEVKKIISFLQNEMGANKIRFPETSGIGIKPVSEEGTKRLVRAAINYAISEGRKSVTLVHKGNIMKFTEGAFKNWGYELAEQEFGEKVFTWAEYDRIKDEKGTDAANQAQSEAEAAGKIIVKDAIADIFLQQILTRPAEFDVVATMNLNGDYISDALAAQVGGIGIAPGANINYDTGHAIFEATHGTAPKYAGLDKVNPSSVILSGVLMLEHLGWNEAATLITKSMEKTIASKVVTYDFARLMDGATEVKCSEFGNALIENM

SEQ ID NO: 7417 - protein, 741 aa, Nicotiana tabacum
MTMNQMKTIELEEGWEFMQKGITKLKIILEGSPDSFSSEEYMMLYTTIYNMCTQKPPHDYSQQLYEKYKEAFEEYINSTVLSSLREKHDEFMLRELVKRWANHKLMVRWLSRFFHYLDRYFIARRSLPALNEVGLTCFRDLVYQELKSKARDAVIALIDQEREGEQIDRALLKNVLGIFVEIGMGEMEYYENDFEDAMLKDTAAYYSRKASNWIVEDSCPDYMLKAEECLKKEKDRVSHYLHSSSEAKLLEKVQNELLVVYTNQLLEKEHSGCRALLIDDKVEDLSRMYRLFHRIPKGLEPVANMFKQHVTAEGMVLVQQARRLSKLTRLKVPVVHRSRYLLGRLLSCLDKYMAYVTNCFANNSLFHKALKEAFEVFCNKVVAGCSSAELLASYCDNILKKGGSEKLSDDAIEETLDKVVKLLAYISDKDLFAEFYRKKLSRRLLFDKSANDDHERLILTKLKQQCGGQFTSKMEGMVTDLTLAKENQNHFQEYLSNNSAANPGIDLTVTVLTTGFWPSYKSSDLSLPVEMVKCVEVFKEFYQTKTKHRKLTWIYSLGTCNINGKFEPKTIELIVGTYQAAALLLFNASDRLSYSHIKSQLNLADDDLVRLLQSLSCAKYKILTKEPTSRTVSSTDHFEFNSKFTDRMRRIRIPLPPVDERKKVVEDVDKDRRYAIDACIVRIMKSRKVLPHSQLVSECVEQLSRMFKPDFKAIKKRIEDLITRDYLERDKENPNLFKYLA

SEQ ID NO: 7418 - protein, 175 aa, Triticum aestivum
MAPPVMPSSPTSVAPFQGLKSPAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEAPGKA

SEQ ID NO: 7419 - protein, 398 aa, Acidovorax sp. JS42
MTAFVEAASPHVMNTYGRVPIALERGQGVRVWDVNGKQYLDGLGGIAVNTLGHNHPKLVPALQDQIAKLIHTSNYYHVPGQEKLAQLLTERAHMTNVFFCSTGLEANEAAIKIARKYGVDKGIEKPVIVVYDHAFHGRSIATMTATGNPKVRNGFGPLLEGFLRVAPNDIEALQEATEGNANIVAVMMEPIQGEGGLHPMRTDYLQQVRALCDANGWLLMLDEVQAGMGRTGKWFAHQWAGIVPDVMTLAKGLGSGVPVGAVLAHGAAAQVLKPGNHGSTFGGNPLAMRAGVETIRIMEEDGLLQNAADVGAHLKAELQRALGETAGVNEVRGQGLIIGMELDRPCGVLIDRAAEAGLLLSVTAERVIRLVPALTLTRAEADEIVALLTPLVQTFLSE

SEQ ID NO: 7420 - protein, 305 aa, Acidovorax sp. JS42
MKHYLQFTDFTADEYNYLFSRAAIIKGKFKSYEKYHPLADRTLAMIFEKASTRTRVSFEAGMYQLGGSVVHLTTGDSQLGRAEPIEDSARVISRMTDLVMIRTFGHDKIERFAEYSRVPVINGLTNEFHPCQIMADLFTYIEHRGSIAGKVVAWVGDGNNMANTWLQAADLLGFTVHVSTPGGYEVDEKLAFGGKPHRAGCYKVFADPMDACRGADLVTTDVWTSMGYEAENEARRKAFADWCVDAEMMAVAKPDALFMHCLPAHRGEEVMADVIDGPQSVVWDEAENRMHVQKALMEYLLLGRV

SEQ ID NO: 7421 - protein, 197 aa, Gossypium longicalyx
  misc_feature (153)..(153): Xaa can be any naturally occurring amino acid
VVEHVGLNVNGEPFVACHECNFPICKSCFEYDLKEGRKACLRCGNPYDENLLDDVEKATGDQSTMAAHLSKSQDVGIHARHISSVSTLDSEMTEDNGNPIWKNRVESWKEKKNKKKKPAANKVEREAEIPPEQQMEDKPAPDASQPLSTIIPXPKSRLAPYRTVIIMRLIILGLFFHYRVTNPVDSAFGLWLTSVIW

SEQ ID NO: 7422 - protein, 307 aa, Chromobacterium violaceum ATCC 12472
MTSVRHYLQFSDLSPDEYHHLFERSRVLKRRQSAGELHRPLVGKVMSMVFEKNSTRTRVSFEAGMAQLGGHAMFLDTKSSQIGRGEPIEDTARVLSRMSDIIMIRTFEQGLVQRLAAHSRVPVINGLTNEYHPCQVLADIFTYVERHGSIKGKTVAWVGDGNNVCRTWLQAAAVLGFKLKVASPLGYELQTLDGRHYGSDVLEMTRDPARAVHGADIVTTDVFTSMGFEAEQAARREAFEGYQVTAELMKQAKPEALFMHCLPAHRGEEVAAEVIDGPQSVVWDEAENRMHVQKALIEYLLLGHRED

SEQ ID NO: 7423 - protein, 197 aa, Gossypium bickii
  misc_feature (21)..(21): Xaa can be any naturally occurring amino acid
  misc_feature (54)..(54): Xaa can be any naturally occurring amino acid
  misc_feature (75)..(75): Xaa can be any naturally occurring amino acid
VVEHVGLNVNGEPFVACHECXFPICKSCFEYNLKEGRKACLRCGSPYDENLLDXVEKATGDQSTMAAHLTKSQDXGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 7424 - protein, 415 aa, Aeropyrum pernix K1
MPLEYMGGRLATLDDVDVRGKKVIVRFDLNSPVGNGGEILDDSRIAEAAGTLRELCDRGAAVVALSHQGRPLESDFVSLERHASLLSRYSGVEVRFVMDVIGPEALRTVASLRPGEAVLLDNTRIISEDFIEAEGTVHARGIMVTRLSKLANMYVNEAFSASHRSQASIVGFPYVLPSAGGRVLEKEIRSLNRAVSSGERPKVVVLGGAKLKDAVRIVDYLSSSGVADEVLTTGLVGLLFLYARGYRLPRDVTKLLEKKGGEEAIAKARRIVEEGRRVRTPIDFVVEVGDKIYIKPADELTEGVPKDIGPSTVEYFRAKMRGARVIVMRGPAGVIEDPRFRRGTVELVKAALSSGAYTVFGGGHFRAILRDLPEHLSSKVGHLSTGGGALLYYLSGRPLPGVKALVDSARIFNLV

SEQ ID NO: 7425 - protein, 282 aa, Streptococcus pneumoniae TIGR4
MKIAYLGPKGSFSHHVVQTAFPHEELQAFANITDVIKAYEQGLVNYSVVPVENSIEGSVHETLDYLFHQAHIQAVAEIVQPIHQQLMVVPGHTKIEKIFSHPQALAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESCPLKTALGEYFFIIDVDYTDKDLVHFAQKELEAIGIQYKILGAYPIYPISDHGKERR

SEQ ID NO: 7426 - protein, 165 aa, Clostridium tetani E88
MIRNFNNKTPKIHSNSFIESTSCIIGDVTIEDNVSIWFNAVLRADHNSIYVGKNSNIQDNCTLHIDTNFKVKIGESVTVGHNSILHGCEIGNNTLIGMGSIILNGAKIGENAIVGAGTLIPQGKTFPSGVLLLGSPAKIIRNLTSEEIENIKKSSDEYVKLSKTY

SEQ ID NO: 7427 - protein, 126 aa, Oryza sativa
  misc_feature (106)..(106): Xaa can be any naturally occurring amino acid
MPGFAQASDLSAWSALQDHHQKLGKDIVLKEYFKKDPQRFEKFSRTFKNDAENSEILFDFSKNFITEETLKLLIELAKEAGLEKLRDDMFAGEKINFTENRAVYHXALRNVSNQEMKVDGKSVVED

SEQ ID NO: 7428 - protein, 150 aa, Populus trichocarpa
MDSFSSHSSMGSGSPQMSAEDFKDQLKNQLAQAYAQEFLETVRDKCFAKCITKPGSSLSGSESSCISRCVERYIEATGIISKALFNAPRWTSRKFPPKMSCKLSWELLSESRDCVLYCIPFLAFIMGTYIFLTLICKRFIQLNFSQFLGN

SEQ ID NO: 7429 - protein, 206 aa, Myxococcus xanthus DK 1622
MIKVLDARFVTTAVEPKGYPTDHTAEVAFVGRSNVGKSSMINALTGRRKLVRVSNTPGRTRTLNFFDVDLERGGVRHQIRLADLPGYGFAKASKADKAQWEKMITTYLEKRHRLEAVVSIVDVEVGPTPDDLTTLDYLQAHNRRVLVVATKVDRLTKARLKPRLVELSKLMDLPLEVILPFSSTEKLGVDEVWGALLDTFGKSARV

SEQ ID NO: 7430 - protein, 319 aa, Rhizobium leguminosarum bv. viciae 3841
MSDKQVPIGSGFGAHTTADEVLAGLDLSGKRVIVTGGHSGLGLETTRALAGAGAQVTIGARSIEAARRAVAGIDGVEIDRLDLSDLESVRVFAERFVASGRSIDILINSAGIMACPETRVGDGWEAQFATNHLGHFALVNRLWPAISPGARIVAVSSGGHHNSAIRWEDVQFETGYDKWRAYGQSKTANALFAVHLDRLGRDTDIRAFSLHPGKIFTPLQRHLAKEEMVSAGWIDADGNPIDPTFKTPAQGAATQVWAATSPQLDGMGGLYCEDCDIAIRATDGAPGGVSDHAADPEEAARLWILSARLTGIDAFAAHA

SEQ ID NO: 7431 - protein, 488 aa, Bacillus cereus E33L
MTKNNEAGWNLDHSYTTLPQSFYTEIPPTPVSSPELVKLNHSLAISLGFHPEELKKEAEIAIFAGNALPEGAHPLAQAYAGHQFGHFNMLGDGRALLIGEQITPSGKRFDIQLKGSGPTPYSRRGDGRAALGPMLREYIISEAMYALDIPTTRSLAVVTTGEPTYRETKLPGAILTRVASSHIRVGTFQYAAARGSIEDLQSLADYTIKRHYPEIEAHENRYTALLQEVIKKQASLIAKWQLVGFIHGVMNTDNITISGETIDYGPCAFMDNYDQGTVFSSIDTQGRYAYGNQPYMAAWDLARLAESLIPILHEDEEEALKIAQDEISKFSVQYENQWFLGMKKKLGLFSNEEQDQSLIEQLLKMMEKFKADYTNTFRSLTLNTIENTALFESPEFKEWYKLWQSRLERQEESKENAYEMMKNNNPSIIPRNHRVEEALEAAVTSGDYSVMEKLLEALSNPYAYSADQEDYCAPPAPTNRPYRTFCGT

SEQ ID NO: 7432 - protein, 136 aa, Brassica napus
MSEEFDESDIIFSDSFFRTRRRDDMNEKENRPVGFRENSKNKPRRSKTAPLPSPAAFSTSLPVNIPGNVVQRYTDDEEYSDDGGRIMVPPHLIVGRRMEGCQMAFSVCTGNVRTLKGRDLSRVRNSVLRLTGFLET

SEQ ID NO: 7433 - protein, 175 aa, Triticum aestivum
MGPTVMASSATSVAPFQGLKSTAGLPVSRRSNGASLGSVSNGGRIRCMQVWPIDVIKKWETLSYLPPLSTEALLKQVDYLIRSKWVPCLEFSKVGFIFREHNASPGYYDGRYWTMWKLPMFGCTDATQVINEVEEVKKEYPDAYVRIIGYDNMRQVQCVSFIAFKPPGCDESGKA

SEQ ID NO: 7434 - protein, 242 aa, Vibrio campbellii AND4
MFASKEGQAVPQVTFPTREGDAWVNVTTDELFKDKTVIVFSLPGAFTPTCSSSHLPRYNELFSVFKEHGVDEIVCVSVNDTFVMNAWKADQEAENITFIPDGNGEFTDGMGMLVDKNDIGFGKRSWRYSMLVKNGVVEKMFIEPNEPGDPFKVSDADTMMNYVAPEYKTQESITVFTKPGCPFCMKAKQNLIDHGLQYEEVVLGKDATTVSLRAISGRATVPQVFIGGKHIGGSEELETYLS

SEQ ID NO: 7435 - protein, 162 aa, Brassica napus
FGDERIIVFTTNHKERLDPALLRPGRVDMHINLSYCTGLGFRTLVSNYLGLDGLNHPLCEEIETLVDSTEVTPAELAEELMQDDDCDVVLPGVVSFVEKRKVERSKAKESVSICDEVVKTDDDAEKQSVCTNGMRNRKKQAGRRKGRGARVVNARTYLQVGM

SEQ ID NO: 7436 - protein, 403 aa, Ralstonia eutropha JMP134
MPDSPSRHSPDPQLPLARDAVHNLRASRIREVANAGIGLPEVLPFWFGESDQVTPDFVRDAAARALAGGATFYTHNLGIAPLRSALADYVGALHGATRIENVAVTSAGVNGLMLAAQLIAGPGDRVVAVTPLWPNLVEIPKILGASVETVSLDYGPHGWTLDVDKLLAALTPDTRALMVNSPNNPTGWVMSRAAQLTVLDHCRRHGIWIIADEVYERLYYGDEPGGGDSRTAPSFLDIASREERVICVNSFSKAWLMTGWRLGWMVLPSSMTDDLGKLIEYNTSCAPSFVQEAGVAAVREGEAFTRDLVQRLRTARDHLVDALSALPGVDAHAPEGAMYVFFRLSGATDSLALCKQLVREAGLGLAPGSAFGDEGEGFVRWCYACDTDRLDEGVRRLRGFIGR

SEQ ID NO: 7437 - protein, 1023 aa, Brucella suis 1330
MTDLSHPAPEFTTKDAERLAECHFGVSASASPLDSERDCNFRLKVANGSVNGSAGSADWILKIVNASEPRVESEFQTALLQHLVDTNPAAAVPHLKPSLSGDVLASAQGPDGKPHALRMASWLPGTPLAEGKRTKTLLKNLGRALGELDRALQGFIHPGALRDFDWDLRHAGRARERLHFIDKPEDRAVIEHFLARFERNVAPQLPFLRAQVIHNDANDWNVLVDDDDGERIAGLIDFGDAVHTVLIAEVAIACAYSILDMDDPIGAAGALAAGFHEKFPLQAQEIDILFDLIAMRLVTSVTLSASRREKTGDNPYLAISEAPAWRLLHRLDALNPRFATAILRKACGFDAVEGAGAVRTWLDANRGAFAPIVKPHLATLTKALVPYGDAAHVMTVDSAGRRPETATAWWDDFCARNHIQLGLGPWGEKRTVYTDEAFRSRFVEGERRVHHLGLDLFMPAGTPVYTPLAATVRSVEIEAVPLGYGGLIALEHEPEGCPPFITLWGHMAHEAVSRLKPGDRLAAGELVGHMGDMHENGGWTPHLHFQISTDTSLSATEILGVGESAYLDVWADIFPDAAPLAGIPAEAFQQSGRTRAEIISVRKEMLLPNLSISYSDPIKFVRGDGVWLIDNRGRAYLDCFNNVCHLGHAHPEVVEAIARQAAILNTNTRYLHDTIVSYAERLAATLPEGLTVASFACSGSEANSLALRMARTHSGQRDALVLDWAYHGTTQELIDLSPYKYKRKGGKGRPDHVFEATIPDSYRAPESWPLAEHGRRFAESIAEQIEKMKAQGRAPAFFIAESIPSVAGQVFLPEGYLREVYAMVRAAGGVCIADEVQVGFGRVGSHWWAFEMQGVVPDIVTMGKPIGNGYPMSAVVTTREVADSFNNGMEYFNTFGGNPVSCAAGLAVLDVIEHNDLRRNALEIGNYLIAGFRSMQDRFDIIGDVRGQGLFLGIELVMDRKTKEPATAIARKINDGARERGILMGTEGPFDNVLKMRPPMIFTRANADHLLSVLEDSFAAALK

SEQ ID NO: 7438 - protein, 135 aa, Zea mays
MKEAGIPRRLIKPEDIPGLNSAEGKLSYYLHKSWQMNLNEHPDAWPFKEPVDSRDVPDYYDIIKDPIDLRTMLRRVDSEQYYVTLEMFVADMKRMFSNARTYNSPDTIYYKCATRLENFFSGRITVLLAQLSTKS

SEQ ID NO: 7439 - protein, 282 aa, Oryza sativa
GEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMETPAILREGIEATGRFEILSKEAGVPLVAFSLKASGRYTVFDISEHLRRFGWIVPAYTMPANAEHVAILRVVIREDFSRSLAERLVSDIVKILHELDAHSAQVLKISSAIAKQQSGDDGAVTKKSVLETEREIFAYWRDQVKKKQTGIC

SEQ ID NO: 7440 - protein, 519 aa, Ralstonia eutropha JMP134
MNRKPASSKPDYLRKILTAKVYDVAQETELTFAHNLSARTGNSVWFKREDTQPVFSFKLRGAYNKMASLTQEELRRGVIAASAGNHAQGVALSAARLQCRAIIAMPVTTPQVKIDAVRERGGKWVEIVLHGDSYSDAYNHAAILEKKHKLTFIHPFDDPEVIAGQGTIAMEILRQHPGPIHAIFVAIGGGGLISGIASYIKAVRPEIKVIGVQTVDSDAMKRSVEAGKRIELKDVGLFSDGTAVKLVGKETFRITRELVDEIVLVDTDAICAGVKDVFQDTRSILEPAGALAVAGLKLYAEREKLKGEHLVAIACGANMNFDRLRFVAERAEVGEAREGVFAVTIPEERGSFKRFCELVGTRSVTEFNYRIADRNIAHIFVGVQIASRAENDKIAANFRRHGFDTLDLSNDELAKQHIRYMVGGVSPLAHDELLYRFEFPERPGALMKFLSSMSPNWNISLFHYRNQGGDTSNILVGIQVPKNEKRAFRAFLSTLGYVHWDETENPVYKLFLSDRGNQA

SEQ ID NO: 7441 - protein, 622 aa, Carboxydothermus hydrogenoformans Z-2901
MGPILERISLPEDIKKLKPSELMALAQELREYIITVASQNGGHLAPSLGVVELTIALHFVFEAPKDKIIWDVGHQAYAHKILTGRKKQFKTLRTFGGLSGFPKRDESPYDAFGVGHSSTSISAALGMALARDLKGEQYEVVAVIGDGALTGGMAFEALNHAGHLQKKLIVVVNDNEMSIAQNVGALSAYLSRIRTDPKYSRGKDELEALIKKIPHIGPTMVKIGERLKDSFKYLLVPGMLFEELGFTYLGPIDGHNIKEMIEVFSRAKTFAGPVVVHVITKKGKGYHWAEENPDGFHGVGKFYISTGEPVEAPRVSFTEVFGKALVELAQDRPEVVAITAAMPTGTGLNYFAQNYPERFYDVGIAEQHAVTMAAGMACEGLKPVVAIYSTFLQRSFDQIIHDVCLQNLPVVFAVDRAGIVGEDGPTHHGIFDLSYLRMIPNLTIMVPRNEDMLRKMLFTALNHSGPVALRYPRGAAVGVELTPYEQLPIGTAEILKEGSDGVVIGVGRPLNYALKAAQKLENEGISLTVIDARFVKPLDYKLLEEVGSLHKPVITVEENVVAGGFGSAVNEYFSFRGIGTKVVNLGIADEFPPHGKVEEILNLYGLTEEKLYLKFREILSKL

SEQ ID NO: 7442 - protein, 598 aa, Arabidopsis thaliana
  misc_feature (545)..(545): Xaa can be any naturally occurring amino acid
MPFWWPLIVLAFAYAICKFLLMLIPPNVPSIDVDASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVVEDRFWPLIKTKIPKPIXRQYPVAENAFEFQEALVETLYGLNIWDRLRSLIDVLKFLTDQSSNVSRTRKSH

SEQ ID NO: 7443 - protein, 431 aa, Acidovorax sp. JS42
MNIDNKTIAIVGLGYVGLPLAVEFGKHRPVLGFDINTARIAELQAGKDHTLECSPEELSNATHLRFSGQADDLKACQIFIVTVPTPVGQANRPDLTPLVKASETVGKALKAGDMVIYESTVYPGATEEVCVPVLERVSGLRFNHDFFCGYSPERINPGDKINTLTKIKKITSGSTPAVADAVDALYNSIITAGTHKASSLKVAEAAKVIENTQRDLNIALVNELSVIFDRLGIDTLDVLEAAGSKWNFLPFRPGMVGGHCIGVDPYYLTHKAEEVGYHPQVILAGRRINDNMARYVARNTIKRMLKNGLDVPRCRIGVLGITFKENCPDIRNSKVADMVREFQAWGAQVVVTDPWADADEVAREYGLQLGQIDVANPVDSLVVAVGHNEYRQATPNELRALCRGSKPVLADVKSLYNRHQAAEAGFTVFRL

SEQ ID NO: 7444 - protein, 390 aa, Streptococcus pneumoniae TIGR4
MVVMNRIRVSKRVEKKLAKGLVLLEASDLENVNLKDQEVEVQGQEGNFLGTAYLSQQNKGLGWFISKDKVAFNQAFFETLFRKAKEKRNAYYQDDLTTAFRLFNQEGDGFGGLTVDLYGDYAVFSWYNSYVYQIRQTISEAFRQVFPEVLGAYEKIRFKGLDYESAHVYGQEAPDFFNVLENGVLYQVFMNDGLMTGIFLDQHEVRGSLVDGLAMGKSLLNMFSYTAAFSVAAAMGGASHTTSVDLAKRSRELSQAHFQANGLSTDEHRFIVMDVFEYFKYAKRKDLTYDVIVLDPPSFARNKKQTFSVAKDYHKLISQSLEILNPGGIIIASTNAANVSRQKFTEQIDKGFAGRSYQILNKYGLPADFAYNKKDESSNYLKVISMKVSK

SEQ ID NO: 7445 - protein, 973 aa, Rhizobium leguminosarum bv. viciae 3841
MTDEALVDRMALPRPDVTATDVEEILLAHYSLSGRLAELGSQQDRNYRVDSDRGRYVLKICHAAYEIRELEAQNAAIRHLKSRQGAPRVPKVIATNDGREIVVLTVRGQGYQVRLLEYLEGQGLTELTYLAPASVAALGALCARLAQALADFNHPGLDRSLQWDLRRAGPVAVQLLSAITDSAARDRIAKTMVMAVRRIQPLAPALRLQAVHHDVTGDNVVGHRDAHGHIIPDGVIDFGDIIRGWLVGDLAVTCASLLHQADGDPFYILPAVTAYQAIYPLSEEELKALWPLIVARAVILVASGEQQISVDPDNDYVRGNLDRERAIFDTAMSVPFDLMEAAILKAAGADVAAPETSGWLPLLPDIDPAGIAYVDLGVRSPHFSAGNWLNTDMDWRLLARMATENGTAATRYGEYRLSRAGTARGQATCALHVDICLAAGSAIAAPFAGRIGWKDQHLTLAGDNMTLHLDGLDLSVDDGAEIAAGDSLGTVFGEASSLGGLRVQLCSVAGLEPPLFASPRAAAAWSVLCPSPSLLLSPQADAPQPETAALFARRRAHLARPQKNYYAAPPQIERGWKEHLFDVEGRAYLDMVNNVTILGHGHPRFAAAIGAQWLRLNTNSRFHYAAITEFSERLAALSPDGLDAVFLVNSGSEANDLALRLAQAHSGARNMLCLLEAYHGWSAASDAVSTSIADNPQAPTTRPDWVHTIVSPNTYRGDFRGPDTAADYLGMATPVLEAIDAAGEGLAGFIAESVYGNAGGIPLPEGYLKELYAQVRARGGLCIADEVQVGYARLGHYFWGFQQQGVVPDIITVAKGMGNGHPLGAVITTREIAQSLEKEGTFFSSTGGSPVSCVAGMTVLDIMAEEKLQENARTVGDHLKARLAALIDRHPIAGAVHGMGLYLGLEFVRDRTTLEPATEETAAICDRLLELGVIMQPTGDHQNVLKIKPPLCLSIDSADFFADMLEKVLEEGW

SEQ ID NO: 7446 - protein, 268 aa, Zea mays
LATPVGGGVSSLNMQLRKELDLYASLVHCSNLPGLPTRHEGVDIVVIRENTEGEYSGLEHEVVRGVVESLKVITKFCSERIAKYAFEYAYLNNRKKVTAVHKANIMKLADGLFLESCREVASKYPGIQYNEMIVDNCSMQLVSKPEQFDVMVTPNLYGNLVANTAAGIVGGTGIMPGGNVGQDYAIFEQGASAGNVGNENLVEQKKANPVALLLSSAMMLRHLQFPSFADRLETAVKRVVAEGTYRTKDLGGSSTTQEVTDAVVANLD

SEQ ID NO: 7447 - protein, 271 aa, Zea mays
MMWLPFLYPAPASAYMAAMSAVSFVSMANAGLAELRGDHMPYSKFWHAVAGAAGGDTRQRGGMPLLRSRDGMLLAYAPALLAAAASFAVPGAVEGARAELLSAALAAHFLKRILEVLCVHRYSGSMPLGTAATISCSYLVSTATMVYAQHLSRGLPDPAVDLLCPGVLVFAVGLAGNLYHHRLLSGLRADDGTGYKVPRGGLFGFVACPHYLFEILAFFGFAMISQTLYALAVATGTAAYLAGRSCATRRWYRSKFQDFPPRIKALIPYVL

SEQ ID NO: 7448 - protein, 285 aa, Arabidopsis thaliana
MRFVPYLYEIERLWLSLVNYLSPRKNKNRRCGEIDKIRMVKKGGTKRKIAIETIQKSDYLRVTCTKRREGLFSKASQLCLLSDAQIAILATPPTSESNISFYSFGHSSVDAVVSSFLSGQRCVPLQEDTKEMREDVAICLSRTNLGLGFWWNNESLNKSENPQEISDAINSMLTLLSNLKELSGEEALVNDHKDLKKNERSDVVLQHGTQYETLNPNSNTTTICCVPDELPANSNEIVGISPNPLIMLEKKKSQIEEKFEKEWQVSVTRIENEATSSYAKRRRSI

SEQ ID NO: 7449 - protein, 488 aa, Ralstonia eutropha JMP134
MTDAATEARTEVPELPPAPHAKHWRHALNKASAGISGLDSKRSCGRLTRAAGLVLEAVGLRLPVGSDCLIELPAGQFSANLGGQRTAEAEVVGFGADRLYLMPQSDVVGLLPGARVYPLEPSPQPEGASSPREPGSKRLPVGEGMLGRVVDAAGRPLDGLGPIRAAQEVPLSAEQINPLMRAPIQTVLDTGVRAINGMLTVGRGQRMGLFAGSGVGKSVLLGMMARYTSADVIVVGLIGERGREVKEFIEHILGPEGRARSVVVAAPADCSPLLRMQGAAYSTRLAEYFRDQGKHVLLIMDSLTRYAMAQREIALAIGEPPATKGYPPSVFAKLPTLVERTGNGPEGGGSITAFYTVLTEGDDQQDPIADSARAILDGHVVLSRSLAEAGHYPAIDVEASISRAMTALIPPEQFSSVRRFKQLMSRYQRNRDLISVGAYVPGNDPELDLAIRLHPRMEAFLQQDIHERAEYDDAVGQLHSLFDRSEYG

SEQ ID NO: 7450 - protein, 464 aa, Mycobacterium tuberculosis H37Rv
MTHYDVVVLGAGPGGYVAAIRAAQLGLSTAIVEPKYWGGVCLNVGCIPSKALLRNAELVHIFTKDAKAFGISGEVTFDYGIAYDRSRKVAEGRVAGVHFLMKKNKITEIHGYGTFADANTLLVDLNDGGTESVTFDNAIIATGSSTRLVPGTSLSANVVTYEEQILSRELPKSIIIAGAGAIGMEFGYVLKNYGVDVTIVEFLPRALPNEDADVSKEIEKQFKKLGVTILTATKVESIADGGSQVTVTVTKDGVAQELKAEKVLQAIGFAPNVEGYGLDKAGVALTDRKAIGVDDYMRTNVGHIYAIGDVNGLLQLAHVAEAQGVVAAETIAGAETLTLGDHRMLPRATFCQPNVASFGLTEQQARNEGYDVVVAKFPFTANAKAHGVGDPSGFVKLVADAKHGELLGGHLVGHDVAELLPELTLAQRWDLTASELARNVHTHPTMSEALQECFHGLVGHMINF

SEQ ID NO: 7451 - protein, 185 aa, Arabidopsis thaliana
  misc_feature (21)..(21): Xaa can be any naturally occurring amino acid
  misc_feature (107)..(107): Xaa can be any naturally occurring amino acid
  misc_feature (140)..(140): Xaa can be any naturally occurring amino acid
  misc_feature (152)..(152): Xaa can be any naturally occurring amino acid
MVSSMLSSADVDTSPAQATMXINCTGLNSSAAFPGTRRTNKDITSIAYNGGICSCMNVWPPIGKITFETLSYLPDLSDVELAKEVDYLLRNKWIPCVEFELQHGFVXREHGNTPGYYYGRYWTMCKLPLFGCTDSAQVLXEVEDCQKEPPGXFLRIIGFDHTRKVQWISSIAYKPPSYTEAKFLF

SEQ ID NO: 7452 - protein, 437 aa, marine gamma proteobacterium HTCC2080
MDRKTLEAHWMPYTGNRQFKEDPRIITSAEGVWYTDDKGRKVLDGHSGLWTSGLGHGRKEISAAVSQQINTLDFAPPFQFGHPPAFELADRIKGLMPEDLDYVFFTNSGSESADTSLKMARAYWRLMGQPTKTRFVGRMKGYHGVNFGGISVGGIAANRKFFGQGVEADHLRHTMLPQNRFCRGMPQDGAELADELNEMIALHDASTIAAVIVEPMAGSAGVIPPPVGYLQKLRDICDANDILLIFDEVITGFGRCGAMTGADAFGVVPDILNVAKQITNGAIPMGAVIARAGIYDTFMAHGGPDYALEFAHGYTYSAHPVACAAGLAALDVLTGEALPQRVADEAPFFEALLHDALSDKLHVSDVRNYGFAGAITLEPYPGEPLRRPFEVAMKMWEKGFLVRYGGDTIQLAPMFVMERPEMESLVGALADSLQELA

SEQ ID NO: 7453 - protein, 111 aa, Arabidopsis thaliana
MDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 7454 - protein, 285 aa, Candida glabrata CBS 138
MDPEEQLESTEGVPAKSLSLIKHILLVLSGKGGVGKSSVTTQTALTLCGMGYNVGVLDIDLTGPSLPRMFGIEDSSIYQSADGWMPIPVETNGKGKLCVVSLGFLLGSRGTSVVWRGPKKTSMIRQFIKDVTWGELDYLLIDTPPGTSDEHISIAEELRFTNPDGAIVVTTPQGVATADVKKEINFCRKVNLRILGVIENMSGFVCPYCTECTNIFSKGGGESLAKQFDVPYLGNIPIDPKFVDLIENQKKMEGTLVELYEKSSLYPIYLEIMKKVQEESSKPQE

SEQ ID NO: 7455 - protein, 219 aa, Haemophilus influenzae R2846
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEMEKELNNVAGVVTNGIFALRGADVVIVGTPEGAKVID

SEQ ID NO: 7456 - protein, 628 aa, Bacillus sp. SG-1
MIICSVQQISKMFGGNLVFEGLSFEVHDGDRIGFVGRNGTGKTTVFKLIAGVEQPDTGEIHIKKGARIGYLSQIPQYGAQITGYEVLKSAFQDLLETEARLKELESKMGTDDNPENLQRLLEEYGPLQDKFTLGGGYEIEPEMAKVANGLEITDLLDKSFNALSGGEQTKVCLGLILLQKPDLLLLDEPTNHLDIGAVEWLEGFLKEYSGSVMVISHDRYFLDETINKVIDLEDGEVCLYHTNYSQFVKEKEEKLLLEFQQYQEQQKKIKKMREAIKRLKEWANQANPPNAALHKRARNMERALERMEKLKRPVLERKKMGLEFENGNRSGKVVFSMKEAGKSFGGKPLFTKASLDVHFKDRTAIVGKNGTGKSTIIKMLLGELQQDEGEVKVGSNVRTGYLSQHFTVSDPNIRLIDAFRDEVTVTEGEARHILAGFLFYGGAVFRKVGQLSGGEKMRLRLAQLMHQDINFLVLDEPTNHLDIDSREVLEDALESFNGTILAVSHDRYFLNKLFEKTYWIHNKKLYFFPGSYSWAKEKLNEFIAKKEPDQKAEHTVNREVPVKVKKEKPAVSLESLEEELLVIEAEISSIEEQLLNETDLEILQKFYAEKEQKEKEREEKYSALEQLL

SEQ ID NO: 7457 - protein, 397 aa, Klebsiella pneumoniae
MKQVYLDNNATTRLDPMVLEAMMPFLTDFYGNPSSIHDFGIPAQAALERAHQQAAALLGAEYPSEIIFTSWPRATPRHAAIALLPERREIITSVVEHPATLAACEHLERQGYRIHRIAVDSEGALDMAQFRAALSPRVALVSVMWANNETGVLFPIGEMAELAHEQGALFHCDAVQVVGKIPIAVGQTRIHMLSCSAHKFHPPKGVGCLYLRRGTRFRPLLRGGHQEYGRRAGTENICGIVGMGAACELANIHLPGMTHIGQLRNRLEHRLLASVPSVMVMGGGQPRVPGTVNLAFEFIEGEAILLLLNQAGIAASSGSACTSGSLEPSHVMRAMNIPYTAAHGTIRFSLSRYTREKEIDYVVATLPPIIDRLRALSPYWQNGKPRPADAVFTPVYG

SEQ ID NO: 7458 - protein, 87 aa, Physcomitrella patens subsp. patens
MSSQEDLDAKAAAGETVVPGGTGGRSFQAQKNLAEGRSKGGQARAEQLGHEGYVEMGKKGGSATTDMSSGGAAEAAGRGIDETKFTT

SEQ ID NO: 7459 - protein, 508 aa, Burkholderia vietnamiensis G4
MSDASSSSSRSTAASAASDAPKIGVVPATLMVAGNMMGSGVFMLPANLAATGGIAIFGWLITVVGAVSLALVFAKLAAIDPAAGGPYAYARKSFGPYMGYQTNLIYWLANVLGNVGLAVAGLGYLTHFFPVMKDPLVFALAQIFVIWLFTYANILGPNVVGRVQSVTTVVALVPILGMALFGWFWFSKDVYLAGWNVSGTSSIGAIGATLNFTLWAFIGVESASVSAGVVENPSRNVPIATVGGVVLAAVCYVLSSTVIMGMIPNKALLASSAPFADAARLALGDTAANAVALCAALGCLGSLAGWTLLVGQTAKAAADDGLFASVFARVNSKNVPSAGLAIVAVIMTVQVLATMSPSASQQFGKIASIAVIMTLLPYIYSCIAIKVLGYGKMPPHQFTFYTIVGLIGAVYSLWAMVGSDGQQTRWSLIFVIATIVFYELSINRQREIEETHVHPGGRSPRWVRYFALGVTIVALAATFWISVGQHEADLLHARSPAAGVAATQHTGE

SEQ ID NO: 7460 - protein, 205 aa, Chromobacterium violaceum ATCC 12472
MSPHPQPAPEPVIQYIASCKLPTPWGEFVMHGFEEESGQEHVALTLGEVGDGLPVLARLHSECLTGDALFSLRCDCGFQLEAAMEAISKAGRGALLYLRQEGRGIGLINKIRAYKLQDGGADTVEANERLGFPADMRDFRIARHMLAHLGIGSVKVMTNNPRKLATLEAAGIAVVERVPLQVGRNPYNDRYLDTKAAKLGHMLLK

SEQ ID NO: 7461 - protein, 163 aa, Arabidopsis thaliana
  misc_feature (21)..(21): Xaa can be any naturally occurring amino acid
  misc_feature (50)..(50): Xaa can be any naturally occurring amino acid
  misc_feature (81)..(81): Xaa can be any naturally occurring amino acid
  misc_feature (140)..(140): Xaa can be any naturally occurring amino acid
MASSMLSYAAVATSPAQATMXAPFTGWKSSAGFPATRRTNTDITSIASNXGGRVSCMKGWPPIGKKKLETLSYLPDLNDVXLTKEADYLLRNTWIPCAEFKLQHGYAYREHGYTPGCYDGPYWTKWKLPLFGCTDCAQVXNEAEECKREYPGACIRIIGCDNT

SEQ ID NO: 7462 - protein, 506 aa, Dechloromonas aromatica RCB
MLYASPGTAGAKIAYKAQYDNFIGGKWVAPVNGQYFDVVTPISGKPYTKAARSTAEDMELALDAAHAAFPTWGKTSAADRANVLLKIADRLEANLELLAYAETVDNGKAIRETLNADIPLAVDHFRYFAGCLRAQEGGISEIDENTMAYHIHEPLGVVGQIIPWNFPILMAAWKLAPAIGAGNCVVLKPAESTPISILILAELIADILPAGVLNIVNGYGREAGMPLATSKRIAKIAFTGSTSTGRVIAQAAANNLIPATLELGGKSPNVFFADIMDKDDSFLDKAVEGMVLFAFNQGEVCTCPSRALIQESIYEKFMERVLKRVAAIKQISPLDTDCMMGAQCSQEQMTKIQSYLELGKQEGAECLIGGERAHLGGDLEGGYYIQPTMFKGHNKMRIFQEEIFGPVLAVTTFKDEAEALAIANDTIYGLGAGVWSRNGNVAYRMGRAIQAGRVWTNCYHAYPAHAAFGGYKESGIGRETHKVMLDHYQQTKNLLVSYSETKLGFF

SEQ ID NO: 7463 - protein, 535 aa, Brassica napus
  misc_feature (373)..(373): Xaa can be any naturally occurring amino acid
MGQAPSSTAESNGREVDLRLWSVSPLIISGGESMDSGKSDRDYTLDLPDECLAHVFQYLGAGDRKRCSLVCKRWLFVDGQNRHRLSLDARAEIFSFLTSMFDRFDSVTKLALRCDRKSVSLSDEALVVISVRCLNLSRVKLRGCREITDLGMVEFARNCRNLKKLSVGSCNFGAKGVNAMLEHCKLLEELSVKRLRGIHEAAELIHLPGDGSSSSTLRSICLKELVNGQVFEPLVASTRTLKTLKIIRCLGDWDKVLQMIGEGDSSLSEIHLERLQVSDFGLSAISKCSKVETLHIVKTPECSNFGLIDVAERCKLLRKLHIDGWRPNRIGDEGLVAVARHCLNLQELVLIGVNATHKSLSAIASDCEKLERXLALCGSGTIGDAEIACIAKKCGALSTHASEGCPVSDLGIEALAAGCPNLVKLKVKKCKVVTGEIGEWLREQRRTLVVSMDGDETEATVAVDGESETALEEPRVGQAGGGVPEIVGSSNGGGSNNGGSRLATIRSKFGFFAGRNLVSCRFRRWSHNDNGSSST

SEQ ID NO: 7464 - protein, 597 aa, Dechloromonas aromatica RCB
MSSQPRAGRSLFALSAIALFSAAAIGATPQVAMAPEHTVLLKADGTVWHWGVVDFVGARSSPGSSCYAVDSSKAAPAQVSGLSGIIAVAATGRESIALKSDGTVWQWGLNSALLATCPAGSIASAPTKVADANGPLAYITAIWARSGSFFARKSDGSLWAWGNNEMNKLGTDGTVQATSTPKPGPTVQNIAVPLQVDHLKAAAGAWPPATPPLAMTSGDTHTLALFYDGNIKAWGGGEYGERGTGAYGKGANPYWNGWFWKDWPAMTAINGVSGLAAGLYKSAAVKNDGSLWVWGCNQAGELGEGIPVGSHVSVLCERLPKQVGNLSGVAAVAMGESHTTILKSDGTVWGMGFNGSGALAADNSVIRSLVPLQIAGLSGITAIDAAKSCSVAIKNDGTVWEWGGDCNSPKYRTVPPEQINVGSVATGPVCGSASGRSFAAAPAANLCLVGSASAVTGSGPWSWTCGPFNGQSASCAAGNGPVFVLNPASLRVFPGRTITLRAIAQGNGTLAYQWYKMPVTGGKVQVTDRRGMASQFGVRSGIAGSATAQLTISNIQAADGASYFVEAKDQNGVSAQSQLAQVGVMMATKPTRPEPIR

SEQ ID NO: 7465 - protein, 442 aa, Lentisphaera araneosa HTCC2155
MSTIMITLPSLSPTMTEGTIAEWKVKPGDEIESGQVIASIATDKSTVDYESLEEGFLREIILEAGGAGPVGKVIAVFTEEADEDYKEELEAALAEESVPEPEEEASEESSDDAPTASAPKAPVSGGAVTATIVPVSAPPADVPGLGSLSPSAQDIKVSPAARKLAEAKRINLAAVKPATTGDRIVLNDIETLPNGYGASEAQSGSGLVGYVNRASESLTDIPMTQMRQAIANRMVQASAGVPVIYLTTKIEMDRLMDLRAQINSMEGVRISINDFIVKACGLSLAKFPAMNGAFQGDKIVQFNDVDISVAVSIPDGLITPIVRSADSKGLASISKDVKSLVGKARSNSLSPEEYQGGSFTISNLGMFGAVDSFTAILNPPQSAILAVAGTQEELKLVNGEVKSAKVCKMTITCDHRVIDGALAAEFMNALKDYLETPAKLIV

SEQ ID NO: 7466 - protein, 466 aa, Lentisphaera araneosa HTCC2155
MSEKFDVVIIGAGPGGYVAAIKAGQAGLKVACIDKAELGGICLNWGCIPTKAFLKSAEVLQSMKHAGDYGLSCTNAKASLEAIVKRSRGVSSTMVSGIEFLFKKNKVTHIQGTAEIIASNLVQVTDEEGSRHIETDKVIVSTGASPVKIPIFPVDGENIITYRQALEQTKQPKKMLVIGAGAIGVEFSYFFNAIGTEIHLVEMADQLLPVEDADSAKVLEAEFKKQGINAYTKTKTKSVEVIKKGKIKAILEDAKGKETELEVDRVLVAVGMSANTQGIGLEAAGVKLDERGNILVNEFQQTSNENIYAIGDCAGRQMLAHKASAEGEVAVDHIAGKAKHGVDYGQIPGCTYCQPQVAGVGLTEKAAKAAGKEIKIGRFPFTASGKAHGVGHPEGLVKLIFEAGSDQLLGAHIVGYDATEMIAELGLAMKLEATWEEIAHTVHAHPTLSEAVMECAMDSQGKAIHI

SEQ ID NO: 7467 - protein, 375 aa, Clostridium tetani E88
MNIKRNILLNPGPATTTDTVKMAQVVADICPREKEFADLMKQMRMDLVGIVHGNPEKYTCVMFTGSGTLNMDVCLNSLLPANKKVLIINNGAYSSRAVEICEYYGLSHINLKFSYDERPDFDVIEKTLKENLDIALVYTTHNETGTGILNPIKEIGALVHKYNATFVVDTTSTYAMIPIDMDRDNIDFCMASAQKGLSAMTGLSFIIGNREMIIKSKDYPKRSYYCNLYLQYHYFETTGEMHFTPPVQTVYATAQAIKEYFKEGEQAKWKRHLCVFESIHKELEKLGFKDVIKREWQAGLVISVKYPDDPNWNFEKIHDYCYKRGFTIYPGKIENTNTFRLCSLGAIDVSDIKTFFKIFGEALIVNNVSIPVIYK

SEQ ID NO: 7468 - protein, 318 aa, Pneumocystis carinii
FSATYNQDTLRSKEIESYLRQEQEHACHEAKILLLGAGESGKTTILKQMKLLHLSGLTLKEREYYRTIIFSNMLQSMRLIIEAMEEFDICVERRENEQYLDLLLQERELTNRENLPPEYYRPFISLWEDAGVTRAVNRGNEYALHDNCFYFFENIHRLFERKYTPTDQDILRCRLKTTGITETCFKVSRLTYRMIDVGGQRSERRKWIHCFENVTAVLFLVAISGYDQCLTEDIGANRMQEALVLFDSICNSQWFINTSIILFLNKIDLFKVKLHVSLISNYFPDFNNENQTDYRACCLFFRQKFLRLNRNHQKTIYT

SEQ ID NO: 7469 - protein, 484 aa, Francisella tularensis subsp. tularensis SCHU S4
MSQKLKRGLHTRHMSMIALGGCIGTGLFVALGGAIADAGPGGTVLAYVIIAIMVYFLMASLGEMAAHSPVSGTFCEYATRYVDPALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKAGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMEGRTWFSVIIEFLSTYIGFFAFVILYFVYKFIKKTKLIRLEDCDLTRES

SEQ ID NO: 7470 - protein, 561 aa, Acinetobacter junii
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAHVSLIERGTIGGTCVNVGCVPSKIMIRAAHIAHLRRESPFDGGIAATVPAIDRSKLLAQQQARVEELRHAKYEGILDGNPAITVVHGEARFKDEQSLVVRLNDGGERVVAFDRCLVATGASPAVPPIPGLKDSPYWTSTEALVSDTLPERLAVIGSSVVALELAQAFARLGSQVTILARNTLFFRDDPAIGEAVTAAFRAEGIKVLEHTQASQVAHVDGEFVLTTGYGEIRADQLLVATGRAPNTRSLALEAAGVAANAQGAIVIDKGMRTSTPHIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 7471 - protein, 250 aa, Vibrio vulnificus CMCP6
MLRYNRQIILRQFDFEGQEALKQSSILILGAGGLGCAASQYLATAGVGKLTLIDDDIVELSNLQRQVLHHDADIGRKKVESAAQSLRELNPHIEVVTVAQRLSDSELETLIKNHSLVLDASDNVETRNQLNRLCFATKTPLVSGAAIRMEGQVSVFTYQNANEPCYQCLSALFGSNALSCVEAGVMAPVVGIIGAVQAMEAIKVLAHFGTPKSGKILILDAMTMSWREMNLMKLPACPVCNDDSQRTSQT

SEQ ID NO: 7472 - protein, 221 aa, Zea mays
MATTKREKVILVLLFSLTMLPLSTLGTRSGPAAVQHHGHGGTTKHPSPPSPATAALVRSTCNSTAYYDVCVSALGADPSSATADVRGLSTIAVSAAAANASGGAATAAALANGTGTASSSNAQAAPATASAAAALLRTCAAKYGQARDALAAAGDSIAQQDYDVASVHVSAAAEYPQVCRVLFRRQKPGQYPAELAAREETLRQLCSVALDIIGLASTNTN

SEQ ID NO: 7473 - protein, 380 aa, Chlamydomonas reinhardtii
MARTGALLLAALALAGCAQACIYKFGTSPDSKATHTGDHWDHSLNGENWEGKDGAGNPWVCKTGRKQSPINVPQYHVLDGKGSKIATGLQTQWSYPDLMSNGSSVQVINNGHTIQVQWTYDYAGHATIAIPAMRNQSNRIVDVLEMRPNDASDRVTAVPTQFHFHSTSEHLLAGKIFPLELHIVHKVTDKLEACKGGCFSVTGILFQLDNGPDNELLEPIFANMPTREGTFTNLPAGTTIKLGELLPSDRDYVTYEGSLTTPPCSEGLLWHVMTQPQRISFGQWNRYRLAVGEKECNSTETDAAHADAGHHHHHHRRLLHNHAHLEEVPAATSEPKHYFRRVMEETENPDAYTCTTVAFGQNFRNAQYANGRTIKLARYE

SEQ ID NO: 7474 - protein, 593 aa, Arabidopsis thaliana
MASKIIAGKPDDTEYEIIEGESESALAAGTSPWMNSSTLKLRHRIGRGPFGDVWLATHHQSTEDYDEHHEVAIKMLYPIKEDQRRVVVDKGVSSINGKICVVMKFYEGSLGDKMARLKGGKLSLPDVLRYGVDLATGILELHSKGFLILNLKPSNFLLSDNDKAILGDVGIPYLLLSIPLPSSDMTERLGTPNYMAPEQWQPDVRGPMSFETDSWGFGCSIVEMLTGVQPWSGRSADEIYDLVVRKQEKLSIPSSIPPPLENLLRGCFMYDLRSRPSMTDILLVLKSLQNSEEEQVRRGIDSREIRKSSATLGYTEWFLSKDHLQVRDTVRSRKPANSCKHENMDVPEGMVVGLERDSTDPDGFVLVKVHGVHDPLRVHVSVLERVTNGLASGDWVRLKVRKDKRHSPVGVLHSIDREGNVAVGFIGLPTLWKGTSSQLQMAKVYSVGQFVKLKANVVIPRFKWMRKGRGIWATGRISQVLPNGCLEVDFPGMLPFGEEHGSYLADPAEVEIVNFNTCQGAVEKYQHLEDFHWAVRPLLIAMGLLTAMKLGICVRKKIGRSKDGKQRDGSTGQGDCKIPDGKGSDKSKWLVFF

SEQ ID NO: 7475 - protein, 270 aa, marine gamma proteobacterium HTCC2080
MSLPLYIVNAFTRTTFGGNPAAVMPLEHWFSDETLLAIAAQHNLSETAFFVHTSAGHYELRWFTPGAEVQLCGHATLASAHVLKAHLGFQGDEVIFSTRFSGKLCARYIGEGIELDFPSLKPQPHSPEPALLAALKTPVIAAAIPEIHPWKALYEVESETALREIVPDFPAIAAAVDHAVIVTARGERHDFVSRFFAPNLRVNEDPVTGSAHCVLTPYWAEKLGSDSLSAAQVSERGGELSCVLAGDRVKLTGQSVTYAVADVVGAIGLD

SEQ ID NO: 7476 - protein, 321 aa, Bacillus cereus E33L
MKALCFEHFGNPDVLQYKDIHDPIINPNEILVRMKAIGLNFADIYRRRGDYHLAGNPPYVLGYEGAGIVEKVGANVTNIHPGDFIAFADVPFANAELVAVPSEKTIQLPNSISFETAASVLLQGLTAHYLTKDSYQIKQGDIALVHAAAGGVGQLLIQIIKLLGGKVIGLTSSKEKAQIATLAGADHVFLYTEAWHTKVVEITNGTGVNVVYESVGSTLEESFNATKIGGTVVFYGMAGGNPAPVDPRMLMDTSKTLTGGDLWNVLTTYEERKKRSTQLFDWIATGKLNIASPTIFALQDGALAHKLLEIRKSTGKILLIP

SEQ ID NO: 7477 - protein, 367 aa, Sinningia cardinalis
MAPSPRVEILASSGNQSIPMEYVRSKEELKSMCTDIFLEEKSNEGPQVPIIDLKAISAEDEDTRKKCHEELKKAAMEWGVMHLINHGVSEEIISRVKIAGKEFFELPVEEKEKYANDQAAGNLHGYGSKLANNANGMLEWEDYFFHCIFPEEKRDFSIWPENPTDYIPSVSQYGKQLRGLATKILSVLSLGLGLEEDRLENEVGGMEELLLQHKINYYPKCPQPELALGVEAHTDISALTFILHNMVPGLQLFYQGKWVTAKCIPNSIIMHIGDTVEILSNGKYKSILHRGSVNKEKVRISWAVFCEPPMEKIVLKPLPETVSQDKPPLFPPCTFAEHVKHKLFRNGSEDAAVDKKSIGDECKEARG

SEQ ID NO: 7478 - protein, 309 aa, Zea mays
MSSPTHVRKAIRFASLRAKIAQQGKTGLALRLLLAAALAGFLLVFAARTLVTPSPAPTSSSQAQEYHQDAAPECGKGNAGLPLAVAEALVHYTTSNVTPQQTADEIGVSLRVLQRRAPCNFLVFGLGLDSPMWAALNHGGRTVFLEEDASWIASVRSKHPGLESYHVAYDTVLTDADSLLGLRDHPACVAQPDLAAAAAASCRLALALKGLPPVFHELEWDLVMVDAPTGWTPQAPGRMAAIYTAGMAARARRPGDGPTDVFVHDVDRPVEDNFSKAFLCEGYLAEQVGRIRHFVIPSHREKDGTPFCP

SEQ ID NO: 7479 - protein, 676 aa, Oryza sativa
  misc_feature (164)..(164): Xaa can be any naturally occurring amino acid
  misc_feature (195)..(195): Xaa can be any naturally occurring amino acid
MNPKLLFFPLLATLLLLCHHAHAVCEPATCGDLTIKYPFWLSGPDLNRSSLAIAACGHPSFELWCSRDGVASLRGSQILVLGIDYTNSSFVAGHKRVADGGDGVCRTDFNISSSLALSPFTISSSNRAICFLYSCNGTEPPEIDGLVNATISNCSKPIYAYLGXGSYDRDKPPAIKAGNCTYSYLPVLWPESPVXNLTAGTNYSPLFKKGFVLEWQKNGFGDCDACNASGGQCRYNNDSAAAFACLCSDGELRGTICAGSKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIGLWCVQVLPMHRPTITQVLDMFERSLDELEMPPKQNFSELLEHPAQEINTESTSSTINTKAAQALSEVLRVEETSLVNSKDPTVTTNYAKR

SEQ ID NO: 7480 - protein, 453 aa, Pseudomonas putida KT2440
MSVNNPQTREWQTLSGEHHLAPFSDYKQLKEKGPRIITKAQGVHLWDSEGHKILDGMAGLWCVAVGYGREELVQAAEKQMRELPYYNLFFQTAHPPALELAKAITDVAPKGMTHVFFTGSGSEGNDTVLRMVRHYWALKGKPHKQTIIGRINGYHGSTFAGACLGGMSGMHEQGGLPIPGIVHIPQPYWFGEGGDMTPDEFGVWAAEQLEKKILEVGEDNVAAFIAEPIQGAGGVIIPPETYWPKVKEILARYDILFVADEVICGFGRTGEWFGSDYYDLKPDLMTIAKGLTSGYIPMGGVIVRDTVAKVISEGGDFNHGFTYSGHPVAAAVGLENLRILRDEKIVEKARTEAAPYLQKRLRELQDHPLVGEVRGLGMLGAIELVKDKATRSRYEGKGVGMICRTFCFENGLIMRAVGDTMIIAPPLVISHAEIDELVEKARKCLDLTLEAIQ

SEQ ID NO: 7481 - protein, 277 aa, Isochrysis galbana
MLSALALATAGALVGTPAAVRQTVAPRAPHVSMRQYYSTSTRGVLMTSMMPDPDKPEIDPRRKDPPSPSPSRPGFLPLPMVGSGDDKMDVMSRLLKDRILLLGQGVDDEVANLLVAQLLYLANEDARKDITMYINSPGGSVSAGMAIFDTMQYVPCDLNTVCFGTAASMGAFLLGAGQKGKRRSLPNSRIMIHQPLGGAQGQAADIEIQAKEILFIRALLCEYIADYTGQPVDKIEDDCDRDFFMTPEEAKDYGIIDEVLASKVRIPTVARPELMMA

SEQ ID NO: 7482 - protein, 467 aa, Idiomarina loihiensis L2TR
MSSNNLHIAVIGSGGSAMAAALKATEGGARVTLIERGTIGGTCVNIGCVPSKIMIRAAHIAQLRRESPFDKGLSTHTLKVNRSTLLEQQQARIEELRESKYQSILRENSAITVINGEARFIDDETLSVSLCDGGEQTVHFDRAFIGTGARPAQPPIPGLAETPYLTSTSALELNDIPKSLLIIGASVVALELAQAFARLGSDVTVLARSRVLSQDEPAIGEAIATVFDREGINVLEHTEASEVRYDGQHFILKTNAGTLKAEQLLVATGRTPNTENLDLKTIGVQTERGAITINDRMQTSNSRVYAAGDCTNQPKFVYVAAAGGSRAAINMTGGDAHLDLSAMPEVIFTDPQVATVGLSEADAKTGGYVTESRTLGLENVPRALVNFDTQGFIKILAESGSGRLLGVQVVAGEAGELIQAAVMAIRAGMTVNELADELFPYLTMVEGLKLCAQTFTKDVKQLSCCAG

SEQ ID NO: 7483 - protein, 243 aa, Ralstonia eutropha JMP134
MSETHFGFEKVDETEKAGKVAGVFHSVASKYDVMNDLMSGGMHRLWKMFTIAQANVRPGHKVLDIAGGTGDLAKAFAKQAGPTGQVWLTDINESMLRVGRDRLLDKGVVTPVALCDAEHIPFPDNYFDLVTVAFGLRNMTHKDAALAEMRRVVKPGGKVMVLEFSKVWKPLEKAYDVYSFQVLPWLGQKVAGDAASYRYLAESIRMHPDQTSLVRLMEQVGLEKVEYFNLTAGVVALHVGRKY

SEQ ID NO: 7484 - protein, 430 aa, Bacillus sp. SG-1
MCSNVLEGGFFMSNAGCGPGNGSQSQSGDAGKGDLKWWQLSLMGVGCTIGTGYFLGSSIGIKNTGPSIVFAFILAAVGTYIVFNLLAKMTAEDPQEGSFCYYADKAYGKWAGFSCGWNYWASNILIMGSQLMALSLLSQFWFEKVPLWVFAAGYAILSIFVVLLGTKGFDKVEDILAIIKTAAIVMFIILAAAVYFGMLKGGGNKPEFPSSAGKLFPEGFKGFWSSLIYAFYAYGGIEVIGLMAMQLKKKEDAPKAGKIMLIVLMIIYVLSLALTVLLVSVDKFTPDESPFVTALAGSNLDFFPHVFNGAIIIAGFSAMTAALFGVTNLLVTMAKDENAPKLFSKKIKKFKELPLPSLGLAAAGLLLSVITALIVPGKIYEYITTAAGILILYNWAFIIISAFKILENKITGKLLAVFGMLLILAAVTVL

SEQ ID NO: 7485 - protein, 91 aa, Brassica napus
MASQQEKKQLDERAKKGETVVQGGTGGKSFEAQQHLAEGGSRGGNTRKEQLGTEGYQQMGRKGGTRTGKAGGEDDEDEGEEMDEPTSRTRT

SEQ ID NO: 7486 - protein, 495 aa, Chromobacterium violaceum ATCC 12472
MARSHAEWKQLAAELKIEGRAFINGEYRDAAEGKRFDCVNPANGAKLAEIAHCGEAEVEAAVKAARRAFESGVWSELAPLKRAAVLKRFAALIREHADELSLLETLDVGKPIGDTTAVDVPASAYCVEWFAEAIDKVGGEVVPVDPKLVGLVTREPIGVVAAVVPWNFPILMASWKFGPALAAGNAVIVKPSEKSPLTAIRIAALAKQAGIPDGIFQVLPGAGDVGRLLALHMDVDCVAFTGSTNVGKLIAGYAAQSNLKRAWLELGGKSPNIILPDCPDLARAARAAASGIFYNMGEVCTAGSRVLVHKDIKERFLEEFKKAAAGFFPGDPLDPATSMGAIVDDIQYRKVLNYIDKGLSEGANLLLGGKAVHTDKGLFIEPTAFDCPSDDLTICREEIFGPVLSVITFSELDDAIRIANDTSYGLAAAVWTSNVSTAHQVSRRLRAGTVWVNCYDEGGDMNFPFGGYKQSGNGRDKSLHALEKYTELKSTLIKL

SEQ ID NO: 7487 - protein, 369 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 7488 - protein, 491 aa, Solanum lycopersicum
MSDLEFFLFLIPPILAVLIILNLFKRKHNFQNLPPGDMGWPFLGETIGYLRPYSATTIGDFMQDHISRYGKIFKSNLFGEPTIVSADAGLNRYILQNEGRLFECNYPRSIGGILGKWSMLVQVGQMHRDMRMIPLNFLSNARLRNQLLSEVEKHTLLVLGSWKQDSVVCAQDEAKKLTFNFMAEHIMSLQPGNPETEKLKKEYITFMKGVVSAPLNFPGTAYRKALQSRSTILGFIERKMEERLKEMNRNENDLLGWVLKNSNLSKEQILDLLLSLLFAGHETSSVAIALSIFLLESCPAAVQQLTEEHLEISRAKKQSGETELNWDDYKKMEFTQCVINETLRLGNVVRFLHRKAVKDVRYKGYDIPCGWKVLPVISAAHLDPSLFDRPHDFDPWRWQNAEESPSGKGGSTGTSSTTKSSNNFMPFGGGPRLCAGSELAKLEMAIFIHYLVLNFHWKLAATDQAFAYPYVDFPNALPINIQHRSLNKLHD

SEQ ID NO: 7489 - protein, 377 aa, Chlamydomonas reinhardtii
MARTGALLLVALALAGCAQACIYKFGTSPDSKATVSGDHWDHGLNGENWEGKDGAGNAWVCKTGRKQSPINVPQYQVLDGKGSKIANGLQTQWSYPDLMSNGTSVQVINNGHTIQVQWTYNYAGHATIAIPAMHNQTNRIVDVLEMRPNDAADRVTAVPTQFHFHSTSEHLLAGKIYPLELHIVHQVTEKLEACKGGCFSVTGILFQLDNGPDNELLEPIFANMPSREGTFSNLPAGTTIKLGELLPSDRDYVTYEGSLTTPPCSEGLLWHVMTQPQRISFGQWNRYRLAVGLKECNSTETAADAGHHHHHRRLLHNHAHLEEVPAATSEPKHYFRRVMLAESANPDAYTCKAVAFGQNFRNPQYANGRTIKLARYH

SEQ ID NO: 7490 - protein, 130 aa, Chromobacterium violaceum ATCC 12472
MKLAYTIIYVPDVPASLRFFEAAFGFKRKFLHESETYGELDTGETTLSFAQHELAAGNLPDGHVRADQSARPLGMEIGLVTDDVAAAHAKALAHGAAELSPPKTKPWGQTVSYLRAPDGALIELCSPVSA

SEQ ID NO: 7491 - protein, 309 aa, Aeropyrum pernix K1
MSTQEGGRASKGFRVSRSEYKAIAERMKTIQEQQMKIVRNMRRIRYKIAVISTKGGVGKSFVTASLAAALAAEGRRVGVFDADISGPSVHKMLGLQTGMGMPSQLDGTVKPVEVPPGIKVASIGLLLPMDEVPLIWRGAIKTSAIRELLAYVDWGELDYLLIDLPPGTGDEVLTITQIIPNITGFLVVTIPSEIAKSVVKKAVSFAKRIEAPVIGIVENMSYFRCSDGSIHYIFGRGAAEEIASQYGIELLGKIPIDPAIRESNDKGKIFFLENPESEASREFLKIARRIIEIVEKLGPKPPAWGPQME

SEQ ID NO: 7492 - protein, 444 aa, Chromobacterium violaceum ATCC 12472
MNHQINEWLREHRITEVECIVPDMTGIARGKIVPKDKFVSDPEMRLPEAVLIQTVTGDYPDDSLLDLTDPDMVLEPDPNTLRYVPWAVDPTAQLIYDCCRADGSPVDVAPRNVLKRVLGLFDEMGLEPVLAPEMEFYLLSPNPDPDIPLAAPIGRTGRAEFGRRSYSIDAVNEFDPLFEDIYDYCHAQNLEVDTLIHEIGTAQMEINFLHGNPLELADQVFLFKRTVREAAFRHNMYATFMAKPMENEPGSAMHIHQSLVDKNTGRNVFTNEDGSPSDIFFHFIAGLQKYVPQTMPLFAPYVNSFRRLSRYTAAPTNVEWGYDNRTVGLRIPHSSPAARRIENRVPGVDVNPYIAIAATLACGYLGMVNKLRPTEPRQTDAYELPYQFPNSSEESLLQLAGCSEIAEVLGPRFVKMYVAMKEKEFSEYFRVISPWERKFLLLHV

SEQ ID NO: 7493 - protein, 196 aa, Chlamydomonas reinhardtii
RLTLLYSHGNAVDLGHMLPVYRELSRLLKVNVMGYDYSGYGCSTGTPTVTNTLADITAVLACLQDTYGIPAGRVVLYGQSVGSGPSCYLGAERADLAGVVLHSPLLSGVRVLKPHVRWWPAWADVYPNHTLAPKIKSPVLVMHGTEDEVIHISCGRRLLELCPNKATPLWAAGYGHQDLEMCSGYLPSLENFLAKV

SEQ ID NO: 7494 - protein, 227 aa, Arabidopsis thaliana
  misc_feature (22)..(22): Xaa can be any naturally occurring amino acid
  misc_feature (73)..(73): Xaa can be any naturally occurring amino acid
  misc_feature (83)..(83): Xaa can be any naturally occurring amino acid
  misc_feature (121)..(121): Xaa can be any naturally occurring amino acid
  misc_feature (142)..(142): Xaa can be any naturally occurring amino acid
  misc_feature (165)..(165): Xaa can be any naturally occurring amino acid
MASSMLSSGAVVTSPAQATMAXPFIGLKSSVSFRVTRKANNDINSITSNGGRVSWMKVWPPIGKKKFETLSYXLPDLTEVELXARKLSYPSPPTNWIPLLLNFELEQGFVYREHGNTPGYXDGRYWTMWKLPLFGCTDSAQXVLKEVEECKKEVTPGPLSFRIIXFDNTPSSPNAFQFPFALPSPPPRLSTRKLKFSFFLNHFFIKFILCLHFPFSLFVLLFLFLLY

SEQ ID NO: 7495 - protein, 257 aa, Streptococcus pneumoniae TIGR4
MESKFEFAKELVKKAGQYILDHMQEDLRVETKSSPTDLVTRLDKEVQELLVGEILSRYPEDKICAEEGCLRASVQEGKVWVIDPIDGTNNFVAQQEDFAVMMAYFENGQGQFGLIYDVVKGDCYHGGGEFPVCLNDRSLAPFKTKPLGDFLIAGNSGMLETNEWGLADLSRAVLGVRVYGSAAISFAKILSGRLLTYLTYLQPWDYAAASILGESLGYRVVTLFGEAPDFQTRQPVMMVPLEMQEEIQSYIYERKRT

SEQ ID NO: 7496 - protein, 358 aa, Ustilago maydis 521
MADFVKLSIFGTVFEVTTRYVDLQPVGMGAFGLVCSANDQLTSTSVAIKKIMKPFSTPVLSKRTYRELKLLKHIRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDVWSAGCIFAEMLEGKPLFPGKDHVNQFSIITELLGTPPDEVIKTICSENTLRFVQSLPKRERVPFSQKFKNADPMALDLLEKMLVFDPRTRISAAEALAHPYLAPYHDPTDEPEAEEAFDWSFNDADLPVDTWKVMMYSEILDFHNIDNSGQDEGPVPPVNN

SEQ ID NO: 7497 - protein, 256 aa, Yersinia pestis CO92
MPNDYKWFDTAFSLSGKVAAITGGATGIGHAIAELYLAKGARVVLMDCADNVAEIAEQLDRDNAVGLHCDVSDSQSVRQAVAQAIGAFGQLDILVNSAGIAALDPAEKVREQDWDRTIDINLKGVFLMCQEVGKHFIQHGHGKIVNLASQAGVVALPNHLAYCASKFGVIGITKVLALEWGPLDIQVNAISPTVVLTALGQKAWSGQLAEDMKLKIPARRFAYPAEVAACALFLASDAANMITGENLVIDGGYTIQ

SEQ ID NO: 7498 - protein, 267 aa, Ralstonia eutropha JMP134
MSIPSFGVGTFRLTGQAAVDSVYNALDLGYRAIDTAQIYGNEADVGQAIAESGVKRDELFLTTKIWTEHYAADKLVPSLRESLDKLRTDYVDLTLIHWPAPGNGVPLREFMEALAAAKSLGLTRQIGVSNFNIALTHQAIDVVGKGEIATNQIELSPYLQSRKLTAFLTEQGIAVTSYMTLAYGKVLTDPVLAQIAAKHGATVAQVALAWALQLGYAVIPSSTKRENLASNLLARDLKLDAGDMAQITALERNGREVNPEGLAPEWD

SEQ ID NO: 7499 - protein, 371 aa, Yersinia pestis CO92
MSHENLKGAQMAEGIPETMRAVVAYGPRDYRFERVPVPTIDAKEILVKVEGCGICAGDTKAFEGAPSFWGDDKQPAYIKAPMIPGHEFIGHVVGLGADVEGFELGDRVTSEQIVPCWGCRFCNHGQYWMCEKHDLYGFQSNVNGAMAEYLKFTKEAINYHVPDHLPLEKAILIEPYACAFHAVQRAKIKLGDVVVLAGSGTLGLGMIGAIKKSGAAKLIVLDLSDDRLALAKKFGADLVLNPSRDDVNTLIKEMTGGYGCDIYIDATGAQKAVEQGLTLLRKLGTFVEFSVFKDPVTVDWSIISDRKELDVLGSHLGPYCFPLVIEGISNGDLPTEGVVTHILPLEKYAEGIELVKRGVDSLKVVLNPNLT

SEQ ID NO: 7500 - protein, 609 aa, Saccharomyces bayanus
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYHFWC

SEQ ID NO: 7501 - protein, 1613 aa, Oryza sativa
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGIRHALRPDPPTPRRRLSPESELSALNPPQTPAVQIPPEPSSRPPAAAAAAPEAEGAEALHEISGPAAAAARLVMLLASCLRGRLRLHRRPRPLIMPSPLFLSRNPNPSPPRSATATGTTILSPPSTSASASMSTSGVYVPPMRRLRSVIASTNGSLAPPPSAAAQAQPGGSTLDNIDEWKWKLHMLLRNEDEQEVISRERKDRRDFEQLSQLAERMGLYSRQYSRIVVFSKVPLPNYRSDLDDKRPQREVSIPSGLQREVDALLSDYLARKRTSSGSFPNAAFSRSSSTDSFATDESFLEQQDNQTSTSAVIERIQRRKSLQLRNQQESWQESHDGQSMMEFRRSLPAYKERQTLLEAIAQNQVVVVSGETGCGKTTQLPQYILESEIDAARGATCSIICTQPRRISAIAVSERVAAERGEKIGESVGCKVRLEGMKGRDTRLLFCTTGVLLRRLLVDRNLKGVTHVIVDEIHERGMNEDFLLIVLKDLLPRRPELRLVLMSATLNAELFSSYFGGAPMIHIPGFTYPVRSRFLEDILEITGHRLTPYNQIDDYGQEKSWKMQKQALRKRKSQIASVVEDTVQAADLRDYSARTRDSLSCWNPDSIGFNLIENVLCHICQKERAGAVLVFMTGWDDINALKEQLQANPLLGDPSKVLLLACHGSMASSEQKLIFDRPEPGVRKIVLATNLAETSITINDVVFVVDCGKAKETSYDALNNTPCLLPTWISKASARQRRGRAGRVQPGECYHLYPQCVYEAFADYQLPELLRTPLQSLCLQIKSLRLGSISEFLSRALQSPESLSVENAIEYLKVIGAFDRNEELTILGKHLSMLPVEPKLGKMLIFGAIFNCLDPILTIVSGLSVRDPFLTPFDKKDLAESAKLQFSCRDYSDHLALVRAYEGWREAERDRNGYDYCWKNFLSVQTLKAIDSLRRQFLFLLRDTGLVDENMTACNKWSRDENLVRAVICAGLYPGVSSVVNKEKSISLKTMEDGQVMLYSSSVNGKETKIPFPWLVFNEKVKVNSVFLRDSTAISDSILLLFGGNIKQGGLDGHLKMLGGYLEFFMSRDLASTYLSLKSELDNLIHCKLQNPRMDIQTSEELLSAIRLLVTEDPCNGRFVYGRQEQRSKKAKTMFSAAPMSHGGGGNGGDNAKNQLQTLLTRAGHDNPSYKTKQIKNSLFRSTVEFNGMQFVGQPCANKKLAEKDAAGEALNWLTGGAPSDSRDPQDMDHMSMLQKPPRRKRHHHRRG

SEQ ID NO: 7502 - protein, 365 aa, Oryza sativa Indica Group
MARIVLVVAFAAVVVVQAAMAQRPGMPPAVVPPSLPTTTPPAPTVVAPPLPTTPPPAVVAPAPPLPPLTPPPAIVPPALPPPPPLPAIVVPPALPPTPAIAVPPALPPIPAIVPPSLPPTPEANLPCVAELAPCSEFYRNATAKPTGACCAPLKKAYESELGCLCSVLTNPAMAATVGVDTKKGLDLFGRCDVKVPTDVCSSHAPAPVRVYNFVKYRSFGSLKFGKVLLQPAVLPQRLPQIFTLSPPTDAKEAAQPLPPCCMNDAAACRSPIASPSPMAGAPYQCTIATYPLSWSLISLRLSSVKRQERYSSRVLNCSILNHSFPDFLNFLHSETKPKNMRLKSEVWQCIVNKKLNDQHKAECLV

SEQ ID NO: 7503 - protein, 285 aa, Bacillus cereus E33L
MKLSVYVASAFSKDHKGGNKAGVVFIENSLTTTQKMAIAKQLGYAETAFISESEIADYKFEYFTPKEEVDLCGHATIGSFAILMHLNKLFRNRYTIETNSGVLTITIKDDSIFMEQNNPIFYDVVSPNEFIDCFDMKAIDNKYPIQIVSTGLKDILIPIKSETRLHALQPSFEKIKEISKYYNVVGMHLYTFNEDRIICRNFAPLYDINEEAATGTSNGALACYLHEQHNLQKEVYVFEQGYSLESPSEILVKLATNSKNEIEKVYVGGKGYYCETQCLNVENME

SEQ ID NO: 7504 - protein, 304 aa, Xanthomonas campestris pv. campestris str. ATCC 33913
MSTTVPMAERSYYEADARERIDGLLDAGSFTEFVGPRRRLISPHLAQLDTPGAFDDGIVVGEGRLRGRHVLIAAQQGAFMGGGVGEVHGAKLTGLLERAAATTPDAVVLLLDTGGVRLHEANAGLIAISEIMRATLGARAAGVPVLALIGSGNGAFGGMGIVARCCSAVIMSEEGRLSLSGPDVIETVRGVEEFDARDRALVWRVTGGKHRYLIGDAQTLVPDRIAAFADAAATTLDTLAEPQGDAALQALEREHHALAARITAYGDCRDGVEIWRRQGIADPERLPLLDTDAFLAATADRSTP

SEQ ID NO: 7505 - protein, 359 aa, Coccidioides immitis RS
MGCSGSKEISPEERQAIKQNASIDKMIRMDKKTYDRTVKILLLGAGESGKSTIIKQMRIIHAGGFPEDERRQTRAIIYSNMIVAFKILLDIMEAEGIEFEAADTKSFAQVIEETEADVESDEAFTDLNVRQAMKSMWADPGVQKAVAKGHEFALHDNLDYYFNSLDRIFTPGWLPNNQDMLHSRLRTTGITETLFELGQINFRMMDVGGQRSERKKWIHCFEGVQCLLFMVALSGYDQCLVEDQTANQMHEAMMLFESLVNGEWFRRKPVILFLNKIDLFKQKVPTSPVSKHFPDFKGPDGDYQAATKFFSDRFKGMTRMPEREIYVHHTNATDTTLLKATMDSVQDMIIQKNLNNLVL

SEQ ID NO: 7506 - protein, 458 aa, Pseudomonas putida KT2440
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVTKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRIEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 7507 - protein, 454 aa, marine gamma proteobacterium HTCC2080
MLLGQAMTAMIYPTTNPAATEVMVVSRGEGPYIYDQAGKQYLEGMAGLWCTSLGYGNQEIIETATRQMEQLSFSHMFSGKTHPSAIELADKLAAMAPIDDARVFLGASGSDANDTLVKLIRYYAVASGQPDRVKIIARDKGYHGVSVASAALTGLHANHAHFQLPFDALGVLRTGAPHYYRCAEAGETEADFVARRASELEALILDEGPDTIAAMIAEPVNGAGGVIIPPEGYFEAVQAVLDKYGIMLWDDEVICGFGRLGAAFGAEKLNMKPRMMACAKALTSAYVPLSAAIVAGDIAEAIAGPAADMGVFGHGYTYSGHPLGCAVASKVLDIYVRDRLFEHAATLGAYMSKRLAEFSDHPLVGEVSAMGLLGALELVANKDSKQPFEGMRVAQFCAKAAEDNGLIIRPLGGNRMALCPPLIIQEAHVDEIMDKLSRALDSTLDFVTAEGLTV

SEQ ID NO: 7508 - protein, 217 aa, Brassica napus
MSSDKDNNLNMSDLTAALNEEDRAGLVNALKNKLQSLAGQHSDVLENLSPAVRKRVEVLRDIQNQHDEIEAKFFEERAALEAKYQKLYQPFYTKRYEIVTGVVEVEGAPEEEDKAAEEKGVPDFWLIALKNNEITTEEITERDEGALKYLKDIKWNKVEEPKGFKLEFFFDENPYFKNTLLTKTYHMIDEDEPILEKAIGTEIEWYPGKCLTQKILK

SEQ ID NO: 7509 - protein, 126 aa, Zea mays
SVGLFRVPSGGGKLKRAGPEGGVNGVVFPPGARPRGSAGSNFLGGEGVQGLKIGGNLIKLTAMGVNLEDAAVPALAKKGGGKTAEKLASDAAFFRKVVRGDLKKFTRGTMILPLTGNQYAEKVTEN

SEQ ID NO: 7510 - protein, 412 aa, Zea mays
MNEASASAGVGTGSGGEVPLVYKAWKGNNVFLLKGRFIFGPDARSLFVTMFLIVAPVSIFCPLVAKELMDKFSYGLGLPVMIAAVLFTAYDLSLLLLTSGRDPGIIPRNAHPPEPEGFDDNAEVGANQTPPVRLPRVKDVVVNGITVKIKYCDTCMLYRPPRCSHCSICNNCVERFDHHCPWVGQCIGLRNYRFFYMFVFSTTLLCLYVFGFCWVFVVKIRNAEQITIWKAMTKTPASVALIIYTFIAVWFVGGLSVFHLYLMSTNQTTYENFRYRYDQRANPYNRGIMVNIKQILFTTIPPSKNNFCGRVQQEHGLRPRPTNGFMSPNMGRAVGDIEMGRKPVAWDEPRMAAEIGDLGAGLSNLLEDKDGRFRSASPDLSRDALAVGGGLEEEGSSAMNAGRSSWGVEAGR

SEQ ID NO: 7511 - protein, 311 aa, Klebsiella pneumoniae subsp. pneumoniae MGH 78578
MENLDVITIGEAMAMFVATETGDLAEVEHFMKRVAGAELNVATGLARLGLKVGWVSRVGNDSFGRFVLQSLAKEGIDSHAVAIDNRFATGFQMKSKVENGTDPIVEYFRKGSAASHLSPDDFRADYFTSARHLHLSGVAAALSESSYALLEHAAKVMKAEGKTLSFDPNLRPVLWKSEAEMVEKLNRLAFQADWVLPGLKEGVILTGQQTPEGIADFYLSRGVKAVVIKTGCDGAWFKSASGEQGTVDAIKVDNVVDTVGAGDGFAVGVISALLEGKTLLQAVNRGNKIGSLAIQVQGDSEGLPTRDALGE

SEQ ID NO: 7512 - protein, 506 aa, Leptospira interrogans serovar Lai str. 56601
MKQKIAFILYTIWFISCSPQSRIDIAPLLLATLSQTTGSQNEISFQVLSPREGEILTVYQLETIVQANSDGEFEIFHEGNKLFSFQSTPSSPQTSPTFKPKNGHNTIQIRFKKSNGFVLSQEIHFYFGTKLSAGGAHSGFLINGELYTVGRNNFGQLGTGISTGDGINDRIVKVDPIRDIFSIHFNQNNSMAISQNGRVYTWGANSKGQLGIGNNNTDPARASDPGNRQPPTEIPGINDAVMGAYGFNHALVLKSDGTVVAFGQNNVGQLGNGENNLNRNSFSSNPVNVVQLRNVIQVIAGSEHSAALTENGEVYIWGRNQYGNLGNGIISPANTVQSVPVKVEGLSKIKQIANGRDHILALTSDGKIYSWGLNASGQLGIGGNGNPPPTPIPTQILNIQDVASIWAGGTQSFAILKNGEVKGWGANGNMASLALGESNTQKVYEPNKAVVGIDNVVHFGCGATHNFALLGNGEIYGWGWNFKGSLGRTDLQNNWGAPNPVYIKFP

SEQ ID NO: 7513 - protein, 696 aa, Nocardioides sp. JS614
MTTNDTTSELVARAQEISSDAERVTQAHLRKVSLPSTSGRSGAVLGLITLDNGEDHTKPNTFGPRSLLALNEAIDTALADDEIVALGVTGKPFILAAGADLTSISGGGPDAVRVVAELGHAVFRKLQDGRKPSFGFVNGLALGGGLEVALHCTYRTVMDSAPALGLPEVMLGLVPGWGGAFLVPNLLGADRAVTVILENPLNNGRTLGGAAAYELGLADAVFQGADFLEQSLLWADAVLRGEIVVDRPEVDRGAAWDAAVERARALVQAKTGGASPAALQAVELIDAARDGDRDAGFAREDDALEAMSRTPELIASLYAFDLVQKRAKRPAGAPDKALARPVTKVGIVGAGLMASQMALLFVRRLEVPVVLTDLDQERVDKGVGYVHAEIDKLLAKGRISSDRASRHKGLVTGSVDKSEGFAGADFVIEAVFEEMSVKKSVFADVEKAVSPECILATNTSSLSITEMAADLEHPERVVGFHFFNPVAVMPLLEIVKGERTDDATLATAFATGKALKKTTILVKDSPSFIVNRLLGRFMGEVGRIVDEGTPVPVADSAFAGVVPMPPFMLLSLVGPAIALHNNETLHGAFPDRFYVSPALERVVAARKVSYYGPDGAIDPEVEALLETPAEPVVLEPAQIRTRVLAGLADEARRMLDEGVAVAAEDLDLAMITGAGFSFWNGGLTMLLEREGHGTFH

SEQ ID NO: 7514 - protein, 425 aa, Mesorhizobium loti MAFF303099
MSGRSLMSPVWHPFTQHALELAIPEIARTEGAYLHKADGTRILDAISSWWVVTHCHRHPRIIKAIETTAASLDQIIFAGFTHEPAERLARALVGLAPAGLDWVFYSDSGSTSVEVALKMALGYFRNIGAPRSRIVVMEHSYHGDTIGTMSVGARGVFNAAYEPLLFEVDTIPFPAAGQEQETLDRFEAVSRDRRAAALIVEPLVLGAGGMQMYPAWVLAELKKITEASGTLLITDEVMTGWGRTGTMFACEQASISPDILCTSKGLTGGTIPLAATLATDAIFQAHYSEDRKKTFFHSSSYTANPIACGAALANVEIWRDEPVAERIAALSAMQAAGLRRFGDNPRFTDSRVTGTIAALDLRTSSAGYLADIGPKLRAFFLERGLLVRPLGNVLDLMPPYCITGDELDGLYDAIEEAAERFGSRP

SEQ ID NO: 7515 - protein, 341 aa, Azoarcus sp. EbN1
MPFQISLEPGGQRFTADDDQTILEAALAAGLLLPYGCRDGACGACKGRVLSGEVDIGEVSASALPDAERAAGLALFCRARARSDLVLEARNVRRASDIPVRKLPCRVQRLRRAAPDVMIVDVKLPASETFRFHAGQYIDFILAGGGRRSFSIANAPDDADHLELHVRHVPGGQFTEHVFNAMKERDILRFEGPLGSFGLREDSTGAALLIVGGTGFAPIKSIVEHAIRTGERRPMTLYWGARDRAGLYLDDLARSWESTLPGFRYVPVLSESGPDDSWSGRTGLVHHAVMQDLPDLSVHEVYACGAPAMIDAARRDLVAERHLREEAFFSDAFTFASGAGR

SEQ ID NO: 7516 - protein, 459 aa, Chromobacterium violaceum ATCC 12472
MQKQRTTSQWRELDAAHHLHPFTDTASLNQAGARVMTRGEGVYLWDSEGNKIIDGMAGLWCVNVGYGRKDFAEAARRQMEELPFYNTFFKTTHPAVVELSSLLAEVTPAGFDRVFYTNSGSESVDTMIRMVRRYWDVQGKPEKKTLIGRWNGYHGSTIGGASLGGMKYMHEQGDLPIPGMAHIEQPWWYKHGKDMTPDEFGVVAARWLEEKILEIGADKVAAFVGEPIQGAGGVIVPPATYWPEIERICRKYDVLLVADEVICGFGRTGEWFGHQHFGFQPDLFTAAKGLSSGYLPIGAVFVGKRVAEGLIAGGDFNHGFTYSGHPVCAAVAHANVAALRDEGIVQRVKDDIGPYMQKRWRETFSRFEHVDDVRGVGMVQAFTLVKNKAKRELFPDFGEIGTLCRDIFFRNNLIMRACGDHIVSAPPLVMTRAEVDEMLAVAERCLEEFEQTLKARGLA

SEQ ID NO: 7517 - protein, 625 aa, Bacillus sp. SG-1
MFHSILFNLMLIGLLGILSQWAAWRFRLPAIVIMSIAGLLAGPFLGIIHPQEEFGDLFKPIISMAVAIILFEGSLNLDFREVKGLGRPVFRIVTIGAFLAWILGSLGAHYVAGLSWAVSFVIGGLFIVTGPTVILPLLRQAKLKPRPAAILKWEGIIVDPFGALLAVFAFEIILFLTSEEGASNTLVMFFLASFFAVVFGWLCGRGIGWMFEKGHVPEFLKSPVVFVVVLACFTISDEITHETGLLAVTAMGMTLANMHISSIDDMRHFKENISVLLISTIFVMLTASLSLETLIEIFNWKIIGFVLLMLFVVRPLSIFLSMIGTDLSWQEKTLVGWIAPRGIVALTVSSYFASILLDNGFEDAAILTSVTFALVFGTVTVHGFSIGWLAKKLDLAINERPGVLIIGGSSFSTELAKTFMDLKTPVMVADSSWKRLFSARKAGVPFYKGEILSEQTDYHMDLTPYEYLLATTEVDSYNALVCTTFVPSIGRNNLFQLTLKGKRSDDIEDLVHTLGGRILFQEDATWDELNKRVERGDIIRRTNITEKYSFEEYLYEREEHTILLFVLKPSGKMEFFSPDGSAKAEAGDIVVSLTQPCKEFNKIQEKLVEQREKPAKKNKDEAKDE

SEQ ID NO: 7518 - protein, 112 aa, Zea mays
MKDGTSSGGGAFAAGSDPRQPSTAKPYAPPKLSPQDLPIDYAGFLAVVFGVLGVMLRYKVCSWIAIIFCAQSLANMKNFENDLKQLSMAFMFAVMGLVTNYFGPARPGSTKR

SEQ ID NO: 7519 - protein, 98 aa, Brassica napus
  misc_feature (43)..(44): Xaa can be any naturally occurring amino acid
  misc_feature (71)..(71): Xaa can be any naturally occurring amino acid
  misc_feature (74)..(74): Xaa can be any naturally occurring amino acid
  misc_feature (76)..(76): Xaa can be any naturally occurring amino acid
MVSDQDLAKGVETLLRQSDPSSLTSLTSVVQQLEAKLGLDLTXXTSFIRDQINLLLRPHQPISSSSSSSSXSAXAXTAQPPPPPSQQMHFGVNVPGKG

SEQ ID NO: 7520 - protein, 120 aa, Glycine max
ETIPVIDVEKINSDEGECKKLREACERWGCFRIINHSIPATLMADMKKVIEALLDLPMEIKKRNTEVIAGSGYMAPSKVNPFYEALGLYDLGSSQAMHNFCSQLDASHHQRCGAMEGFAI

SEQ ID NO: 7521 - protein, 254 aa, Escherichia coli
CGWPGIKEILLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 7522 - protein, 270 aa, Triticum aestivum
  misc_feature (260)..(260): Xaa can be any naturally occurring amino acid
  misc_feature (263)..(263): Xaa can be any naturally occurring amino acid
AYLGDTLEQVCTKKQAGTGPEFPGYRRPTRPETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFTEWNKGELLSFLVEITADIFSIKDDPGEGYLVEQVLDKTGMKETGSXDMXQGADLSV

SEQ ID NO: 7523 - protein, 131 aa, Brassica napus
SVGVHTPGELKALEKRMESSQLRTRNLTSSDLVKDHLRYLMGGRSSVEEEVLCQFTFPERPGALMNFLDSFSPRWNISLFHYRAEGGAGANVLVGIQVPEQEMEEFRNRAHVLGYEYVLVSEDTVFKLLMH

SEQ ID NO: 7524 - protein, 633 aa, Saccharomyces bayanus
MSSSTSPYELKDLKNSSTEVHAAEQENEIEYFETDSNDRPSQQPHLDYEQHNTSAVRRFLDSFKRADQDQEQEAEVAQMNDLTSAISPSSRQAHELEKDETTDKIAPHTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGYIGGKYWHEPGAFNGVHAIDRFKGVVATLVTAAFAFGGSEFIAITTAEQSNPRKAIPGAAKQMIYRILFLFLATIIIVGFLVPYNSDQLLGSSGGGTKASPYVIAIASHGVRVAPHFVNAVILLSVLSMANSSFYSSARLFLTLSEQGYAPKIFSYIDRAGRPLIAMCVSALFAVIAFCAASPKEDQVFTWLLAISGLSQLFTWTAICLSHIRFRRAMKVQGRSLGELGFKSQTGVWGSIYSCIMMILILIGQFWVAIAPIGEGKLDAQAFFENYLAMPILIVLYVGYKMWNKDWKLFIRADKIDLTSHRQIFDEELIKQEDDEYRERLRTGPYWRRVLAFWC

SEQ ID NO: 7525 - protein, 188 aa, Brassica napus
MTKQHANWSPYDNNGGTCVAIAGSDYCVIAADTRMSTGYSILSRDYSKIHKLADKAVLSSSGFQADVKALQKVLKSRHLVYQHQHNKQMSCPAMAQLLSNTLYFKRFFPYYAFNVLGGLDEEGKGCVFTYDAVGSYEKVGYSAQGSGSTLIMPFLDNQLKSPSPFLLPAQICLMLSHLFPSLDLVKTE

SEQ ID NO: 7526 - protein, 162 aa, Yersinia pestis CO92
MRIGHGFDVHKFGENGSGPLIIGGVRIPYEKGLLAHSDGDVALHAATDALLGAAALGDIGKLFPDTDPAFKGADSRGLLREAYRRILAKGYKLGNLDITIIAQAPKMAPHIPQMRVNLAEDLQCHMDDINVKATTTEQLGFTGRGEGIACEAVVLLVNVEQG

SEQ ID NO: 7527 - protein, 312 aa, Chlamydomonas reinhardtii
MERFQVIQSLGSGSFGTVRLVKDVAAEKLLAMKVLNRRDASKYVEAEIVNHSLLRHPHIVHFREVFLTDEHLCIVMEYANGGSLFSMVRQQRRLKESMARWFFQQLILAVDYCHKRGVANRDIKLENLLLHLEEGLPHPLLKMCDFGYSKADFRSAAKSQVGTLSYMAPEVMKSCGAYYDAKIADVWSCGVVLYVMLYGIYPFDNQGEDAGLSEAQKVRKMLERMENEAYALNPQVPVTEECIDMLRGLLKPAPESRFTIDKIMEHPWFNKKLPPQAREMNVYYLNLPVPPEYQRPEQIKSLLEEARAVGGR

SEQ ID NO: 7528 - protein, 506 aa, Saccharomyces bayanus
MPESRLQRLANLKIGTPQELRRTSIIGTIGPKTNSCEAITALRKAGLNIIRMNFSHGSYEFHQSVIDNALKSEQQFPGRPLAIALDTKGPEIRTGRTPNDQDFHILVDHQMIFTTDAKFEHSSNDKIMYIDYANLTKVIVPGKLIYVDDGILSFKVLQIMDDANIRVQALNSGYISSRKGVNLPNTDVDLPPLSAKDIQDLQFGMRNGIHMVFASFIRAPEDVLTIRKVLGTEGEDIKIISKIENQQGLDNFDEILQVTDGVMIARGDLGIEILAPEVLAIQKKLIAKCNVAGKPVICATQMLESMTYNPRPTRAEVSDVGNAVLDGADCVMLSGETAKGDYPVNAVKIMAATALIAESTIAHLALYDDLRDATSKPTSTTETVAAAATAAILEQNGKAIVVLSTTGNTARLLSKYRPSCPIILVTRHARTARIAHLYRGVFPFVFEPKRLYDWGEDVHRRLKFGVEMARSFGMVESGDTVVSIQGFRGGIGHSNTLRVSTVGEEF

SEQ ID NO: 7529 - protein, 388 aa, Francisella tularensis subsp. tularensis SCHU S4
MILANDMTNAILVFPDGTYYLGRSIGVRGWTDGEICFNTSMTGYQETLTDPSYAGQIITFTFPHIGNVGINNEDNESLGVFAKGLIVRENLTNPSNFRAKKHIDTWLKNRNIVGICGVDTRAIVRKVRKEGAVRVAILSVKPGEFLDANYVRSRIKNKSNLNGRDLAISVTTNREYDWNEHTFTLGQQVYKQQQSYKYSVVVIDYGVKYNILRNLVDAGFKVTVVPADSTYEDIMKHNPDGVFLSNGPGDPFATSDYTMPVIKKLLEVKMPIFGICLGNQLLALAAGLKTKKMHKGHRGVNQPVLDANTKKVLITSQNHGFVVCDDNVPDNIQIHMSSLFDGTVEGLRFKDRPAFAVQYHPESSPGPHDCKYLFNEFAEMIAESKKGN

SEQ ID NO: 7530 - protein, 306 aa, Francisella tularensis subsp. tularensis SCHU S4
MLSFQKLLRGDQITKDDLFKLFHQADIYKNKLANSEPIKDLEGKILASLFFEPSTRTRFSFESAMNRLGGKVISLENGSSSSTQKGETLDDTGRMIDQYADIIVMRHPKPHSVEEFSKYVNSPVINAGDGENEHPTQSLVDLYTIYSEKGSLDNLKVGFLGDLKYGRTVHSLTNILAKYNASFKFISSKELQIPKKLKDFIIKNGNSFIELDKVSADVLEDLDVLYVTRVQRERFPDEESYLKNKDLCYLDRKHISPRSNFIILHPLPRVDEMDRSIDELECAKYFEQIKYSIPIRMTLLALLVIS

SEQ ID NO: 7531 - protein, 298 aa, Saccharomyces bayanus
  misc_feature (281)..(281): Xaa can be any naturally occurring amino acid
MSRLERLTSLNVVAGSDLRRTAIIGTIGPKTNNPETLVALRKAGLNIVRMNFSHGSYEYHKSVVDNARKSEELYPGRPLAIALDTKGPEIRTGTTTNDVDYPIPPNHEMIFSTDDKYAKACDDKVMFVDYKNITKVISAGKIIYVDDGVLSFEVLEVVDDKTLKVKAMNAGKICSHKGVNLPGTDVDLPALSEKDKEDLRFGVRNGVHMVFASFIRTANDVLTIREVLGEQGKDVKIIVKIENQQGVNNFDEILKVTDGVMVARGDLGIEIPAPEVLAVQXKLIAKSNLAGKPVICAT

SEQ ID NO: 7532 - protein, 487 aa, marine gamma proteobacterium HTCC2080
MNIELTNPTLFRTEAFVNGEWIGADNGARLPVTNPATGALITDVAKTGAAETRRAIAAAETAMLSWRQQPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGGCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 7533 - protein, 261 aa, Candida glabrata CBS 138
MTKFVGCIDLHDGQVKQIVGGTLKDNDDSLETNFVSKYPPSYYAQLYLENRIEGCHVIKLGPNNDAAAMEALNAAPGFLQVGGGINDENCLQWLEKASKIIVTSWLFTKEGTFLMDRLQLLSNKCGPDRIVVDLSCRRTPDSKWVVAMNKWQTLTTLELNKETFTELSKYTDEFLIHAADVEGLCKGIETDLVTKLYEWTKDINKEVKIVYAGGAKSISDLELVDKLSNGTVDLTYGSSLDIFGGKLVRFQDCCEWNSKHN

SEQ ID NO: 7534 - protein, 299 aa, Brassica napus
FVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 7535 - protein, 186 aa, Saccharomyces bayanus
  misc_feature (25)..(25): Xaa can be any naturally occurring amino acid
  misc_feature (57)..(57): Xaa can be any naturally occurring amino acid
ISDVGNAILDGADCVMLSGETAKGXYPINAVTTMAETAVIAEQAIAYLPNYDDMRNXTPKPTSTTETVAASAVAAVFEQKAKAIIVLSTSGNTPRLVSKYRPNCPIILVTRCPRAARFSHLYRGVFPFVFEKEPVSDWTEDVEARINFGIQKAKEFGILKDNDTYVSIQGFKAGAGHSNTLQVSTV

SEQ ID NO: 7536 - protein, 467 aa, Arabidopsis thaliana
MQSSVYRDKASSIAMILETQRNVEFPHRIVDKRPRKRPRLTWDAAPPLLPPPPPPTVFQPPLYYGPEFASGLVPNFVYPNMFYNGLPRQGSPPWRPDDKDGHYVFVVGDTLTPRYQMLSKMGEGTFGQVLECFDNKNKEVVAIKVIRSINKYREAAMIEIDVLQRLTRHDVGGSRCVQIRNWFDYRNHICIVFEKLGPSLYDFLRKNSYRSFPIDLVRELGRQLLESVAYMHDLRLIHTDLKPENILLVSSEYIKIPDYKFLSRPTKDGSYFKNLPKSSAIKLIDFGSTTFEHQDHNYIVSTRHYRAPEVILGVGWNYPCDLWSIGCILVELCSGEALFQTHENLEHLAMMERVLGPLPPHMVLRADRRSEKYFRRGAKLDWPEGATSRDSLKAVWKLPRLPNLIMQHVDHSAGDLIDLLQGLLRYDPTERFKAREALNHPFFTRSREQSIPPFNPNPHPFLYNQKN

SEQ ID NO: 7537 - protein, 472 aa, Bacillus cereus E33L
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKEAEMKDHPFKMPFAPVTNYLTIAFLIMVLIGMWFNDDTRISLVVGIIFLVIVTISFYAFGIGKRTPLDVQNDQEISSK

SEQ ID NO: 7538 - protein, 634 aa, Nocardioides sp. JS614
MGLLDSIASPADLRGLSDAQLEQLASEIRDLLIRTVATNTGHLGPNLGVVELTLAIHRVFDSPRDRVVFDTGHQAYVHKLVCGRAASFGTLRREGGVSGYPSQAESPHDIVENSHASTALSYADGLAKAYTIRGEDRHVIAVIGDGALTGGMAWEALNNIAIAKASKLVIVVNDNGRSYTPTIGGLATALTSLRTNPRYENVLDLVKRRLNAVPGVGPAAYDALHAMKKGLKDALAPQGLFEDLGLKYVGPVDGHDRAAMEQVLAQAKRFNGPVIVHAITRKGYGYDPAERHEADQFHAPGPFDVQTGAEKPKGRIWTDVFSEEIVHLGHRRKDLVGITAAMMHPVGLDAFQKHFPERTFDVGIAEQHAATSAAGLAMGGMHPVVALYGTFLNRAFDQVLMDVALHKCGVTFVLDRSGVTGDDGASHNGMWDMSILQVVPGLRLAAPRDPARLRELLNEAVEVDDAPTVVRFPKGSPPEDIEAVDRAGGADILVRNGTKDVLVVAVGAMGTTAVDVAQRLTAQGIGVTVVDPRWVKPVDPAIVELAREHRLVVSIEDNGETGGCGAVLLQTLNAAGVHTPFRLHGIPQQFLGHAKRAAILERIGLTPQAIALRIVEDMTSLTEGRSPLDVEQAT

SEQ ID NO: 7539 - protein, 307 aa, Nocardioides sp. JS614
MDLTVFPVPGPGAEDVVVAGPGPDEGAVFTGTEDGSIFRVAHDGGRIDRVAHTGGRPLGIELDLDGRLLVCDARRGVLRVDPRGGAVEEVTDRLGGAPMMFCNNAAVASDGTVWFTDSSTRYGIDQWKDDFVQDTRTGRLGRLGTDGTVEVVLDGLAFANGVALAADESYVAVAETGARTVVRWWLTGERAGTRDLLTSDLPGYPDNIARGSDGLVWVSIASPTDPVVERLQRAPLPLRKAVTKIPERLQPKPKRTIRAQAFDDAGRLVHDIDLPGTAYHMVTGVREHDGRLWLGSLHEPAVAVVDI

SEQ ID NO: 7540 - protein, 645 aa, Vitis vinifera
MEHRRLVLLVVFLVIVEMLPAGKSDLAADRTALLGLRKVVSGRTLLWNVSQDSPCLWAGVKCEKNRVVGLRLPGCSLTGKIPAGIIGNLTELRVLSLRMNALEGPLPSDLGSCADLRNLYLFGNAFSGEIPASLFGLTKIVRLNLAANNLSGEISTDFNKLTRLKTLYLQENILSGSIPDLTLKLDQFNVSFNLLKGEVPAALRSMPASAFLGNSMCGTPLKSCSGGNDIIVPKNDKKHKLSGGAIAGIVIGSVVGFVLILIILFVLCGKKRGKKTSAVDVAAVKHSEVEIQGEKPIGEVENGNGYSVAAAAAAAMTGNGNAKGDMSNGGAKRLVFFGNAARVFDLEDLLRASAEVLGKGTFGTAYKAILEMGTVVAVKRLKDVTISENEFREKIEGVGAMDHEHLVPLRAYYYSRDEKLLVYDYMPMGSLSALLHGNKGAGRTPLNWEIRSGIALGAARGIEYLHSQGPSVSHGNIKSSNILLTKSYDARVSDFGLAHLVGPSSTPNRVAGYRAPEVTDPRKVSQKADVYSFGVLILELLTGKAPTHAILNEEGVDLPRWVQSIVREEWTSEVFDLELLRYQNVEEEMVQLLQLAIDCTAQYPDKRPPISEVTKRIEELCRSSLREYQDPQPDPVNDVDDLSSR

SEQ ID NO: 7541 - protein, 463 aa, Pseudomonas putida GB-1
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQMEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVANAKAIIDFVVLTSVTSCLNSSLYTASRMVYSLSRRGDAPACAQVTSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGLLVTRRRARAVVVGGVGQGA

SEQ ID NO: 7542 - protein, 342 aa, Listeria monocytogenes EGD-e
MLNEQQITRLLYRLQDPVLEASLEETEGVLEVQVLEETANIKIALADPAVETDHFVHNIEELLTQFGVNEINIELEYLPAAVIDRIFQARDNILSEASETKFLAIASGKGGVGKSTVSANLAIALAQQGKKVGLLDADIYGFSIPVLLGTTESPHKENGQIIPVETHGIQMISMDFFVEQGEPVIWRGPMLGKMIKMFLEEVRWGKLDYLLIDLPPGTGDVALDIHTLIPKCNELIVTTPHYAAASVASRAGYMAAKNNHKIIGVIENMSYLTLADGQVLKVFGQGGGEKVAADLETQLLIQLPIEQPEPNGNGYVSALFNSSSTSGKAYKTLAEKIIPYLS

SEQ ID NO: 7543 - protein, 206 aa, Bacillus sp. SG-1
MKLIDIAQKLNNNTPVWPGDTPFNFSLNWSKEDTGSVNVGNINFSAHTGTHIDAPYHFDEDGKKVADLPLDSFFGNALVVEISEKESIGAEDLEDLDLRDVTQLLIRTNSWEDKSVFPSQITYLQENIGPFLKKNGIKLIGVDVPSVDPLDSKELKAHHSLQENGIGILEGIVLDGVEPKTYELAAFPLPLEEADGCPVRAVLIDR

SEQ ID NO: 7544 - protein, 243 aa, Chromobacterium violaceum ATCC 12472
MLQNREGQRVPNVTFRIRENNEWKNVTTAELFDGKTVALFSLPGAFTPTCSSTHLPRFNELAPAFFANGVDAILCVSVNDTFVMNEWAKDQEAQNIVMIPDGNGDFTEGMGMLVDKQDLGFGKRSWRYSMLVKDGVVDKMFVEPQEPGDPFKVSDADTLLNYINPSAKKPDQVVVFTKVGCPHCARAKAVLAENGYDFVEVPLDNKIRGKVLGAVSGAMTAPQVFINGELIGSADEVEKRFAK

SEQ ID NO: 7545 - protein, 567 aa, Zymomonas mobilis
SYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 7546 - protein, 360 aa, Escherichia coli O157:H7 EDL933
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 7547 - protein, 267 aa, Shigella flexneri 2a str. 301
MAIPAFGLGTFRLKDDVVISSVKTALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNAIPAQVILAWAMGEGYSVIPSSTKRKNLESNLKAQNLQLDAEDKKAIAALDCNDRLVSPEGLAPEWD

SEQ ID NO: 7548 - protein, 403 aa, Francisella tularensis subsp. tularensis SCHU S4
MFEQIKNNVENAIEALKQGKPVVVLDDYDRENEGDLILPGQKATEENIAFMLEHTSGIICLAMDSKKARELNLTPMVAADQNNSTFTTPFTVTIEAKEGVTTGVSAKDRAHTIQVASKADSKAEELARPGHIFPLIANDKGVLGRNGHTEATVDLMKLSGFNSAGVLCELMNKDGTMMKAAELEAFAKKHDLPLLTIAELYQYRLATENFVTKMASSTIPFKKIGELEMSVYKDNFSGDEVVVLSKPYSGNNPLVRMHSSCITGDIFGSLRCDCQDQLHKGIEMISEEGGFFIYLDQEGRGIGLTNKLKAYNLQMNENMDTLEANLALGLPADARKYDLAIQVLKYNNVNRCRLISNNPEKLAALRNVDIETQPVYCEAFVNSHNRNYLITKKIKAKHTIKGI

SEQ ID NO: 7549 - protein, 576 aa, Yersinia pestis CO92
MNEKHPGPLVVSGKLSDGERMKSESNFLRGTIAEDLNNGLTGGFSGDNFLLIRFHGMYQQDDRDIRAERAEQKLEPRHAMMLRCRLPGGIITPQQWLGIDKFAADNTLYGSIRITNRQTFQFHGILKGNVKPAHQLLNELGLDALATANDVNRNVLCTSNPVESALHQEAYEWAKKISEHLLPRTRAYAEIWLDAEKVATTDEEPILGATYLPRKFKTTVVIPPQNDVDLHANDLNFVAVADKGKLIGFNVLVGGGLSIAHGDKNTYPRKASEFGYIPLKHTLAIAEAVVTTQRDWGNRTDRKNAKTKYTLERVGVETFKAEVEKRAGVSFSAIKPYQFIGRGDRIGWVKGVDKKWHLTLFVENGRLLDYPGRSLKTGVAEIAKIHQGDFRLTANQNLIVAGVPEKDKARIEALAREHGLMDDNVTSQRENSMACVSFPTCPLAMAEAERFLPEFVTRVEGILQQHGLADEHIVLRVTGCPNGCGRALLAEVGLVGKAVGRYNLHLGGNREGTRIPRMYRENITADEILLITDQLVGRWAKERHVDEGFGDFVIRAGVIAPVIDSARDFYDVQEAM

SEQ ID NO: 7550 - protein, 147 aa, Francisella tularensis subsp. tularensis SCHU S4
MRKLAIVVSEFNSLITDKMLEGALEEAYAQGLKDSQICIKKVPGAVELPYAAKLLAETKEFDAIVLLGCVIRGETDHYDYVCDQVSYGTQKVMHQYNLPVIFGILTTHNKEQALERVGGKKGHKGKYSIQAAITMAKMKKDILEQGV

SEQ ID NO: 7551 - protein, 260 aa, Ralstonia pickettii
MQLKGKSAIVTGAASGIGKAIAELLAKEGAAVAIADLNLEAARAAAAGIEAAGGKAIAVAMDVTSEASVNQATDEVAQAFGNIDILVSNAGIQIVNPIQNYAFSDWKKMQAIHVDGAFLTTKAALKYMYRDKRGGTVIYMGSVHSHEASPLKSAYVAAKHALLGLARVLAKEGAEFNVRSHVICPGFVRTPLVDKQIPEQAKELGISEEEVVRRVMLGGTVDGVFTTVDDVARTALFLCAFPSAALTGQSFIVSHGWYMQ

SEQ ID NO: 7552 - protein, 80 aa, Myxococcus xanthus DK 1622
MSTSTIEAKVKSIIADQLGVGEDEIKPESSFIEDLGADSLDIVELVMAMEEEFEVEIPDEEAENIKTVNDAVSYINTHKK

SEQ ID NO: 7553 - protein, 261 aa, Brassica napus
  misc_feature (204)..(204): Xaa can be any naturally occurring amino acid
MKEIADETFFRYCVLTLIFSGPPTAVALKFLQAPYGKHNRSGWGPTLSPPLAWFLMESPTLWLTLLLFPFGRHSHNPKSLLLFSPYLLHYFHRTVIYPLRLLRSSSSSKNGFPITIAAMAFTFNLLNAYIQARYVSHYKNDYDDGVWFWLRFVIGTVVFVTGMWINITSDRTLVRMKKENRGGYVIPRGGLFEFVSCPNYFGEXVEWLGWAVMTWSRAGVGFFLYTCSNLIPRARASHVWYGDKFKDEYPKTRKAVIPFVF

SEQ ID NO: 7554 - protein, 431 aa, Yersinia pestis CO92
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 7555 - protein, 295 aa, Mycobacterium tuberculosis H37Rv
MLFGMARIAIIGGGSIGEALLSGLLRAGRQVKDLVVAERMPDRANYLAQTYSVLVTSAADAVENATFVVVAVKPADVEPVIADLANATAAAENDSAEQVFVTVVAGITIAYFESKLPAGTPVVRAMPNAAALVGAGVTALAKGRFVTPQQLEEVSALFDAVGGVLTVPESQLDAVTAVSGSGPAYFFLLVEALVDAGVGVGLSRQVATDLAAQTMAGSAAMLLERMEQDQGGANGELMGLRVDLTASRLRAAVTSPGGTTAAALRELERGGFRMAVDAAVQAAKSRSEQLRITPE

SEQ ID NO: 7556 - protein, 401 aa, Bifidobacterium longum
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 7557 - protein, 406 aa, Ralstonia eutropha JMP134
MLKLDFHPAGRHFLQIPGPSPVPDRILRAISYPTIDHRGPEFGALGLKVLAGIRKIFKTEQPVVIYPASGTGAWEAALSNTLSPGDTVLMFETGHFATLWKKMAEKLGLRPEFLGLPGIEGWRRGVQADMIEARLRQDSDHAIKAVCVVHNETSTGVTSDIAAVRKAIDAAGHPALLMVDTISGLASADYRHDEWGVDVTVSGSQKGLMLPPGISFNAVSPKAIEASRSARLPRSFWDWEEIIAMNRTGYWPYTPSTNLLYGLSEALDMILEEGLDNVFARHHRLAEACRRAVRAWGLEIQCADPSVYSPVLTGVMMHDGIDADSVRRIIYDRFNMSLGAALGKMKGRMFRIGHLGDCNDLTLMATLSGCEMGLKLSGVPVAASGVAAAMDYLAAHANPLPLRAAA

SEQ ID NO: 7558 - protein, 185 aa, Triticum aestivum
  misc_feature (43)..(43): Xaa can be any naturally occurring amino acid
  misc_feature (111)..(111): Xaa can be any naturally occurring amino acid
  misc_feature (130)..(131): Xaa can be any naturally occurring amino acid
DIGVIAKIESIDALKNLEEIIRASDGVMVARGDLGAQIPLEQXPSIQQRIVRMCRQLNKPVIVASQLLESMIEYPTPTRAEVADVSEAVRQRADALMLSGESAMGRYPEKXLSVLRSVSLRIERWWREEXXQEDWTSSVSSSFSDKIQRNCIQQLNGNNLDRRVSLHEDHGPVDAARPISLTLQS

SEQ ID NO: 7559 - protein, 274 aa, Triticum aestivum
  misc_feature (192)..(192): Xaa can be any naturally occurring amino acid
  misc_feature (218)..(218): Xaa can be any naturally occurring amino acid
  misc_feature (239)..(239): Xaa can be any naturally occurring amino acid
  misc_feature (251)..(251): Xaa can be any naturally occurring amino acid
NKFVQKSRLVPVRNSRDIVDPRVRKKKRPRCAMAGEEQPLTEYEKQRLARIRENEARLQALGIRRLAASPILNQPSSAAAAAAAGGAKRKQKKRSDDADDEYLPSDGGGGEEEEEEEDSSSAGDQDSEEEFKASSRSNQKGKAKKKMNLGSSSKSTVREEGAPFTDFMDDDAALQQAIALSLAEPSKSSVTXTTEPSKSPVTTTTVAETSSRGAKGRXSTPWQNDNTPPGKDSAKIGRXRAGQEQNSLSEXDVVQYSFSLMSWKRILAPWDLEK

SEQ ID NO: 7560 - protein, 283 aa, Listeria monocytogenes EGD-e
MKTVKLNNGVEVPILGFGTYQITDAAEAEHAVKDAIKAGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDIFNNPVLTKIGAKYGKSAAQVILRWLVEQDIIVLAKSVKPERMAQNLAIFDFELTEADKEEIAGLDQGESQFFSHADPEMVKWMASRKLNV

SEQ ID NO: 7561 - protein, 358 aa, Glycine max
  misc_feature (209)..(209): Xaa can be any naturally occurring amino acid
MSAFVGKYADELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAACXYKALNEQHVLLEGTLLKPNMVTPGSDSPKVPPEVIAEYTVQALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNYKY

SEQ ID NO: 7562 - protein, 303 aa, Oryza sativa Japonica Group
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPEEDDKAAAATAAAVAGAGEKKVAA

SEQ ID NO: 7563 - protein, 435 aa, Ralstonia eutropha JMP134
MSSAAPTHTAGQKHALPSYLNADNLGPWGIYLQQVDRVTPYLGSLARWVETLKRPKRAMIVDVPIELDNGTIAHYEGYRVQHNLSRGPGKGGVRFHQDVTLSEVMALSAWMSVKNAAVNVPYGGAKGGIRVDPRTLSHAELERLTRRYTSEINIIIGPSKDIPAPDVNTNAQVMAWMMDTYSMNSGSTATGVVTGKPISLGGSLGRHEATGRGVFVVGSEAARNIGLEIKGARVAVQGFGNVGAVAAKLFQEAGAKVVAVQDHRVSLYNPAGLDVPAMMEYASHSGTVDGFQAETISSEQFWQVDCDILIPAALEGQITAKNAPQIKARLVIEGANGPTTPEADDILRERNILVAPDVIANAGGVTVSYFEWVQDFSSFFWTEEEINERLVRIMQEAFRAIWQVAQDNKVTLRTAAFIVACTRILQAREMRGLYP

SEQ ID NO: 7564 - protein, 502 aa, Triticum aestivum
GEKRGSSPGGGGPSKKKWVPPGARGISQGPLPGKFLIEKFFSLHSILKPWRSTRVTVSTLVLLLLFFSAPTNATRPPATLRIPVVHRDAVFPPPPGASRGSLLSRRAAADAARLPTPRATPPSRRPSGLGLRSSSAHDDRLHSPVMSGLPFDSGEYFASVGVGTPSTSALLVIDTGSDLIWLQCKPCRRCHRQMSPLYDPKGSSTYRQIPCSSPRCFPRHGCDTSTGACGYAMVYGDGSGSRGNLATDRLVFSNDTSVDSVVIGCGHDNAELFDSSAGVLGVGRGAGSLATQVAPTYGRYFAYCLGDRTSVARSSASYLAFGRTPEPPSTAFTPLLSNPRRPNLYYVNMAGFSVGGERVAGGFCSSSLWLDPATGRGGVVVDSGTSISRLPRDVYAALRDAFDARAAAAGMRRLARGISVFDACYELRGASVPAVVLHFAGGADVALPPENYFIPEQGGKYHCLALEATDDGLSVLGNVLQQGFRVVFDVEKERVGFAPNGC

SEQ ID NO: 7565 - protein, 339 aa, Arabidopsis thaliana
MAPVLQSSQPWVEKYRPKQVKDVAHQEEVVRVLTNTLQTADCPHMLFYGPPGTGKTTTALAIAHQLFGPELYKSRVLELNASDDRGINVVRTKIKDFAAVAVGSNHRQSGYPCPSFKIIILDEADSMTEDAQNALRRTMETYSKVTRFFFICNYISRIIEPLASRCAKFRFKPLSEEVMSNRILHICNEEGLSLDGEALSTLSSISQGDLRRAITYLQSATRLFGSTITSTDLLNVSGVVPLEVVNKLFTACKSGDFDIANKEVDNIVAEGYPASQIINQLFDIVAEADSDITDMQKAKICKCLAETDKRLVDGADEYLQLLDVASSTICALSEMAQDF

SEQ ID NO: 7566 - protein, 74 aa, Oryza sativa
  misc_feature (9)..(9): Xaa can be any naturally occurring amino acid
  misc_feature (25)..(25): Xaa can be any naturally occurring amino acid
  misc_feature (29)..(29): Xaa can be any naturally occurring amino acid
VATPDQAHXVHDGLKKSLASNDSAXVAEXTWIIYGGSVTGTNCMELTAKPDVDGFLVGGASLKPEYIDMINSST

SEQ ID NO: 7567 - protein, 1401 aa, Staphylococcus cohnii
MSNKKLNYKVPSIVALTLAGTALTTHYAHAADNTQDQKSNKNVLNDENTIKQSEEIKSEVSNPTTNISGTQTYNDPSQVQELKSDEPENYDAQLDELNKDTSSQNIYPTQNQEDQNNSDINNYTEAHTEQLATEAQNESAQDESNDVSSVTDDNVNVAQNDNDSDVSNTEAPSSNAENENLVASNSSEDTDDNTNVTQNDDDSAASITEVSSNESTSDKENKNHDTSNSSEDKDVNTDVTQNDDDSAASITEVSSDDSTSDAVNENHDASNKTEVKDDNTNVTQNDDDSETSNTEASSNESTSVKENENHDASNSSEDNDVNANVTQNDDDSEASNTEISSNESTSDKENKNHDTSNSSEDKDDNTDVAQIDKDSEASNTEVSSNESTTTNESDKEAQTEKVNTLDSDINTSPKTVQVYKNDATPKLRMTRSVSTPTIATRSAVTKESTTKSSLPKYTPKVNSSINNYIRKNNFKAPNYEQDIASYLPKYQYRYGKPEGIVMHDTANDNSTITGEINYMKNNYNSAFVHAYVDGNRIIETANTDYLAWGAGPAANDRFIHVELVHTHDYDSFARSITNYADYAATNLQYYGLAPDSAEYDGVGTVWTHKAVSNYLGGSDHIDPHGYLANHNYSYDELYDLIYEKYLIKTGKAAAWGTTSSGSTSGSKNESSGSGSTTKPSTNTGKLTVSTNNGVGRINTSNDGLYTTVYDQNGKKTSKTNQTLKVTKSATLGNKNFYLVSDYNKGDLIGWVHQNDVSYNSAKSVVKNNQSYKIKPGEVIYTVPWGTSSQKAGTVSGSSSQTFKASKQQQIGKTNYVYGTVNNLSGWVSLSKLTSTSKTATSPTTNNHLTVNTLTNQQGTVAKTNHGVYTSVYDKKGVQKSYVNGKTYKLSKKATLGNNSFYLITDNKTNTNLGWMQTADITVKEAVTKATATATTSVSKIGQLNTNNSGIKTTVYDKKGKNASKFAGRTYTVTKQRTQGNNTYVLIQNTKQNTPIGWVNTKDINTRDLSKTKAKSGQYTVKATNNGLYAIPWGTKAQQLDTQNNIKNSKFNASKSVFVDKDEYLYGNVNNKTGWISAKDLNKAQTQSAITPQKFDYVIYNANGNYYLDPSVTKSAGSLKGFHESIFTVFEKQIINGVTWYHGKLSNGKIVWIKESDLRKELVKYYKSNLTLDQAVALQHGLKFKPQIQRTPGKWEDATTSEIKNAMNSSKLAKDPTQKYQFLRLDKSQNISGTDLDKLLVGKGILEGQGEAFSEAAKTYNINEVYLVSHALLETGNGTSKLANGGDVVNNKVVTNGAKKYYNMFGIGAVDKDPVKQGFATAKNNGWDTVKKAIVGGAKFIANSYINQGQNTLYKMRWNPDNPGVHQYATDVAWASHNATRIKGFYDSMNKLGKYFDVNTYK

SEQ ID NO: 7568 - protein, 337 aa, Rhodococcus sp. RHA1
MQESTPTPESGVACLGEAMVLVAPDSTLHLAGAEANVAAGLATLGVPAAWVGRLGDDEFGTLIRTELQARGVDVRAIEVDPDRPTGHYSKSTALDEHGEPRTDSLYSRAGSAASAMDPGFLDRPAVADLFGRAAVVHCSGITPALSDSCLALMRRLLRHRPGISGVVSFDVNWREQLWPDGDPRIVVELANLADLVLVGADEALRVLGTADPHELRLILPAPATVVVKDGAHRALAVDRSGRSVAVPALRVDVVEPVGAGDAFAAGYLSGVVRGEDQARCLRRGHIGAAATLTVAADSAPPPAAELLDELLRCSESDWAATSVTADGFSPRESGVNG

SEQ ID NO: 7569 - protein, 525 aa, Idiomarina loihiensis L2TR
MSKDFILPDIGEGIVECEIVEWLVAEGDEVKEDQPVVEVMTDKAMVEIPAKDDGIVEKLYYQKGDIAKVHEPLFAIKPADGSSDEAPAKESEPTKKEEPKTEEEQTSSSGDTTDFILPDIGEGIVECEIVEWLVSEGDEVKEDQPVVEVMTDKATVEIPAKDDGTVVKLYHKKGDIAEVHKPLFALQPAGGVQSSGSNAPQSHVDPDAKTSPSDSKAEAEPPAKARQGKAIASPAVRRLARESDINIAEVPGSGKKGRVLKKDIEAFKSGEQKSAASSDSQQPQKAAATSGGTRTEAIRGVKAAMAKQMMSSVSTIPHFTYADEFDVTDLIALREKLKEQYKEKGIRLTVMPFFIKALSLALKEFPVMNAQVNEDCTEITYFDDHNIGMAVDTKIGLLVPNVKQVQNKSIIDVANEVTRLTQASREGKLPQADMKGGTISISNIGVIGGTVATPIINKPEAAIVALGKVQELPRFDANGNVVARKIMTVSWSGDHRIIDGGTIARFNKLWQEYLEDPTSMLVNMV

SEQ ID NO: 7570 - protein, 357 aa, Ralstonia eutropha JMP134
MSQYRIAVIPGDGIGTEVMPEGIRVMDAAARKFGIDFQWDHFDFSSCDYYARHGKMLPDDWFDTLVKYDAIYFGAVGWPDAVPDHVSLWGSLLQFRRSFDQYVNLRPVRLMPGIKSPLADRKPGDIDFYVVRENTEGEYSSIGGRMFPNTEREIVMQETVMSRVGVDRILKFAFELAKKRPKQHLTSATKSNGISITMPYWDERVEAMAANYPGIKVDKYHIDILTAHFVQHPDWFDVVVASNLFGDILSDLGPACTGTIGIAPSGNINPDRTYPSLFEPVHGSAPDIAGRGVANPIGQIWCGAMMLEHLGHDAAGAAVLGAIEKVLSEGPDHAPLTRDIGGKAGTEDLGRAIAEAL

SEQ ID NO: 7571 - protein, 297 aa, Nicotiana tabacum
MGEKPKSGGVWPTVKPFVNGGASGMLATCVIQPIDMIKVRIQLGQGSAVDVTKTMLKNEGFGAFYKGLSAGLLRQATYTTARLGSFRSLTNKAIEANEGKPLPLYQKALCGLTAGAIGACVGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 7572 - protein, 1290 aa, Oryza sativa Indica Group
MSGLDLREMLSSAARRHTWRRSGWGAEWGGGDDARSAALPARCPPPPPPRRPAAAGGRGDEGSGGLRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGTLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPETFAVTEVLTSHAYDEMMQIKALQEGGSDAAQETEHDLPMGGKCETILPDASPKCSFGGPSNEIVHGKRVLGSHGMKGEVPSLAIEDNGGIAQIDQELEDVEMTTGEYRVQDAQIATHVIPHESTTGRHEGGLCASAAAEDVKVMNKYKGTLPKAAAKSSMNIATGVFGDGIMRSKILSTARKVVKPPVRASHKPPLNTLHRPFSTNSASFGHKKLKVKRPDQSKDIPMKIASTSGLAGKDNLTDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFLSRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 7573 - protein, 295 aa, Nicotiana tabacum
EKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 7574 - protein, 300 aa, Nicotiana tabacum
MGDKAKSTSSAGAWPTVKPFANGGASGMLATCVIQPIDMIKVRIQLGQGSAGEVTRTMLKNEGFGAFYKGLSAGLLRQATYTTARLGSFRVLTNKAIEANDGKPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 7575 - protein, 1337 aa, Chlamydomonas reinhardtii
RGRWLQAGVVLPSVTVDYRNLRIDTEALVGSASIPTVANVPLTFLRKLFGVHNEREAKPLTILNDLQGRLVPGRLTLLLGPPSCGKSSFMRALTGRLMPAQGRLTGDVRYNGHPLEDFNVRRTAGYVEQIDNHNPNFTVRETLDFAHTCQVGLHGARIDVPAEVAAHPPAGAKPHDEFEALLRQAWGTNVRVDIVMSLLGLAHCSETLVGDALMRGISGGERKRLTAAELLVGGSNVLMLDEMSTGLDSATLFTVVRWLRQATMSMQLTMLVSLLQPPPEVFGLFDDVILMTEGRILYHGPVSDVVPHFRSLGLECPDRKDVPSFLLEITTPLGQRQFAGPELRQRFNLPPPDVDLQQHLILASNSTDPHAAGTATARFALKPWEAVCAATRRQVTLVLRDRVLLRGRLVQVTVLGLITGSLFYNQLLPTARLDDPRTIFGACFMCVLFMSFGGFMQVPLMMEQKKVWYKQRASAFLPAYAQSLALALSQFPISIAEATVFSVIMYWMIGLYGQPGYFFTFCAVMISASLAISSLFRFFGVVCPSLVISNAATGVTFIFLVLTSGFTIVHYSIPPWAIWAYWISPYAFAVRALVINEMVSPKWQNVPAPGGPPGMSLGDAALLSFDFYTSESREWIWIGVGFLNGFYILFTLATAWCLAYLNPEFAEALLLSPHTAWPAFCSYTDCRTLSKQVKTDSVGDNPISGKGDDSEAGPKMVLSPSMAAIHVGKWHTRYMVGMVGGLVSGGGARERLQLLSGITGFNEPGVLLALMGGSGAGKTTLMDVIAGRKTVGEIGGTITVNGHKAEPRAWSRVMGYVEQFDIHTPAQTVLEALHFSARLRLPQSFSDAQVRSYVEEVAEIVDLTPQLGALVGSPGVSGLSTEGRKRLTIAVELVANPSCLFLDEPTSGLDARAAAIVMRAVRNVARNGRTVMVTIHQPSIEIFESFDQLLLIQRGGRTTYFGPLGLHSADLINYFMAVPGTPPLPSGFNPATWMLEVTGGSMATVLDKVELDWPEHYAKSELAKAPPLYLTLVCLLSWPTPIRTCAYSSTQVGSQYAMPFWTQTGVLLHKFNLAYWRSPGYNLIRVGMTFVASLVYLAIYWGEGHFPSPATIANVQNVMGIMFSSANFMGMTNLMSVMPVVGYERVVFYRERAASMYDAFAYGIAIALVEMPYLLVQACTFVPIMYFGIGFELTAEAFWYYFIVFFETIAFYTIFGQTLVYITPSQAMAQVFGGGFNFLFNVFNGFMITYPDIPQGWRWMNRAVPPTWILYGLGVSQLGNDTDLIEYGGMPINEFLQVRFGYQYYMRWWIVLILLAYILVLRVGSILALKYWNHLKR

SEQ ID NO: 7576 - protein, 361 aa, Ralstonia solanacearum GMI1000
MKTYRIATIPGDGIGKEVVPAGREVMEALAAAGAGFRFEFENFDWGGDYYRQHGAMMPADGLDALRGKDAILFGSAGDAQIPDHITLWGLRLKICQGFDQYANVRPTRILPGIDAPLKRCGPQDLDWVIVRENSEGEYAGVGGRVHQGHPIEAATDVSMMTRAGVERIMRFAFRLAQSRPRKLLTVITKSNAQRHAMVMWDEIAVQVSKEFPDVQWDKELVDAATARMVNRPASLDTIVATNLHADILSDLAAALAGSLGIAPTGNIDPERRYPSMFEPIHGSAFDIMGKGLANPVGTFWSVVMLLEHLGEQAAARRLMQAIEAVTANPALHTRDLGGNATTVQVTRAVCECLAVSQAQAA

SEQ ID NO: 7577 - protein, 318 aa, Rickettsia typhi str. Wilmington
MANLHQQQIIDKIQNITFKDGTFLNEVISDIIIKGNNIGFSIDISGKNKLEAEEIRLKAINELNNIKDVNNITIVFTQKKTIDKKAQKPKHFVENVKKIILVASGKGGVGKSTISALIAQQLSLENYQVGIVDADIYGPSIPHIFGINEIPKTVEGRIIPILAQNIQIISIGFFVKAHSAIIYRGPMASKIIYQLLSNTRWNNLDYLIIDMPPGTGDIHLSMLENYHLDGVIVVTTPQKISEIDVIRSIDLYRKLGLPILGIIENMIYMLESDRCGHLSKKYNIPLIAKIPIIPQIANACDKSLPLTNLLTLPLEKYL

SEQ ID NO: 7578 - protein, 222 aa, Francisella tularensis subsp. tularensis SCHU S4
MIDKEFIQKSYTSIMQNIDSKARLLAVSKYQSIDKIEYLAGLGQLDFGENYFQELEQKAQKLPHLRWHFIGSLQSRKIKHIVKYASSIQSVENIEHLEKIDKAAGQIAKIVDVFLQINIDDDINKSGFESTQLEEVVASIMKAKSFMNLKIVGLMCIPAKTNAPEKSFAKMKHFFDTVNSRLNDDLKLSRLSMGMSADYRLAIQYGSTDVRVGSSLFGARAT

SEQ ID NO: 7579 - protein, 452 aa, Aeropyrum pernix K1
MAVDAPRIVVEPPGPRAREVLERDERVIMQSFTRWYPLVVKRGYGAVVEDVDGNRYIDFNAGIAVLNVGHNHPRVVEAVKRQLERFLHYSLTDFYYEEAVSAAERLARSVPISGGAKTFFTNSGAESIEASIKVVRAFFRGTRPYIISFLGGFHGRTYGAMSASASKPVHRARFYPLVPGFIHAPYPDPYRCPFPGLEGEACGEAAVSYIEDYIFSKLVDPGEVAAFLFEPIQGEGGYVVPPDSFLPSLQKLARKHGILLIADEVQTGFARTGRMFAVEHWGVEPDVMALAKAMGGGLPLGAAVGRSEVMSLPRGSHANTFGGNPVALAAFNAVMDVIEGERLWERSQRLGEKALKILGEAAEELSIVGHVRGKGLMIGVELVRDENTREPHKEALAWVLDRSFKRGLLVIGAGVSAVRIAPPLTIEEELFDRGLEILVEVLREADRRFSQV

SEQ ID NO: 7580 - protein, 468 aa, Mycobacterium tuberculosis H37Rv
MSVLLFGVSHRSAPVVVLEQLSIDESDQVKIIDRVLASPLVTEAMVLSTCNRVEVYAVVDAFHGGLSVIGQVLAEHSGMSMGELTKYAYVRYSEAAVEHLFAVASGLDSAVIGEQQVLGQVRRAYAVAESNRTVGRVLHELAQRALSVGKRVHSETAIDAAGASVVSVALGMAERKLGSLAGTTAVVIGAGAMGALSAVHLTRAGVGHIQVLNRSLSRAQRLARRIRESGVPAEALALDRLANVLADADVVVSCTGAVRPVVSLADVHHALAAARRDEATRPLVICDLGMPRDVDPAVARLPCVWVVDVDSVQHEPSAHAAAADVEAARHIVAAEVASYLVGQRMAEVTPTVTALRQRAAEVVEAELLRLDNRLPGLQSVQREEVARTVRRVVDKLLHAPTVRIKQLASAPGGDSYAEALRELFELDQTAVDAVATAGELPVVPSGFDAESRRGGGDMQSSPKRSPSN

SEQ ID NO: 7581 - protein, 325 aa, Gibberella zeae PH-1
MSQTFKQAAESARSKARGDSAAIANDLLHTPLMRAALPFINGGIAGMVATTVIQPVDMVKVRIQLAGEGTATGPKPSPLAVTRQIIASGKFLDLYTGLSAGLLRQAVYTTARLGMFDTLMGNLSARAKTEGRTVGFKERATAGLTAGGIAAMIGNPADLALIRMQSDGLKPLAERKNYKSVIDALSSIAKSEGVGALWAGAAPTVARAMALNFGQLAFFSEAKVQLKKNTDLSARTQTLTASAVAGFFASFFSLPFDFVKTRLQKQSKGPDGKLPYRSMIDCFSKVAKQEGLGRFYRGFGTYYVRIAPHAMVTLIVADYLGFITK

SEQ ID NO: 7582 - protein, 189 aa, Leptospira interrogans serovar Copenhageni str. Fiocruz L1-130
MNIHKTAFIHPLATAIGLVEMGPYSSLWPGTVVRADMNQIVLGKGVNIQDNSTLHTDSSRGITIGDYTLVGHNTMLHGCKIGRGCLIGIGSIVLDEAEIGDGAMITAGCMIRGGKKIPPGAMVIQKNGELKILEGKSKPILSVAGCLEYIALSDRFRKGIFGPFTLEEEIEFQNQAKTVLKEMGIPFKE

SEQ ID NO: 7583 - protein, 489 aa, Gibberella zeae PH-1
MALLSVNLRDGLILTAVITILLYIWEKKTAKITRNGEPLRKPPNTLPLVGNGIIFLQPRQKLFSWFHRCERLYGYETLHITVPSLPPGVIVNDPQNLDFIFRNEGVFEKGEFFKQRSWDLFGHGIINVDGEFWRLQRKAGLRFLSAAALKTLTNEKLPKYLDQAIGVLEAKTNTKEVVDLQAVVHEVTTQLMGRMAYNMEMHADDDFTVAFEHASGGTAERFQNPLWFVTEMFTGARMRRSITTVKAYGKRIVTSAVADRKEAEGKTQSDAPGSLIQSLLDSIGDETLVADAALNYLSAGRDTVAQALTWTLYLLMKNPHVATKLRQSVESLRDEDTSTGDDPELLTPVRLPYVLAVFYESLRLRPPIPFEIKQAQQATTLPDGTFLPAGAIVVWCAWAMGRSHTTWGPNADDFRPERWLTTSLAGDVTVAQRPAAEFPVFNGGPRTLARLVPLFKFEPAFEGERVSKSSLTLPMEGGLPVYVQHQTPS

SEQ ID NO: 7584 - protein, 131 aa, Triticum aestivum
MATISAAAATTVVARAAIARPQALGLPQLRTRSERVRCSYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 7585 - protein, 236 aa, Idiomarina loihiensis L2TR
MLLSLLDLAALLFFFFCWIGYSLFARKRARTTHCLSSILCSLRIDWFTTVMHKENQVADASLIGNVERTVTFFASSTILVLAGVITVLAHADEVVLVLNEIPMSPDTSSILVQFKLSVLAIIFIYAFFKFTWSIRQFGFVSVLLGASVEYHQGNKPEEERRRFAMHAAKVLDQSGHEYNKGLRTYYFALAYLSWFLHPVILIASSAVVVAVLYRREYRSRVLRELLATKGYVPGKK

SEQ ID NO: 7586 - protein, 550 aa, Gloeobacter violaceus PCC 7421
MASSVLTVGEYLIERLYSHGVHHIFGVPGDYVLGFFKQLCDSPIKVINTCDEQGAGFAADAYARVRGLGAVCVTYCVGGLKVANTTAQAYAEKSPVVVISGAPGTNERHKNPLLHHKVREFDTQLKVFEQLTVAATVLDDPQTAFCEIDRVFEAALRYRRPVYIELPRNVARATGSACHLRELPQETSDPATLGEAVKEAVARINASRQPVILAGEELHRFALQPLLAQLIEKTNIPVASTILGKSVFPESHPRYLGVYEGAMGREDVRDYVEASDCLVLLGALMTDMNLGIYTANLDPRRSIYCATEKLTIGYHSYEDVRLQDFAAGLLAGEIERRVDGPTPHPLPLAQFQPVQDRPMTVLRLFQQLNAFLDDETIVVADPGDALFAGADLFIPGKTRFLAPAYYASLGFAVPAALGAQMADARLRPLVLVGDGAFQMSGLELSTIARFGLDPIVVLLNNRGYGTERPMQDGSFNDVLNWNYSRLPELLGTGRGFEVSTEDQLAAALHEARRHRGSFSLIDVHLEPGDLSPALRRMTDSMGQRVRPAAV

SEQ ID NO: 7587 - protein, 655 aa, Idiomarina loihiensis L2TR
MNGTFSSLLLLLAVAVILVWLFRRVKLPAILAYLVAGIIAGPDVMGWIADPDDYHLVAELGIVLLLFSLGLEFSLPKMIAMRRWVFGLGAAQVLGSLLIFLLIGFIWLDEWAASLAIAGALALSSTAVVIKQLKESAQTSTRRGQMSVAILLFQDIAVVPLLIIIPLLASDNGNIGYTLLLALAKGAAVIAVLMTIGKWVLPYLFKEIAKQRTDELFVLATLLVALVAGGMTHVFGLSMALGAFLAGMMLGESQYKHQLEADIRPFRDILMGLFFTTIGMQLQLYGFVQNFHWILLALIVMAVIKIALISSVARFMGERDEDAWGSGISLFQMGEFGFVIVALASSHGLLSKEIVTSMIGIGVLSMAITPIVIHRLKPLVNLVVRHPDPLVDIEQQRTTGSEGLENQVLICGFGRVGQTMSRFLDAEGITHIAVDNDPMRVQEAVAGGARVYFGDSARKDILRAVGAESVDLIIISFADDLRALEVLKELRQLNPDAYIIVRSRDDTRLTQLQEAGASQVVPDTLEASLMLISHVLSRSGIPIRRILARLDKERRNHYGEMHGFFQGDETEITPELADKLEFLRALTLPEGAWATGKRIDELDWEKHQVQLKALRRDDEEIQEPDGDTELQPQDVVLLVGKPRYVEAAERWLLEG

SEQ ID NO: 7588 - protein, 690 aa, Vitis vinifera
MAAGRVGVSRRNDFYKYSKKEHDYHRNPNRGVELSRDRDRGVTGRNGFDSLSRVSSDVGGRRNVFRVRIGEKELGKLSSGRKIGSQMVDSETSEVDNGVKMNCDRKRKFSPIVWNAEKEVRISSKNGVVSMSTALSHPKLLGEVVSDEVVAVHSDADRIQCLQSSIIESHVVSGSAETAVVEPPACLSSLMPGQRCGRSGEEVEQLEEEVVCSWNIATSRWASESDSPREKCFSDNGNMPKRSKMSSPMDSPSRTLLDGKASSPESGEFQREDSEGDRAESSVTDEVGIFIGRAGGEECSGNELDNNDCMEINDGEDETRVDYQSGLDSEDGNEVHLPVESLPPPQRSVNMLQECRSVFEYDRLNKINEGAYGVVYRARDKKTGEIVALKKMKMKIAETDGFPMSALREINILLSFHHPSIVDVKEVVMDDFGTVYMVMEYMEHDLKRLIELKKRSFSLSEVKGLMLQLLEGVQHLHHNWVLHRDLKTSNLLLNDNGELKICDFGLSRQYASPSKPYTQLVVTLWYRAPELLLGTKQYSTAIDMWSVGCIMAELLAKEPLFQGKTELDQLDKIFKILGTPNKTIWPGVSNLPGFKANFVKQPYNLLRKKFPATSFTGFPVLSDSGFDLLSKLLTYDPEKRITAEAALDHDWFHEVPLPKCEGFMPFFPAQHAQDRHLQRIIDSLHPIEEP

SEQ ID NO: 7589 - protein, 226 aa, Nicotiana tabacum
ELRQATDTTARLGSFRVLTNKAIEANDGNPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 7590 - protein, 94 aa, Oryza sativa
EIKVFGFRGEYVRKKVLQFAGIEDVFTSSRGSTKTLGNFVKATFDCLMKTYGFLTPDFWRDTKFVKSPFQEYTDLLAKPTKALMIDAPVENVEA

SEQ ID NO: 7591 - protein, 324 aa, Pseudomonas putida GB-1
MPVLITGVAGFIGFHVARRLCEAGIDVVGIDNLNAYYSVELKLARLQRLFGFANFRFQTLDIANSADLQQLFARQAFSEVIHLAAQAGVRYSLDNPGAYGQANLVGFLNILEACRQQPPRHLIYASSSSVYGANAKLPFSIDDPVEQPVSLYAASKRANELMAHSYAHLYRIPTTGLRFFTVYGPWGRPDMALFKFTRAMLEGRPIEVYNNGLMGRDFTYIDDIVESIVRLRLKPPRPTEGQPPCQLFNIGRGQPVRLLQFVECLEAALGIKAQRDYLPLQAGDVLETWADVGSLARWIDYSPGTSLEHGVNAFVGWYRDFYRV

SEQ ID NO: 7592 - protein, 437 aa, Acidovorax sp. JS42
MAQGHLAPGPDQGYDLDANDETLPVLQQLRSRYGPICRVPSLTRPGDGLVIHDPDDIRRVLLTNRGNYVKGAGLERVRVLLGNGLIVSDGDLWVRQRRMIQPAFQGQATRGFAPVVRQVNADLLTRWSAHADSGEPIDLTHELSSVALEIVLRALFSADFDRLVETEGGSPFDLLTEESRRDLQFAARFRGLARFVRAIIETRRLEARVESDWLSMLMQARDKASGEPMPDRALLDEVMTLIVAGHETTASTLNWTWYLLARHPEAEAALHAAIANAAPTEAAPDQALATPFASADYVEQVLQEALRLYPPVWLFSRRAVQDDTLGGYHVPAGTDIFICPYLLHRDAAQWERPEEFLPARFMPDAAAGRHRFAYLPFSAGPRFCVGAGFAMAEMATHLTMVAERFRWVPVDAEPAEAEFQINLRTRHPLRMRLVSRR

SEQ ID NO: 7593 - protein, 445 aa, Pseudomonas putida GB-1
MKVTVFGTGYVGLTQAVCLAQVGHSVLCMDVDAERVANLSAGHCPIFEPGLAPLLEKNLACGRLRFTTDARAAVHYARLQFIAVGTPPQADGSADLKHVFAVVDSILEHADGTKVIVNKSTAPVGTVHRIKSRIAQAVADTSRFQVISNPEFLKEGSAVDDCMRPDRIIIGGAEPAEVELLRELYLPFSRNREKLMTMDARSAELTKYAANCMLATKISFINEIANLAEYLGADIEMVRRGIGSDPRIGYDFIYAGCGFGGSCFPKDLQALRRSAEAEGFEPQLLRAVESVNEHQKGRLFSKIQRHYPGGLRGKVFALWGLSFKPNTNDIREASSRVLLEALWAAGARVQAHDPQAMEEILRHYGPRADLQLVPCKDDALEGADALVIITEWQDYRVLNLEKVPQQLADRVVFDGRNLFEPEHMATAGLTYYGIGRGQVQPACPY

SEQ ID NO: 7594 - protein, 250 aa, Chlamydomonas reinhardtii
MSRRRDGEGDQALPLIEKPAPKKSTLLTVCPFILGNEFCERLAYYGLATNLVMYICNVMGGDPADAAIQVSVFEGTCYLTPLIGAYLADSRWGRYHTILVFSSIYLVGMVALALTSWLPGLTPAEGEQANGWQLAALIGSLSVIALGTGGIKPNVSAFGADQFNEADPQDRREKESFFNWFYLAINVGSLIACTVIVYIQDQISWTLGFAIPAVVMCMAVLLFVAGRKVYRHVAPTESPMERVVRVVAAA

SEQ ID NO: 7595 - protein, 273 aa, Klebsiella pneumoniae subsp. pneumoniae MGH 78578
MPCEELDIVWNNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWTQGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPESDKPAMDMDQHFNGIHHTFEYGDGI

SEQ ID NO: 7596 - protein, 471 aa, Rhodococcus sp. RHA1
MSGTTDPQLQHTLKKRHLSMIAIAGVIGAGLFVGSGVAIRETGPGVLVAYALAGIVVILVMRMLGEMSTANPETGSFSAYADRAIGRWAGFSIGWLYAWFWIIVLGIEATAGAVIMNRWIPDVPQWSWALILMVLLTLTNIASVKSFGEFEFWFASIKVAAIVIFLVLGVLAICGALPGVEAPGLTNLTGHGGFFPNGAGAVFAAVLVVVFSFFGAEIATIAAGESANPVAAVRNAVRSVVWRILIFYIGSIAVVVTLLPWDDASVALSPYVAVMDSFGIPAAGNIMDVVVLTSVLSCLNSGLYTASRMIFSLSRRGDAPASLSKIGSSGVPRQAVLVSTVVGFLTVGLNYLYPDTVFLFLVNSSGAIALFVWLAISVSQLRMRRSLEAEGKDLSLKMWLFPYLTWCTIAAIIALCVGMLVLSETRSQMYVSMGLAVVVVGIGIYRQHTRGTTDETPDPSPSGEEVDALRP

SEQ ID NO: 7597 - protein, 147 aa, Oryza sativa Japonica Group
MAAAALTSQLNALVNNMFAMGLLDDQFQQLQMLQDSTAPDFVSEVVTLFCDDGERIICELSRQLEKPNVDFDRVDSYVHQLKGSSASVGAQKVKNTCIQFREFCQQRSRDGCLKTLDLVRTEFYDLRNKFQAMLQLEQQIQACYPKH

SEQ ID NO: 7598 - protein, 339 aa, Klebsiella pneumoniae subsp. pneumoniae MGH 78578
MNALNAAMTVIGAGSYGTALAITLARNGHHVVLWGHDPKHIATLQHDRCNAAFLPDVPFPDTLHLESDLATALAASRDILVVVPSHVFGQVLRQIKPLMRSDARLVWATKGLEAETGRLLQDVAREALGDDIPLAVISGPTFAKELAAGLPTAISLAATDPQFAEDLQRLLHCGKSFRVYINPDFIGVQLGGAVKNVIAIGAGMSDGIGFGANARTALITRGLVEMSRLGAALGADPETFMGMAGLGDLVLTCTDNQSRNRRFGMMLGQGMDVQSAQDKIGQVVEGYRNTKEVRVLAQRLGVEMPITEEIYQVLYCGKIAREAALTLLGRARKDERSSN

SEQ ID NO: 7599 - protein, 219 aa, Chlamydomonas reinhardtii
MPLVYVSVCQGSVALAEYAGFQGNFAVVARDYLDKATKLEGKSRYEVDGHSLNFLNRGGFTYLVIASVDSGVALPSAFLDKVEAEFRAKYGAGLQLGAAAGSLNATFGKQLKQLTENATQHPEEFSKVAAVQKKVDEAKAVMVDNIDAVLKRGEKLEQIQEKTEDLMAEADRFRDGAVRVKRKLWWQNCKMKIVVALAVILLAVVIFLLVCFSGGNCLK

SEQ ID NO: 7600 - protein, 253 aa, Rhodococcus sp. RHA1
MGTLDGKVALITGAGQGVGAGMAFALAKEGARIAVVGRTEAKLVDTCAGIADFGGVAEPIVCDVSKRDQLGPMVDRVVDEFGGIDILVNNANASALGPLLDITPKLLDRAMAVGPVATLLLMQLCYPHLKARGGGSIINLVSSSAVRWDTSGYGLYAATKEAMRSLTRTAASEWGPDGIRVNAIAPHALSPGLKWWTENNPEEAAEFVKSIPLGRIGDCEQDIGRAVVFLVGPDAGYLSGATIPLDGGQARWS

SEQ ID NO: 7601 - protein, 520 aa, Streptococcus pneumoniae TIGR4
MSNISTDLQDVEKIIVLDYGSQYNQLISRRIREIGVFSELKSHKISAAEVREVNPVGIILSGGPNSVYEDGSFDIDPEIFELGIPILGICYGMQLLTHKLGGKVVPAGDAGNREYGQSTLTHTPSALFESTPDEQTVLMSHGDAVTEIPADFVRTGTSADCPYAAIENPDKHIYGIQFHPEVRHSVYGNDILRNFALNICKAKGDWSMDNFIDMQIKKIRETVGDKRVLLGLSGGVDSSVVGVLLQKAIGDQLICIFVDHGLLRKGEADQVMDMLGGKFGLNIVKADAAKRFLDKLAGVSDPEQKRKIIGNEFVYVFDDEASKLKDVKFLAQGTLYTDVIESGTDTAQTIKSHHNVGGLPEDMQFELIEPLNTLYKDEVRALGTELGMPDHIVWRQPFPGPGLAIRVMGEITEEKLETVRESDAILREEIAKAGLDRDIWQYFTVNTGVRSVGVMGDGRTYDYTIAIRAITSIDGMTADFAKIPWEVLQKISVRIVNEVDHVNRIVYDITSKPPATVEWE

SEQ ID NO: 7602 - protein, 446 aa, Listeria monocytogenes str. 4b H7858
MAKFTYDVVIIGSGASGTTVAFEAQAAGLKVAIVEERSWGGTCVLRGCDPKKVLVGAREARNLSTRLRGKGIKQAATISWTDLMAFKETFVENVPESRLENFQEAGIETFFGAASFQDSHSLQVGDDLIQANKIVIATGATPSTLKVEGQEYIQTSDDFLSLEKLPDSVVFIGGGYISFEFASIALATGREVHIIHHNSEPLKKFDPDFVAALVSNMKEEGIHFHFDTDITKVENKGEKLHIHGKDGFSLQTDLIIGATGRKPNIAHLSLENANIDYTKKGIIVNEKLQTTNNPHIYACGDVAATKGAPLTPVVSMEAAFVAKNVIGGDEKMIYPAIPSVVFTSPKLASIGISAEEAKAHPEKYQIKNHDTTNWYTYKRTNEQIALAKIIEDRESGQIKGAHFLSEEADYMINYVAILMKANLTLADLQSVIFAYPSPASDLTALN

SEQ ID NO: 7603 - protein, 110 aa, Glycine max
PRVRRRQGGIQQLLAAEQEAQQIVNAARNAKTARLKQAKEEAEKEIAEYRAKMEAEFQRKVDESSGDSGANVKRLEHETDAKIEHLKTEASIISHDVVHMLLKHVTTVKN

SEQ ID NO: 7604 - protein, 403 aa, Listeria monocytogenes str. 4b H7858
MKIIVQKFGGTSVQNEKSRLMAFNHIKQVLKEGYKVVVVVSAIGRYGDPYATDTLLELIGAKNTKLTAREQDTLLSVGETISASVFTNMLKEANIKAEAFSGGQAGIITSDDHLNAKITEVDTARLKDALTNLDVAVVAGFQGITANGDISTLGRGGSDTSAAALGVSLQADYIDIFTDVDGMMTADPRIVEHARSLPRVSYNEVSNMAYQGAKVIHPRAVEIAMTAKIPMRIRSTYLESTGTLVTSLTNDSDHFDVKERIVTGVAHVTNLTQISVQTDTVKAQQLAFEILADAGISLDFINISTNSVIFTVPEEKSHVVKQLLEDADLQTTVRQACAKVSIVGAGITGVPGVTAKIVGALSEKNIPILQSADSHTTIWVLVKEEDLISAVNALHDVFCLEIK

SEQ ID NO: 7605 - protein, 133 aa, Myxococcus xanthus DK 1622
MPLIPCALGQDARMSESKRYEGGCHCGLVRYDVSLDLSQPLVSCNCSICLKTGMLLGFAPAEQFNLQKGAEHITDYQFGKKSIHHLFCDTCGVRSFGKGTMPDGKEMRAINVRCLDGIELDGLPVMKVDGKNL

SEQ ID NO: 7606 - protein, 479 aa, Oryza sativa Japonica Group
MSASAAPTHIRFSSAAPPSAAALRRPRRRCATPVRCSLAAAPGLRAPPELIDSILSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKTNEHGYGFLVNPAMKLLLLVYTVFARRFQHFCRQLLVTEHFWIYEHRQISIKRSRLFQTSKCISIADMPPPACSNVLYGDRTCTVEKSPLEKENAFLEKPSCSSPHPRRGGVPSSSRVSRLLDGGVAVELPLWDKRSKYSAQSVRAMPMRVLTVGKKRSRGAQLIVEEYKEKLGYYCDIEDTLIKSNPKLTSDVKVQVEAEDMAMMLQLKPEDFVVVLDENGKDVTSEQVADLVGDAGNTGSSRLTFCIGGPYGFGLQVRERADATIRLSSMVLNHQVALIVLMEQLYRAWTIIKGQKYHH

SEQ ID NO: 7607 - protein, 519 aa, Zea mays
  misc_feature (95)..(95): Xaa can be any naturally occurring amino acid
  misc_feature (205)..(205): Xaa can be any naturally occurring amino acid
  misc_feature (471)..(471): Xaa can be any naturally occurring amino acid
MRIPRRKGGAGPLAVGVPSRRAQVAAVFALATLLGVSVLYDAAHIAASLRRHGGPTAYAKLSSSDGAASVSGVAREEVAAVETLAPPPRAVRSDXRRSDRPRPPHEQQEEPKEGAAKPGASLQQDAPLTEEVVEGGSGGHGGGGSQEQEQDQAQGTCDLYKGRWVYDESRAPLYKESECSFLTEQVTCTRNGRRDDDYQKWRWQXPDGCDLPRFEAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKTVHGGSFSRKHVKYDEIERVEAYRKVLKTWSRWVEAHIDPKRSTVLFMSVSPVHMQSEGWGSPNAVKCFSETQPAINYTKKLEVGTDWDLFAAAQRVTRSMEKVPVRFVDVTALSEIRKDAHTSVHTLRQGKLLTXSRRRTRGSSRIASTGASPACRTRGTSSFMVTSCRARRRRRINLTDNNS

SEQ ID NO: 7608 - protein, 416 aa, Coccidioides immitis RS
MPRDPLIGLVGKPSSGKSTTLNSLTDASSKVGNFPFTTIDPQRAIGYLQIDCACQRHNLTEKCKPNYGSCHEGRRSVPIELLDVAGLVPGAHEGKGLGNKFLDDLRHADALIHVVDVSGTTDAEGKATRGYDPSQDIIWLKSEIVRWILGNLMEKWGSIKRRHVAVKATPVETLQTQFSGYGATSKIVARCLDRLDLKEPLQDWSDETIAQVVVAFIDEKFPTVLALNKIDHPDADKNINKIAKVQDPQSIVLCSAISEVFLRKLAKQGYVKYVEGSEFVDTREDLIEMGDPDGGGLKEMDDKLKNRVENLKGLVLYRFGSTGVVQVLSRAAELLGLVPVFPVRNIHNFTSGSGGGNAVFRDCVLVKKNSTVADVARKVMGDAPIAYVEGVGGIRVSEDEVVSVGKHDILSFKVGR

SEQ ID NO: 7609 - protein, 437 aa, marine gamma proteobacterium HTCC2080
MSFSTLGLSESLLKAVADEGYTTPSPIQAQAIPAVLEGRDVMAAAQTGTGKTAGFTLPLLHGLSKGQPAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPNKRQNLMFSATFSEDIRDLAKTIVNNPVEISVTPRNSTAVSVTQWIHPVDKNQKRHLLVELINQHNWEQVLVFSRTKRGANRLAEFLDKKGIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLSRKLVAGYEPENPLPELALRPPAKPKKPKKPTTQRHAGSNVDGNKTGERDSRRTPTSTDPWKRRRSNNKAR

SEQ ID NO: 7610 - protein, 154 aa, Xanthomonas campestris pv. campestris str. ATCC 33913
MSQFDLTPPSPAQRDALIAGLSDEEQRVLLHHGTEAPFCGVFLDNKLDGVYTCRLCGLPLFRSNAKFDSGTGWPSFFAPYDPAHVREIRDTGYGMIRTEIVCARCDSHLGHVFPDGPPPTGERHCLNSVSLAFTEDGQPLPNPLQRAGADTQPA

SEQ ID NO: 7611 - protein, 429 aa, Gloeobacter violaceus PCC 7421
MTQTPLRITTLKGLRCRECGEQYPAEARHVCEFCFGPLEALYDYEAIRGCTSRKTIEAGPRSIWRYRPFLPVVGERVIDVGTGLTPLIRSERLARRLGLGALYIKNDAVNVPSLSFKDRVVSVALTRARELGFTTVSCASTGNLANATAAIAAHAGLECYVFIPADLEAGKVLGTLIYGPQVMAVEGNYDQVNRLCSEVADRHGWGFVNINLRPYYSEGSKTLGFEVAEQLGWRLPDHVVAPVASGSLYTKIYKGFQELIKTGLVGERPVRMSGAQATGCSPVAQAFKAGRDFIAPVKPATIAKSIAIGNPADGVYALDLARRTGGHIEDVTDAEIIEGIKLLAQTEGIFTETAGGTTVAVLKKLVEQGKIAPDELTVVYITGNGLKTQEAIAPYAGETLKIEANLASFERALERARTLDRLDWQQTLV

SEQ ID NO: 7612 - protein, 135 aa, Vitis vinifera
MAGRGKSLGAGAAKKATSRSSKAGLQFPVGRIARFLKAGKYAERVGAGAPVYLAAVLEYLAAEVLELAGNAARDNKKTRIVPRHIQLAVRNDEELSKLLGSVTIANGGVMPNIHNLLLPKKSSSSKGGAAADDDN

SEQ ID NO: 7613 - protein, 474 aa, Vitis vinifera
MAKEEQQIEGNDVVSDLINFLNSSPTAFHAVDEAKKLLKESGFVQVSERDNWNLEAGKRYFFTRNYSTIVAFAIGKKYVPGNGFCIVGAHTDSPCLKLKPISKVTKGGYLEVGVQTYGGGLWHTWFDRDLTVAGRVIIREGKDAFSHKLVRIEEPIMRIPNLAIHLDRGVNDGFKVNAHSHLVPILATEIKAELNKVVSENGPVKSGADEKKHHSLLLQLLATRLGCEPDDICDFELQACDTQPSTVAGAMKEFIFSGRLDNLCMSFCSLKAMIDATASESTLEEETGVRMVALFDHEEIGSNSAQGAGSPVMFDALSQITNSFTSDSKLLQIAIQRSFLVSADMAHALHPNYMDKHDENHQPKLHGGLVIKHNANQRYATNAVTSFIFKEIAAKHNLPVQDFVVRNDMPCGSTIGPILASGVGIRTVDVGAPQLSMHSIREMSAVDDVKHSYEHFRAYFQEFSCLDAKITVDI

SEQ ID NO: 7614 - protein, 305 aa, Pseudomonas putida GB-1
MTLHIHTPLIESRSLSLVAGRNVWLKLDALQPCGSFKLRGVGHACEVHQARGARQFISSSGGNAGLAVAYAGRKLGVPVTVVVPETTTERAKELLRLEDANVVVHGSSWQEANALAQTLVGPNDAFIHPFDDPLLWAGHASLIDEVAEAGVKPDAVVLSVGGGGLLSGVVEGLQRNGWGDVPVLAVETNGAASLHAALQAGHSVELERIASVATSLGAKRVADRALACAQQHPVHSHLVTDRAALEACERFLLDHRLLVEPACGAALALAYAPGALAQYQNVLVVVCGGATATLEQIQAWLQQAD

SEQ ID NO: 7615 - protein, 343 aa, Vibrio fischeri ES114
MKIKALSKLKPEEGIWLTEVEKPEMGHNDLLIRIKKTAICGTDVHIYNWDEWSQKTIPVPMVVGHEYVGEVVGIGQEVRGFEIGDRVSGEGHITCGHCRNCRGGRTHLCRNTTGVGVNRTGAFSEYLVIPAFNAFKIPAGISDDLASIFDPFGNAVHTALSFDLVGEDVLITGAGPIGIMAAAVAKHVGARHVVITDVNEYRLDLAKKMGVTRAVNVMNEKLEDVMSELGMTEGFDVGLEMSGNPSAFNSMLTNMNHGGKISLLGIPPSDMTVDWNQVIFKGLVIKGIYGREMFETWYKMASLIQSGLDLTPIITHHYKIDDFQAGFDMMRSGMSGKVILDWE

SEQ ID NO: 7616 - protein, 394 aa, Oryza sativa Indica Group
MNPSIEVKDGISNMIFDLVAKKLIGFKPTKSRELRKNFQEFFHGMVSFPIYFPGTSFYRCMQGRRNVQKTLTDLLKERLSAPGEKYNDLIDQIIEELQSENPVIDVNFAIDVLSALLFASFATLSSTLAVGFKFLTDNPKVVKELKYIFDVPHLLPQTVKGGVPPEEHTTILNKRGSLNSGFTWEEYKSLMFTSQVVNEITRISNVAPGIFRRTLADVKVNGYTIPAGWLVMISPMAVHLNPTLFEDPLEFNPWRWTDKTKQSELLRNYMPFGGGIRLCLGAEFSKLFIAIFIHVLVTEYRWKEIKGGDVLRISEMVDSNKTGGSPAGTSKQTLSAEEMDDQLEQFTSLMQQKFLSGEDFGHMDYSRIDNDEMLDDHWSKEANYDAGEKYFEED

SEQ ID NO: 7617 - protein, 229 aa, Ralstonia eutropha JMP134
MQGKGMLQSSGPHSLAYTHLIVIRHGETAWNRERRLQGQLDIPLNETGEAQARALAAALAGEPIDAVYSSDLGRAMQTAAPLAETLGLKVRSEPRLRERSYGTLQGMTYAEVAEKLPEDFARWQARVPDYTPPQGESLAQFHERAVEIALSLSRRHPGERIALVAHGGVLDCLYREATGMTLEAPRQHELLNASINRLRSDSHHLTLAQWGDVTHLETLALDEVDRRVP

SEQ ID NO: 7618 - protein, 507 aa, Klebsiella pneumoniae subsp. pneumoniae MGH 78578
MVLVILDGYGYREDQQDNAIYSAKTPVMDALWAKRPHTLIDASGLEVGLPDRQMGNSEVGHVNLGAGRIVYQDLTRLDVEIKERTFFANPVLTAAVDKAVAAGKAVHIMGLMSPGGVHSHEDHIMAMVELAAERGAEKIYLHAFLDGRDTPPRSAEKTLATFEAKFAALGKGRIASLIGRYYAMDRDNRWDRVEQAYDLLTLAKGEFQADTAVAGLQAAYARDENDEFVKATVIRAAGQADAAMEDGDALIFMNFRADRAREITRAFVNADFDGFARKKVVNLDFVMLTEYAADIKVACAYPPASLANTFGEWMAKHDKTQLRISETEKYAHVTFFFNGGVEEPFKGEERILINSPKVATYDLQPEMSSAELTEKLVAAIKGGKYDTIICNYPNGDMVGHTGVMEAAVKAVEALDRCIDQVAQAVESVGGQLLITADHGNAEQMRDPATGQAHTAHTNLPVPLIYVGNKAVKAVNGGKLSDIAPTMLSLMGMEIPQEMTGKPLFIVE

SEQ ID NO: 7619 - protein, 266 aa, Rhodococcus sp. RHA1
MSRMAGKVAFITGAGNGMGRSHAVRLAEEGTDVVVVDLPSAEADLAETGRLVGELGRRAVLAHADVRDPAALCAAVDAGVAELGPLDVVVANAGVCDNPGPAWTIDDAVWHRSLDVNLTGVWNTAKAAVPAMRDGGGSVVIVSSTAGIKAVAGAAHYSASKTAVVGLARTLANELGPQFIRVNVLHPGAVGTRMTLNPETMARLRPDLANPTRDDVVPVLAANHMLPVPWLDSRDVSNALLFLASDESRYITGTQLVVDAGLTQKV

SEQ ID NO: 7620 - protein, 303 aa, Escherichia coli
  misc_feature (41)..(41): Xaa can be any naturally occurring amino acid
MSTLEQTIGNTPLVKLQRMGPDNGSEVWLKLEGNNPAGSVXDRAALSMIVEAEKRGRIKPGDVLIEATSGNTGIALAMIAALKGYRMKLLMPDNMSQERRAAMRAYGAELILVTKEQGMEGARDLALEMANRGEGKLLDQFNNPDNPKAHYTTTGPEIWQQTGGRITHFVSSMGTTGTITGVSEFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 7621 - protein, 341 aa, Klebsiella pneumoniae subsp. pneumoniae MGH 78578
MKALSKLKAEEGIWMTDVPEPEVGHNDLLIKIRKTAICGTDVHIYNWDEWSQKTIPVPMVVGHEYVGEVVGIGQEVRGFKIGDRVSGEGHITCGHCRNCRAGRTHLCRNTIGVGVNRPGCFAEYLVIPAFNAFKIPDNISDDLASIFDPFGNAVHTALSFDLVGEDVLVSGAGPIGVMAAAVAKHVGARNVVITDVNEYRLELARKMGVTRAVNVAKENLNDVMAELGMTEGFDVGLEMSGAPPAFRSMLDTMNHGGRIAMLGIPPSDMSIDWTKVIFKGLFIKGIYGREMFETWYKMAALIQSGLDLSPIITHRFGIDDFQKGFDAMRSGQSGKVVLSWD

SEQ ID NO: 7622 - protein, 496 aa, Escherichia coli O157:H7 EDL933
MSPLAGKNSAVWQHQEWCNDHAPDSLARTLPSGSTRSGVMTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPSPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLEGYLQQGIFERADWEASLQGLERIFPTVS

SEQ ID NO: 7623 - protein, 317 aa, Rhodococcus sp. RHA1
MPLDEQAETILRGLNENFPRVETMTGAQARAATRAGRKAVADPEPVGSVCDREIRGDAGPIAVRIYLPAGHRAESLPVVVFFHGGGFVICDLDSHDGFCRAMCNGIGAVVVSVDYRLAPESQWPAAADDAYTATCWVAQHAREFGGDPDRLLVAGDSSGGNLAAVAALMARDREAPAVAGQLLIYPVIEPVFDTESYELFAEDHFLTRSAMQWYWDQYLPTHRETVPAYAAPVRAEDLGGLPPAIVITAERDPLRYEGEKYAGALADAGVPVQCRRVEGMFHGFLTIDAMAAAQTARRELWPRLRTLVAEPASTPVD

SEQ ID NO: 7624 - protein, 486 aa, Oryza sativa Japonica Group
MRKKPARAVPEWLNSPLWSAPPPSSSSPSPPVPPDPYGADLSPPPPPPPKPPPTVPPPSYEQAVGSSRRARSEAGWEEEEEEDGEVGGGAALRAHLLADFKLALSKKVVNMGELRRLACLGVPDGGAAVRPLVWKLLLGYLPTERAFWPHELEKKRSQYSAYKDEFLLNPSEKIRRFEESKLLRKKELNSDKIGLLPRAKVTNEEHPLSFGKSSLWNQYFQESEILEQIDRDVKRTHPEMPFFSAKANQESLRRVLIIFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYLLNKILILIACYIVFVGKFSHSGMSPTIVDSHAWILKIQVYPQYYAFRWITLLLTMEFSFNVCIHIWDAILGDPEGPPDTLLRICCAMLILVRRRLLAGDFTANIQLLQHYPPTNIDHLLHIANRLRGSVAS

SEQ ID NO: 7625 - protein, 423 aa, Ralstonia solanacearum GMI1000
MDRAIDIDFRTISVVGLGYIGLPTATVLASRQREVIGVDINQHAVDTINQGRIHIVEPDLDMLVRAAVSQGYLRATTEPEPADAFLIAVPTPFLDNKQPDLSYIEAAARAIAPVLKRGDLVVLESTSPVGATEQLSDWLSAQRPDLSFPHQQGEESDIRVAHCPERVLPGHVLRELVENDRIIGGMTPKCSEAAQRLYELFVRGRCIVTDARTAEMCKLTENAFRDVNIAFANELSMICDEIGVNVWELISVANRHPRVNILQPGPGVGGHCIAVDPWFIVDAAPESARLIRTAREVNDAKPHYVLDRVKQAARRFKEPVIACFGLSFKANIDDLRESPAIEIVQTMVQQQLGTVLVVEPHIKVLPAALQGVELLNAEAALSRADIVVLLVDHQQFRKLDTDRLQSRVVIDTRGMWSAKRIAA

SEQ ID NO: 7626 - protein, 430 aa, Zea mays
  misc_feature (113)..(113): Xaa can be any naturally occurring amino acid
  misc_feature (235)..(235): Xaa can be any naturally occurring amino acid
MAMLSRAASSAARRPLLPPPRLLAVRAMASSLFGHVEPAPKDPILGVTEAFLADPSSDKVNVGVGAYRDDNGQPVVLSCVREAERRIAGNLNMEYLPMGGSIKMIEESLKLAXGEDSDFIKDKRIATAQVLSGTGACRLFADFQKRFLPDSQIYIPTPTWSNHHNIWRDAQLPQKTFTYYHPESIGLDFSRLMNEIKNAPDGSFFLLHACAHNPTGVDPTEEQWREISHQFKVKXHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKSLWLKEVKGMADRIIGMRKALKENLEKLGSPLSWDHITNQIGMFCYSGMTPEQVDRLTNESPIYMTRNGRISMVGVTTGNVGYLANAIHEVTKPN

SEQ ID NO: 7627 - protein, 815 aa, Schizosaccharomyces pombe 972h-
MNAPSTMTDKKPEVEHLQGENPPKDTYSAEDTATAILRKKRKPNSLVVDDATNDDNSVITLSSNTMETLQLFRGDTVVVKGKRRKDTVLIVLTDEEMEDGVARINRVVRNNLRVRLGDIVTINPCPDIKYAERISVLPLADTVEGLTGSLFDVYLKPYFVEAYRPIRKGDLFVVRGSMRQVEFKVVDVAPDEFGIVSQDTIIHWEGEPINREDEESSLAEVGYDDIGGCRRQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDVGIPDPTGRLEILRIHTKNMKLADDVDLEQIAAETHGYVGSDLASLCSEAAMQQIREKMDMIDLDEDEIDAEVLDSLGVTMDNFRFALGSSNPSALRETVVEVPNVRWEDIGGLEEVKRELRETVQMPVMYAEKFLRFGVTPSKGVLFFGPPGTGKTLLAKAIANECSANFISVKGPELLSMWFGESESNVRDIFDKARAAAPCVVFLDELDSIAKARGASAGDSGGGDRVVNQLLTEMDGVNSKKNVFVIGATNRPDQIDPALMRPGRLDQLIYVPLPDEEARFSILQTQLRHTPVAEDVDLRAVAKATHGFSGADLEFVVQRAVKLAIKDSIEEDIKRENETGEAPADDVVMDEDASVSQVQRHHVEEAMKMARRSVSDAEVRRYEAYAHQLLTSRGLTGFQFDSADSNTNGPSFGNDGADDLYA

SEQ ID NO: 7628 - protein, 530 aa, Candida glabrata CBS 138
MAYSTSATSNWVVQKFGGTSVGKFPVQIVDEIVKYYSSSKQDGGFDNDVAVVCSARSSYTKQEGTTSRLLKCCDLASQDQEYSDIIETIRQDHVSNAERFLEDSPLVAKLIDDTNKELALVDKYLSASKVLGEVSNRTIDLVMSCGEKLSCLFITALCNDRGCKAKYVDLSNVVPSDYQTTTLDTSFYTFLVQALKEKLEPFVNSKERIVPVFTGFFGFIPMGLLNGVGRGYTDLCAALIAVALNADELQVWKEVDGIFTADPRKVPQARLLDSVTPEEASELTYYGSEVIHPFTMEQVIRAKIPIRIKNVQNPKGNGTIIYPDNVAKKGESTPPHPPEALSSTFFEKKRRGATAITTKNDIVVLNVHSNKKTLSHGFLAQIFTVLDKYKLVVDLISTSEVHVSMALPIPDSDSMKALRSAVEKLKPLGSVDIIKKMSIVSLVGKQMKQFIGIAGTMFTTLAEQGINIEMISQGANEINISCVIDEMDSIKALQSIHKKLLDELPENGSGSEQFEKAVDERLEQIKRLNL

SEQ ID NO: 7629 - protein, 172 aa, Chlamydomonas reinhardtii
MPNPIVFFDITADGAPVGRIEMELYADDVPKTAENFRALCTGEKGVGRSGKPLHFKGSTFHRVIPNFMCQGGDFTRGNGTGGESIYGEKFPDENFKHRHTGPGVLSMANAGPNTNGSQFFLCTVETAWLDGKHVVFGKVCKGMDVVKKVEGYGSSSGKTRATFAIADCAQLA

SEQ ID NO: 7630 - protein, 496 aa, Orchidantha fimbriata
MRTNPTTSSPVVSTLEEQNLGRIAQIIGPVLDVVFPPGKMPNIYNALVVKSRDTVGQQINVTCEVQQLLGNNRVRAVAMSATDGLMRGMKVIDTGAPLSVPVGGATLGRIFNVLGEPVDNLGPVDTSTTSPIHRPAPAFIELDTKLEIFETGIKVVDLLAPYRRGGKIGLFGGAGVGKTVLIMELINNVGKAHGGVSVFGGVGERTREGNDLYKEMKESGVINEKNIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEKHYEIAQRVKQTSQRYKELQDIITILGLDELSEEDRLTVARARKIERFLSQPFVVAEVFTSSPGKYVSRAETIRGFALILSGELDSLPEQAFYFVGNIDEATAKAMNSEGESKL

SEQ ID NO: 7631 - protein, 486 aa, Vitis vinifera
MASQEPWQMENGNLKGSSKEIKHGRTAHNMSSSSLRKKSDLSLVNKVPCGLVRQLLANLQEVILGTKLSVLFPAIPLAIVAQYYGFAGPWIFGLSLLGLTPLAERLGFLTEQIAYYTGPTVGGLLNATCGNATELIIAIFALSKNKILVVKYSLLGSVLSNLLLVLGTSLFCGGIYNLREEQKYDRKQSDINSLLLLLGLLCHMLPLMFRYAANPSGAALIADSTLSLSRAGSIVMLVAYLAYLVFQLWTHRKLFEAPEDGDDDTVSSDEEPVIGFWSSVVWLILMTAIIALLSEFVVGTIEVASESWGISVSFISIILLPIVGNAAEHAGAVIFAFKNKLDISLGVALGSATQIAMFVVPLCVLVAWIMGIRMDLDFSLLETSSLALAIIVTAFTLQALALWGRFSPDEESNVVMLFFQQSLDWKWEDQGVKFTCMLHLALEIVEAPRSRRILVVDVALQLDEEDQHTSIYGHVYSLVTEYGLLC

SEQ ID NO: 7632 - protein, 496 aa, Orchidantha siamensis
MRTNPTTSSPVVSTLEEKNLGRIAQIIGPVLDVVFPPGKMPNIYNALVVKSRDTVGQQINVTCEVQQLLGNNRVRAVAMSATDGLMRGMKVIDTGAPLSVPVGGATLGRIFNVLGEPVDNLGPVDTSTTSPIHRPAPAFIELDTKLEIFETGIKVVDLLAPYRRGGKIGLFGGAGVGKTVLIMELINNVGKAHGGVSVFGGVGERTREGNDLYKEMKESGVINEKNIAESKVALVYGQMNEPPGARMRVGLTALTMAEYFRDVNKQDVLLFIDNIFRLVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEKHYEIAQRVKQTSQRYKELQDIITILGLDELSEEDRLTVARARKIERFLSQPFVVAEVFTSSPGKYVSRAETIRGFALILSGELDSLPEQAFYFVGNIDEATAKAMNSEGESKL

SEQ ID NO: 7633 - protein, 191 aa, Vitis vinifera
MGVEEEEEDEERKIELGPQFTLKEQLEKDKDDESLRRWKEQLLGSVDLNSVGETLEPDVKILELAIKSPGRPDIVLPIPESGNPKGLWFTLKEGSRYSMNFAFKVSNNIVSGLRCTNVVWKTGLKVDSTKEMLGTFSPQQETYTHEMPEETTPSGIFARGTYSAKTKFLDDDNKCYLEINYSFDIRKDWQS

SEQ ID NO: 7634 - protein, 479 aa, Bradyrhizobium sp. ORS278
MSFVAKHRLWTAEQTEAAARMRRLAEEHGLNTIRFSFPDQHGILRGKALSVDAALSSLEDGCSITTTLLAKDTSHRTVFPVFTAGGGFGMSEMQGGSDALMVADPTTFRVLPWAPGTGWVLCDLYFANGAPVPFATRNLLRSALSTLDQRGYQFKAGLEVECHIFKVEDPRLAPADAGSPGQPGAPPAVSLLTQGYQYLTEQRFDQMEPALEIIRTHLAALGLPLRSIELEYGPSQCEFVLQPGIGMEPADTMVLFRSAVKQIAQRHGYHATFMCRPRIPNVMSSGWHLHQSLVARDGGNAFMSNEPEELSALGRHYMAGLLAHARAAAVFSTPTINGYRRYRSYSLAPDRAIWGRDNRGVMIRVLGGPGDSATRLENRIGEPAANPYLYIASQIAAGLDGIDRALDPGPSADVPYETKASPLPKSLREAVDALKGDAFFRQAFGATFIDYYTFIKNAEIERFQQEVSDWEQREYFEMF

SEQ ID NO: 7635 - protein, 496 aa, Phenakospermum guyanense
  misc_feature (420)..(420): Xaa can be any naturally occurring amino acid
MRINPTTSSPAVSTLEEQNLGRIAQIIGPVLDVVFPPGKMPNIYNALVVKGRDTVGQQINVTCEVQQLLGNNRVRAVAMSATDGLMRGMEVIDTGAPLSVPVGGATLGRIFNVLGEPIDNLGPVDTSTTSPIHRPAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQKVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTSQRYKELQDIIAILGLDELSEEDRLXVARARKIERFLSQPFVVAEVFTGSPGKYVGLAETIRGFQLILSGELDSLPEEAFYLVGNIDEATAKAMNLEGESKL

SEQ ID NO: 7636 - protein, 203 aa, Brassica napus
MSYKKLPVDVQPGHTILCADGSISLAVLSCDPKSGTVRCRCENTAMLGERKNVNLPGVVVDLPTLTEKDVEDILKWGVPNKIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDC

SEQ ID NO: 7637 - protein, 286 aa, Mycobacterium sp. JLS
MDAAERKDDPLVLREVAEQLAAEAAAFVRTRRGEVFDASSGDAAAGAVAAKSTPTDPVTVVDTETERLLRDRLAEYRPGEQILGEEEGGAADAGAGQLTWVLDPIDGTVNFVYGIEAYAVSVAVQRDGESVAGAVADVAADAVYSAARGHGAQLRRHGTVRPLRCNAPERLAMALLGTGFAYAPERRRRQAELLVELMPRVRDVRRIGSCALDLCMVAAGQLDAYYEDGVNVWDWAAGALVAAEAGAVVSLPTPAGAVGGAGLVIAAAPGIAAELDEALRSVGVRT

SEQ ID NO: 7638 - protein, 496 aa, Ravenala madagascariensis
MRTNPTTSSPVVSTLEEQNLGCIAQIIGPVLDVVFPPGKMPNIYNALVVKGRDTVGQQINVTCEVQQLLGNNRVRAVAMSATDGLMRGMEVIDTGAPLSVPVGGATLGRIFNVLGEPIDNLGPVDTSTTSPIHRPAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTSQRYKELQDIIAILGLDELSEEDRLTVARARKIERFLSQPFVVAEVFTGSPGKYVGLAETIRGFNLILSGELDSLPEEAFYLVGNIDEATAKAMTLEGESKL

SEQ ID NO: 7639 - protein, 496 aa, Riedelia aff. wrayii SBG 83-203
MRTNPTTSSPVVSTLEEKNLGCIAQIIGPVLDVVFPPGKMPNIYNALVVKGRDTVGQQINVTCEVQQLLGNNRVRAVAMSATDGLTRGMEVIDTGAPLSIPVGGATLGRIFNVLGEPVDNLGPVDTSTTSPIHRPAPAFIELDTKLSIFETGIKVVDLLAPYRRGGKIGLFGGAGVGKTVLIMELINNIAKAHGGVSVFGGVGERTREGNDLYIEMKESGVINEKNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDSLPEQAFYLVGNIDEATAKAINLEEEGKL

SEQ ID NO: 7640 - protein, 254 aa, Photobacterium profundum SS9
MTTALCWQTEGQGSDLVLIHGWGMNGAVWQQLLPLLTPFYRVHWVDMPGYGHSHDISADSIEEMAQLLLDKSPISATWLGWSLGGLVATQAALLAPERVTRLVTVASSPRFAAEGTWRGIQPQVLDDFRRQLGDDFQLTVERFLALQAMGSPTARQDIKLLKQAVLSRPQPNPEALSIGLRLLADVDLRAQLGDITQPWLRLYGRLDGLVPAKVAKDMDQLAPQSCRQIFAAASHAPFISHPEEFVQTLKDFIK

SEQ ID NO: 7641 - protein, 326 aa, Pseudomonas putida GB-1
MSKVVRFHQTGGPEVLRYEDAEVGEPGPGQVRLRQVAVGLNYADTYFRNGTYPIPLPNGIGVEAAGVVEAVGEGVTQVGVGDRVTYTGFLNTLGAYCTERLIPAAALIKLPETIAFETAAAMTMRGLTSAYLLRRLYAFKPGDSVLLHAAAGGVGLIVAQWARLLGLNVIGTVSTEAKAEVARAHGCNHIINYSVEDVASRVRELTDGVGVNVVFDSVGKNTFTGSLDSLKRRGLMVCVGTASGTIPPFDPQLLAIKGSLQLTRPALADFIADPAEKADLAGELFDHVSSGRIRIEINQHYALQDAVQAHRDLEARKTTGSSIFVI

SEQ ID NO: 7642 - protein, 339 aa, Agrobacterium tumefaciens
  misc_feature (339)..(339): Xaa can be any naturally occurring amino acid
MAKTMKAAVVRAFGKPLTIEEVAIPDPGPAEILINYKATGICHTDLHAATGDWPVKPNPPFIPGHEGVGYVAKIGAGVTGIKEGDRAGTPWLYTACGCCIPCRTGWETLCPSQKNSGYSVNGSFAEYGLADPKFVGRLPDNLEFGPAAPVLCAGVTVYKGLKETEVRPGEWVVISGIGGLGHMAVQYAKAMGMHVVAADIYDDKLELAKKLGADFTVNGRAPDAVEQVQKATGGVHGALVTAVSPKAMEQAYGFLRSKGTMALVGLPPGFISIPVFETVLKRITVRGSIVGTRQDLEEALSFAGEGKVAAHFSWDKLENINDIFRRMEEGKIDGRIVLX

SEQ ID NO: 7643 - protein, 370 aa, Rhodococcus sp. RHA1
MKTKAAVLFETHKPFEIVELELDGPGPGEVLIKYVAAGLCHSDLHLTDGDLPPRFPIVGGHEGSGIIEEVGPGVTKVKPGDHVVCSFIPNCGTCRYCATGRQNLCDMGATILEGSMPDGSFRFHSGKQDFGAMCMLGTFAERATISQHSVVKVDDWLPLETAVLVGCGVPSGWGTAVYAGGVRAGDTVVIYGIGGLGINAVQGAVSSGAKYVVVVDPVAMKREAALKFGATHAFADAATAAEKVNELTWGQGADQALILVGTVDEEVVQNATAVIGKGGTVVITGLADPAKLTVHISGTDLTLNQKTIKGSLFGSANPQYDIVRLLRLYDAGQLKLDELITTKYTLEQVNEGYQDLRDGKNLRGVIVHQQ

SEQ ID NO: 7644 - protein, 298 aa, Zea mays
MGDLPEPEAAMAVPEPSSSLALRVFYLRVSRCEVDESMLDTLALTHTPLTPDTILDVSGAEHQPGMGKGNGSVSFCLRRDRVDKRSGEATFVCTATVRVSGSVRFEVQSKDERIVVGILEACDVDSKGTKSWAMKCQAATQRGSGFLRCGGEKRDTKPPVVEVYVAGVFRGTPVVFTKATQLRFRRRRQVRAFMDPIPECREQVEETHHPEESGYRCYKPDPNWDDDDVDDDSLYMRSDGTDDGEEYSELSWFTAGVRVGVGISLGICLGVGIGAGLVVRSYQSTSRTLKRRLISNLL

SEQ ID NO: 7645 - protein, 502 aa, Rhodococcus sp. RHA1
MTATIEPSQAELLPSVRNFLSGTKRFLVGGQWVESASGETFETIDPATGQVLTTVARGGAEDVDRAVRAARTAFDEGPWATMKPNERERLIWRVGDILSERAEEFGQLEALDNGKSAGIAAAVDVAWSADIFRYFAGWATKIEGSTVNVSMPFVPGGQFHAYTLREPVGVCGLIVPWNFPLLMAAFKLAPALAAGNTVILKPAEQTPLTAILLGEVFEEAGFPPGVVNIVTGYGDAGAALSAHDDVDKIAFTGSTEVGKKIVDAARGNLKKVSLELGGKSANVVFADADFDAAVTGSLNAWLFNHGQCCVAGTRMFVEDSIFDDFTAAVAEAASQVKIGPGLDPTTQLGPLVSQEQFDKVTGYLAAGLADGARALTGGKRWGDTGFYVEPTVFVDVKPEFSIVEEEIFGPVVAALPFNAEEGVAKAANSSIYGLAAGIWTKDLSKAHLTARQLKAGSVWINQYNGFDTAMPFGGYKQSGWGRELGATAIDLYTQTKAVNIAL

SEQ ID NO: 7646 - protein, 427 aa, Pyrococcus abyssi GE5
MNVSIIGSGYVGLVTGMGFVKLGNRVIFVDVDEWKVRVINNAQPPIYEEGLEELMQEFKGKYYATNNYREAILNSDITFITVGTPSKPDGTIDLTYVKNAAKEIGKALKEKDNFHIVVVKSTVLPGTTEGVIRPILEKYSGKKAFQDFGLAMNPEFLREGVALKDFLNPDRIVIGVQDERTKKVLEKLYEPFNAPKLFTDIKTAEMIKYASNAFLATKISFANEIGNICKKLGIDSWKVFEGVGLDHRISPHFFRSGIGFGGSCFPKDLKALIKKAEELGEDPIILKAVLQVNERQPLKLIELLKKHVPNLKDMKVGVLGLAFKPNTDDVRETRAYIVIKKLLEEGAKVIAYDPKAMENFKRFYPDVGRQISYANSAEEVLREVDVILILTEWRDFESLDYSGKIVIDGRRVRSAEKTAKIYEGVCW

SEQ ID NO: 7647 - protein, 500 aa, Schizosaccharomyces pombe 972h-
MSSANLSIKENGAMVVFGASGDLSKKKTFPALFSLFSEGRLPKDIRIVGYARSKIEHEDFLDRITQNIKIDEEDSQAKEKLEEFKKRCSYYRGSYDKPEDFEGLNSHLCEREGDRSTHNRIFYLALPPDVFVSVATNLKKKCVPEKGIARLVIEKPFGVDLKSAQELQSQLAPLFDEKEIYRIDHYLGKEMVQNLVHLRFCNPVISHLWDKNSISSVQITFKEPIGTEGRGGYFDSSTIVRDIVQNHLVQILTLLTMETPTTFSADDLRDEKVKVLRRTRLGDLKDIVLGQYVKSKDGKKPGYLDDETVPKGSRCPTYSAIPCFIDTERWRGVPFLLKAGKAMDIGKVEIRVQFKAAANGLFKDAYHNELVIRVQPDEAIYFKMNIKQPGLSEAPLLTDLDLTYSRRFKNMKLHEAYEALFLDAFAGDQSRFARIDELECAWSLVDPLLKYMEEEKPVPEPYEYGSDGPECLYSFLKKFGYIYDSPDYYDYPVMSVPSDH

SEQ ID NO: 7648 - protein, 291 aa, Pyrococcus abyssi GE5
MIRKAVIPAAGLGTRMLPITKSMPKEMLPIVDRPVIHYVVEEAVKAGIEDILIITGKGKRAIEDYFDRSFELEYYLKERGKLEALREVEEIGEMVDIYYVRQKKPLGLGDAILYAEKHVNGEPFAVLLGDDIIISKKPAIKQLIEVAERKNTPVIGVESVPRELVSRYGIIEGELIENDLYRIKRLVEKPSPKEAPSNIAIIGRYILIPEIFDILRETPPGRDGEIQLTDALQILLNKNEILAKRIEGERYDIGSKFGFVMANLKLSLRREELRNEVLKYLKSILKEISNE

SEQ ID NO: 7649 - protein, 458 aa, Aeropyrum pernix K1
MRGPVKIVATVGPSSSSASILAQMLSLGVDVARINASHGGVEQWNSMLESLRRAEEAVGKRVGVAVDLEGPRVRTGNSEPVKLEKGDLVTLGFMEGDVPVDARQFFETIDEGDIVLLDDGKIILQVESVEGFRVKARVLEGGVLGPRKGVVVRGKEPDLPPLSAKDRRALEFFADKGVSHVYVSFARSAEHVEKVRTVVRRLGLRQARIFAKIEGPSGVSRIGEIAEASDGVIIARGDLGMHYSLEELPEIQELIVWEARKRYKTVVLATEFLSSMIEKPVPTRSEVVDIYQAVLQTADALMLTGETAIGKYPVKSVQWMAKISSRAYKKLATSPPERPRPTSTPYKLALGLVELAESLDSPLVVYSKTGRFAERLASFKPLKTFYVGVPSREVERVVRHLWGAEPIVVGDYPYEAGLAKTYEKLRRENIIHGDETVVEAAWSSERGIYIIRVRNLEF

SEQ ID NO: 7650 - protein, 460 aa, Oryza sativa
MSHVRSAPAGKSGGGGGSTPAKRGRPFGSTTGSGAAAAAAAAAIGDAAAPAALVGPSLQVLTALSDQNNKRIVLALQSGLKSEILWALNALTVLSFKEKDDLRRDTTPLAKVPGLLDALLQVIDDWRDIAMPKDHTKPPRVRTLGVNTTLSGFGHENVEKVYSDTTTPSDDQTKTADSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 7651 - protein, 148 aa, Magnetospirillum magnetotacticum MS-1
MLRFALGIRKPIAALATEAEGPALARNLSAFSLVCIGVGATVGAGIFVLTGTAAANFAGPGLMLSFVLGAVASGLVALCYAELAAMIPVAGSTYSYTYATLGALPAWIIGWDLVLEFAFAAATIAVGWRATPKASCRCRVSCRHAPPK

SEQ ID NO: 7652 - protein, 171 aa, Mycobacterium tuberculosis
MSSHHHHHHMQFDVTIEIPKGQRNKYEVDHETGRVRLDRYLYTPMAYPTDYGFIEDTLGDDGDPLDALVLLPQPVFPGVLVAARPVGMFRMVDEHGGDDKVLCVPAGDPRWDHVQDIGDVPAFELDAIKHFFVHYKDLEPGKFVKAADWVDRAEAEAEVQRSVERFKAGTH

SEQ ID NO: 7653 - protein, 343 aa, marine gamma proteobacterium HTCC2080
MIRVAINGFGRIGRNILRAYYDRPELSQAIDIVAINDLGEPAINAHLLEFDTAHGRFGHEVTSGEDYLAVDGRRIAVLNERSPSALPWAELNIDLVLECTGLFTTRVSAAAHLDAGAQRVLVSAPTKDADATIVYGVNHGTLTNEHRVISNASCTTNCLAPVVQPLHAEIGLVSGLMTTIHAYTNDQNLNDVYHKDLFRARAAGQSMIPTATGAANAIGLVLPELQGRLDGLAVRVPTLNVSLVDLSFTAARETSVEEINSLMSKAATEDAFGILGYNERPLVSVDFNHDSHSANFDANHTRVAGSLVKVLAWYDNEWGFSNRMLDNALELSAIAGLSAKKAA

SEQ ID NO: 7654 - protein, 448 aa, Pyrococcus abyssi GE5
MVKLLGMSREDVREAIKNGDVTIAVYGLGKMGLPLAAVFADNGAKVIGVDINERVVNSVNNGENHIKEEPGLDELVKKNVEAGRLKATTDGILAAKKADVMIILVPTLADDRGNLKLESVYDVAEKISKGLEKGDIVITEATMPPGTTESLIPILEKSGLKLGDFGLAHAPERTMTGTAIRDITGQYPKIVGASDERTLEAVIGIYETINRKGVIPMSSIKAAEAVKVFEGIYRDVNIALANELALWCEEHGLDAIEIFNAANTQPYCHLHMPGAGVGGHCIPIYPWFVINLAKKTNVRLIRTAREINDSMPRHVVELTVRALNDAGKPMKGSKILVLGLTFRGGVKEFTKSPAIDVIRELKEWGAEVYAYDPLCTREDAERFGAKWKEDFKDVDAIVIVTDHREFKTLDLKEIAAEVRTKVIVDGRNVIHPEEAKKLGFIYKGVGRV

SEQ ID NO: 7655 - protein, 475 aa, Yersinia pestis CO92
MMSTEIKTQVVVLGAGPAGYSAAFRCADLGLETILVERYSTLGGVCLNVGCIPSKALLHVAKVIEEAKALAEHGIVFGEPKTDIDKVRVWKDKVINQLTGGLAGMAKGRKVKVVTGFGKFTGANTLVVDGENGPTTINFDNAIIAAGSRPIQLPFIPHEDSRIWDSTDALALRTVPERLLVMGGGIIGLEMGTVYHALGSKIDVVEMLDQVIPAADKDVVKVFTKRISKQFNLMLETKVTAVEAKEDGIYVTMEGKKAPAEPQRYDAVLVAIGRVPNGKLLDAGQAGVEVDDRGFIHVDKQLRTNVPHIFAIGDIVGQPMLAHKGVHEGHVAAEVIAGMKHYFDPKVIPSIAYTEPEVAWVGLTEKEAKEKGISYETSTFPWAASGRAIASDCADGMTKLIFDKETHRIIGGAIVGTNGGELLGEIGLAIEMGCDAEDIALTIHAHPTLHESVGLAAEIYEGSITDLPNPKAKKK

SEQ ID NO: 7656 - protein, 509 aa, Yersinia pestis CO92
MSIEINVPDIGADEVEVTEIMVKVGDTVEAEQSLITVEGDKASMEVPSPQAGVVKEIKIAVGDKVATGSLIMVFDATGAAAAPVKAEEKPAAPAQVAAPAASAAKNVEVPDIGDDEVEVTEVMVKVGDKVDAEQSLITVEGDKASMEVPAPFAGIVKEIKISTGDKVKTGSLIMVFEVEGAAPAPAAAPAAKAESKGEFAENDAYVHATPVIRRLAREFGVNLAKVKGTGRKGRILREDIQAYVKDAVKRAEAAPAAAGGGLPGILPWPKVDFSKFGEIEEVELGRIQKISGANLSRNWVMIPHVTQFDEADITEVEAFRKQQNIEAEKKKQDLKITPLVFLMKAAAKALEEFPRFNSSISEDGQKLTLKKYINIGVAVDTPNGLVVPVFRDVNKKGIVELSRELSVISKKARDGKLTASDMQGGCFTISSLGGIGGTAFTPIVNAPEVAILGVSKSSMKPVWNGKEFAPRLMLPLSLSFDHRVIDGAAGARFAAYIATIMADIRRLVM

SEQ ID NO: 7657 - protein, 481 aa, marine gamma proteobacterium HTCC2080
MTGVDLIIFGASGDLSARKLFPALFQLDRAELLPSDLRITAIARDQVDVNTFLEGLRQRMHAYMGSESPSHAEWQHYSRHFQYVGADFANADSYSSIRATLDDTRISLFYLATPPSIFALICNNLATNNCLTGDCRIVLEKPIGECLASSKEVNETLARYFDEESIYRIDHYLGKETVQNLLALRFANRFINSQWDANCIDHVQITVGEIVGIEGRWSYYDRVGQLRDMVQNHLMQLLCLVAMEPPNSLEADSIRDEKVKIVKALRRIDSDQVSEHVIKGQYSQGWSSGAAVPGYLEEPGCERPDSDTETFIAIKAHVDNWRWAGVPFYLRTGKRVPEKLTEIIIQYKDLPHNIFSGGTSANKLIIRLQPREGIELTMASKRQTLREKLSLQNHTLDLDFRETTGMNRIPDAYERLFLDAINGDQSLFVGREEIEESWRWCDELIDACNQKNIETKPYHAGSWGPPKAELLIEKDGRSWHV

SEQ ID NO: 7658 - protein, 648 aa, Sulfolobus solfataricus [sequence omitted]

SEQ ID NO: 7659 - protein, 558 aa, Oryza sativa
  misc_feature (58)..(58): Xaa can be any naturally occurring amino acid
  misc_feature (108)..(108): Xaa can be any naturally occurring amino acid
MATRRALTFVLRSASRLRAASPSQCPRRAPLHPHRRPSPAGFLLNRAAAAYASSAAAXQAAPAPPPASGKATGGGKITDEFTGAGAVGQVCQVIGAVVDVRFDEGLPXILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVQSFQGVLDGKYDDLPEQSFYMVGGIDEVIAKAEKIAKESAS

SEQ ID NO: 7660 - protein, 422 aa, Brucella melitensis 16M
MTAQAGDANETGVHTMTETTPKTAPWTVQKRTAVLVLADGTVIEGKGLGATGAVEAEVVFNTALTGYEEILTDPSYAGQIVTFTFPHIGNVGANAEDIEDLTPANRHGAVGAIFKADITAPSNFRAAKDLDSWLKHRGIIALAGIDTRALTALIRERGAQNAVIAHDPNGNFDLDALKARAANWCGLENLDLAKDVTIGQSLVWKELPWTLQDGYGEQDAPQYHVVALDFGVKRNILRLLTGLGAKVTVLPATATAEDVLAHNPDGVFLSNGPGDPAATGEYAVPTIGKLVETGIPLFGICLGHQMLALALGGRTEKMHQGHHGANHPVKDYTTGKVEIVSMNHGFAVDSDSLPENVEETHVSLFDGTNCGLRVVGKPVFSVQHHPEASPGPQDSHYLFRRFINLIRERKGQAPLPEREQAA

SEQ ID NO: 7661 - protein, 485 aa, Sansevieria socotrana
  misc_feature (5)..(5): Xaa can be any naturally occurring amino acid
MRINXTTSGPAVSTLDEKTLGRIAQIIGPVLDVVFPPGKMPNIYNALVVKGRDTVGQQINVTCEVQQLLGNNRVRAVAMSATDGLTRGMEVIDTGAPLSVPVGGATLGRIFNVLGEPVDNLGPVDTCTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPGIVGEEHYETAQKVKQTLQRYKELQDIIAILGLDELSEEDRLTVARARKIERFLSQPFFVAEVFTGSPGKYVGLAETVRGFQLILSETVFLSRPFIWWVTSMKLPRKL

SEQ ID NO: 7662 - protein, 496 aa, Sparganium eurycarpum
MRTNPTTSSPGVSTLEEKNLGRIAQIIGPVLDAVFPPGKMPNIYNALVVKGRDTLGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEVESNL

SEQ ID NO: 7663 - protein, 419 aa, Oryza sativa Japonica Group
MRRKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIGLWCVQVLPMHRPTITQVLDMFERSLDELEMPPKQNFSELLEHPAQEINTESTSSTINTKAAQALSEVLRVEETSLVNSKDPTVTTNYAKR

SEQ ID NO: 7664 - protein, 496 aa, Strelitzia nicolai
MRTNPTTSSPVVSTLEEQNLGCIAQIIGPVLDVVFPPGKMPNIYNALVVKGRDTVGQQINVTCEVQQLLGNNRVRAVAMSATDGLMRGMEVIDTGAPLSVPVGGATLGRIFNVLGEPIDNLGPVDTSTTSPIHRPAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFVVAEVFTGSPGKYVGLAETIRGFQLILSGELDSLPEEAFYLVGNIDEATAKAMNLEGESKL

SEQ ID NO: 7665 - protein, 683 aa, Oryza sativa Japonica Group
MDTPLLLLLPFLAACLLAPRHAAEAAVTSCAPRRCGNVTIAYPFWLPDSSPPPSSSSAPCGPAAFQVNCDNGSRASLARSFRSGYKILGVSYANRTVVVANDNVQTDASGCPVPKIDVSASLTLAPFTASPANSQLVFLFNCTSSSRPPPAGFVNVTCPGAKAVVRLDTSYNNTAARVVAGGCDYAAVPVVGVPGASPTDYPQLLRGGYMLEWRAPAGDCMACNASGGQCGYDADTEAFACICSDGSSRPGICDAKKSGNKVILIVSLSICATGLVLLACIAIVYKCRRRMQNRFSFLNAMDGASRTDTAKVEKLLQSYGSLAPRRFRYSELKKITKSFSQRLGEGGYGTVFSGTLADGRAVAVKFLHHSKPNGEEFLNEVVSIGRTSHVNIVSLLGFCLEGSKRALVYEYMPNGSLDKYIYSTSAAAAAEAEEAEATASPDRDVLGWKVLQEIAVGVARGLEYLHDGCNTRIIHFDIKPHNVLLDEGFRPKIADFGMAKLCNPKESILSMADTRGTIGFIAPEVFSRGFGDISTKSDVYSYGMLLLEMVGGGSNVKAYAEKGASGTFFPLWVYDHLLEDGGVLQSVAAAAAATAGGGAGSPGGEEIARKMALIGLWCIQTVPANRPSMGKVLEMLERSVHELAMPPRPYHSNSSSPSRPSSYPSSASDFTQRSRLSTPGSTA

SEQ ID NO: 7666 - protein, 154 aa, Zea mays
MILPNKFALNLVGIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSEEEDDSGDEAILGNPDP

SEQ ID NO: 7667 - protein, 204 aa, Azoarcus sp. EbN1
MKPPRVYAIDGVVPVVDPSAYVHPSAVLIGDVIVGPGCYVGPCASLRGDFGRLILMAGVNVQDTCVIHSFPDHDTVINENGHIGHGAVLHCCTIGRNALVGMNAVVMDNAVVGENAFVAACSFVKAGMQVPPATLVAGTPAKVVRPLTEQEMAWKVQGTGIYQNLTRRCLATMVETDALAAVEADRKRIVMPEIVPLSEQKQRS

SEQ ID NO: 7668 - protein, 228 aa, Nicotiana tabacum
MATSAFGQCNLLPRTTTVNPTQLHSPRYSLSLPFHRQSLTSSPALSFTQSQGLGSAIERHCDRSDLFQTCAVRQLTGSVTSTKGHRFAVVVARFNDLITKKLLEGALDTFKNYSVRDEDIDVVWVPGCFEIGVVAQQLGKSQKYQAILCIGAVIRGDTSHYDAVVNAATSGVLSAGLNSGTPCIFGVLTCDTLEQAFNRVGGKAGNKGAETALTAIEMASLFEHHLKA

SEQ ID NO: 7669 - protein, 464 aa, Oryza sativa Japonica Group
MGQNLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLEAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGLNSVL

SEQ ID NO: 7670 - protein, 463 aa, Listeria monocytogenes str. 4b H7858
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTVISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAICTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFRTPFYPVVPALSFLLCVYLMINLSKTTWIAFGIWFVIGILVYTFYGRKHSALRVK

SEQ ID NO: 7671 - protein, 133 aa, Zea mays
MAAVVNARAATARCSAAGGPPRGAASLFPPSIRMRKRTTAAAGGRGRLVAVSAVGDVAAEGNTYLIAGAVAVALVGTAFPILFSRKDTCPECDGAGFIRKAGATLRANAARKDEAQIVCPNCNGLGKLGQIDK

SEQ ID NO: 7672 - protein, 352 aa, Triticum aestivum
  misc_feature (13)..(13): Xaa can be any naturally occurring amino acid
  misc_feature (154)..(154): Xaa can be any naturally occurring amino acid
  misc_feature (308)..(308): Xaa can be any naturally occurring amino acid
  misc_feature (317)..(317): Xaa can be any naturally occurring amino acid
MENGGSKGDVPDXHANAHCPGTQSEEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWXRGPRKNGLIKQFLKDVDWGEIDYLVVDAPPGTSDEHISIVQYLQATEVDGAIIVTTPQQVSLIDVRKEINFCKKVGVPVLGVVENMSGLRQAFTDLKFVKPGPAGETDATEWAMNYIKEKAPELLSVVACSEVFDSSKGGAEKMCHEMGVPFLXGKVPMDPQXLCKAAEEGRSCFADQRCSASAPALKSIIDKLIKTK

SEQ ID NO: 7673 - protein, 465 aa, Yersinia pestis CO92
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 7674 - protein, 540 aa, marine gamma proteobacterium HTCC2080
MSSIMNIDPELQSLANQIATRRVTECFEGDANRASDFRCTSNGLVLDYSKHHIDAPSRQRLLEIAQQSALAADFEALTRGDAINITEERAALHTLLRGTRKEESPELYAEVHATNSKLAQLVAKIHSGAWSGFGANRFTDVVNIGIGGSDFGPKVVCRALRTETDLMKSHFVANVDPQDLDETLASLDPQSTLFIICSKSFTTEETLTNALRARAWLLAAGAKDTDVNKHMVAVTTNLEGASRFGISPENCFPMWDWVGGRYSLWSAVGLSIALQSGWETFLRLLTGAHEMDIHTLGSHDKNNLPLMMALLEFWNTVYLKTDTHVVLPYAQALEKLPDFLQQLSMESNGKRVDLSGSALTLPSAPVLWGSAGTIGQHSYYQLLHQGNRRFTADIILPLSHKEKDLDAQRKLAANALAQSRALLVGRDKSAAQQLAAERGQPESFAPHYEMPGNHSHSLIYFESLTPEILGALIAAYEHKTFFLSRLLGINAFDQWGVELGKVIGRQILTMLEHGEGLEVIDPATAIAVEAWRSANARSTS

SEQ ID NO: 7675 - protein, 1023 aa, Schizosaccharomyces pombe 972h-
MNAQPFHNNTSDVQSFQDIISNSYQKPLSLVDSTDRALPDSSLSSLSRSTFQFHKHHLSGNENPQPSSESPYFTNNERLNSSSFPQIHDNQLSPSFNTSYQAIPSSSSNRSRGGPYTPSIRDDSLLALLSFSSNHRLHSMPSQLQPFNNASSYTTPMAPFTASFSNKVSHSAYPTRRLPSQAKKTSAIERVPVNLNFLQSDNLVVQSSPQTNFENFEFPKKIPSKEDLETREVLLLPPQTSKLSNKNLDTKSFTDVNKISQQGFVEISSNSSKVTPNTSLHQSFGIASSSSNNYMQTSSELTSSTEKMNGSHPLQLSNKSLLSIHLMQSKNQGHVSMTGSDKLSSHVQSETENAPVSKPSKPNTLTEDEKPLQSTKLPGNSLTVGELYQEPKSIQLPELSVSRTTYSAQSSSVKNCNERIPSAKALKKQKHLVPENKSKLQYVWQKKESLPYANLTSASNTHFFLSENQNDTSERLTRTLRKSTKNYTFGSYILGRTIGTGEFGKVKLGWPLPKANSTIHRSTPQVVIKIVLSTKQNCQTSRLMREVAILKGLGNNHPHIVKYLDFVKTKHHFGIVLDYVNGGELFDYILARRRLEDSVACRLFAQLISGVAYLHSRGVVHRDLKLENILLDTNRNIVIADFGFATTFGHFNTLSEHSLPTEKPDLFSTSCGSPCYAAPELVNCKSGMYAGTQADIWSCGVILYAMLAGYLPFDDDPHNPNGENVPRLYRYICSTPLIFPEFFKSKARDILKKILVPDPAKRVRMSAIMNHAYLRSHVSLFETYNDDEATSLRPSPIRLLSQKSLASVSSVSSISTYSSSIELTPQITKTSLNREKPALHGSINLKHSTRPVVPIADGIYASTTLHPIDNAKNRLVSLLRRPKHKVKHAKVETRESPMKNKPTKKQHKRAFSMFERPTSQKAPLSPVESKINLMVAPKRVLNCASDSLRALLAGKTDKSFWGSRIPFLFNKLKSKQKAVSSSFNTENSFLILQAVSPLTFGGCFKEENAYGQKKQHMRHATVF

SEQ ID NO: 7676 - protein, 386 aa, Candida albicans SC5314
MLFIKSLIRSIIASPKNQYYDSSTNLKLDLSYITPQLIVTSAPVTNYIESWYRYPLNDLLQFLNSNYGSNWHIFNFRGESPGYDDSLVYRKVSHYPFPDHYPPTMNIIINCIDEIDNLLQVFGDKTNVVAVLHCKAGKGRSGTLCCAYLIYQKYHKYHQSHSNKSFTLEDILLIYTTKRMNYLIGGEGISIISQKRYLQYWYDYIHNKQLRESYINWLNIMKFINLKIIRIGGLKLSNIDYLNISISTYITKIETDTSGNSNNRSNTIVKELIQLTNENCDIDNHDDGHDDYWITYNIHDLKIFQLEDIMIGIQSWSYIWFNIFFESFKSNGHGHGHHNNNKVLFNWDDDIDGFKGFKQKGIKLFNEIELQWDVIITTKSTDIYAN

SEQ ID NO: 7677 - protein, 778 aa, Oryza sativa Japonica Group
MPHRRRLLNPAPSLPAPPAAAPAGFHHHLLAVDDTRLPLLADYALLQGEAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 7678 - protein, 350 aa, Magnaporthe grisea 70-15
MDGKRHLNSFQQLEKLGEGTYATVFKGRNRHTGELVALKEIHLDSEEGTPSTAIREISLMKELKHENIVGLHDVIHTENKLMLVFEHMDGDLKKYMDTKGDRGALQPMVIKSFMYQLLKGIDFCHQNRVLHRDLKPQNLLINNKGALKLGDFGLARAFGIPVNTFSNEVVTLWYRAPDVLLGSRTYNTSIDIWSAGCIMAEMFTGRPLFPGTTNEDQIVRIFRIMGTPSERTWPGFSQFPEYKKTFHTYATQDLRNILPQIDATGIDLLGRMLQLRPEMRISAHDALKHPWFNDILMQQHQQQHAIQAQAQAHQARTQSGSSQQQQSYSQQQVPQQQQQTHSQAQPYENY

SEQ ID NO: 7679 - protein, 219 aa, Nitrosomonas europaea ATCC 19718
MTQDEQKRAVAQAALQYVPTGEIIGIGTGSTANLFIDELAKIKHRIEGAVASSEVTANRLKQHGIEVLDLNSVGELPVYIDGADEITRNMHMIKGGGGALTREKIVAAVARKFICIADQSKLVKVLGKFPLPVEVIPMARSYVAREITLLGGQPAWRQGFTTDNGNIILDVHNLNIMNPVELETALNQIAGVVTNGLFARRAANVLLMGTDQGVETITV

SEQ ID NO: 7680 - protein, 668 aa, Gloeobacter violaceus PCC 7421
MVAQSRLAAPPTPWSRRLAEAAIDPSAYVHSFSQIIGDVRIGANVLVSPGTSIRADEGSPFHIGANTNIQDGVVMHGLQEGRVNGDDGQSYSVWVGSNTSITHMALIHGPCYVGDDCFIGFRSTIFNARVGKGCIVMMHALVQDVEIPPGKYVPSGAVITSQQQANRLPDAQDIDIHFAKHVIGINDALRQGYRCAADIECIVPIRDESSPAAPGTNGKPTPKTHAQVSSMFMTSQTLDTVRSLLAQGCRLAVEFADERRFRANSWVSGPAIQAAREPEVVSALENVLREHAGEYVRIIGIDPKAKRRVAETVIQRPDGKPVEANSSSGKFAMTPAAPPGGSHRPGNGGLLSPEAAQQVQSLLSQGYRIGTEHADERRFRANSWQNCAPIAATREPEVLAALEGCLQEHAGEYVRIIGIDPKAKRRVAETIIQHPNGKQPSGGAAAPAQGYNTVSHRASGGGMLDAAVLDMVRSLLSQGHRLGVEFADERRFRANSWVSGPAIQAAREPEVVSALENVLREHAGEYVRIIGIDPKAKRRVAETVIQRPNGRPVSGGAATASTPAAGGYSPAPAHAPGPMRSSSLSSEVLDQLRHLLGQGHRIGVEFADVRRFKANSWVSGPAIQAAREPEAAAALETVLREHAGEYVRLIGIDPKAKRRVAELIIQRP

SEQ ID NO: 7681 - protein, 884 aa, Emericella nidulans
MSEDQGQQGQRLSTARGSTCLKQTMTEPALSAGLGTDGPVGAAKDNIRVRIQSRRRSRLLSRLGRKIPTQAVEPVKSHETHSHSSDAEGTSHQDVSDRRNHPCHTPRPSSHSQADSFESVARGQQKEQSRTMREDAVSPVLLDVKRSQSTPVELAKLVSLKLSTSFGSRTVIRRSQPGVRQSVRAAQLQRMMLDRGNPKRERSSGSSTPSSKSSPVDSVSTAPTSVSPGSLAPSGSTNNDPASGFKHIDSQADLPERPLSPVRESPMVSPTIQTTEATAIVKVFLETHFHTLLSGLDARTQRRLELDQYIETFPLSPEEVVRVRKHWVTQERDYLRQYRVLKSRPQDKTSRAGTASLAGFEPLKILGRGSFGVVRLVREKRTDEQTQSGRVPLAPKTNHRQAMTGVKKDVFAMKVIRKSVMIRNCQEAHLRAERDFLVASAKSRWVVPLIASFQDQKHLYLVMDYMVGGDFLGLLIRHNILRESIARWYVAEMILCIEEAHRLRCIHRDVKPDNFLISESGHLKISDFGLAFDGHWAHDQWYFTYQRHSLLKRLGIQIDGDAEDQKLSHDANIQSLGTTREDGSMEDDWIHPPTNGLLHWRDKNQTRTMARSVVGTSQYMAPEVIRGHPYDGRCDWWSLGVILYECLYGFTPFASEDRHQTKLKIHRHLQTLYFPVHRPTDKLVSADAIDVINSLLQEKEFRLSSPKYKQNDAISSKPAKCSFYKPDSSNPSYQGHYVYPDDATDIKSHRFFRGINWEQIHRTSPPFIPMVRGWEDTRYFDDGEHPSDREDDSSDSELDGVQDKWHPLGGKGGLHKPDKPLKADVKPSSYPKGNDGAKDTAIASLKHKKRLKEAKRARDKILRDKRLRRTVLEMLRCLVVVAAT

SEQ ID NO: 7682 - protein, 406 aa, Fulvimarina pelagi HTCC2506
MPLDIDFVRKQFPALSGEWVFMDNAGGSQVLSRVADRVSDYLLTSNVQTGASYEPSQRSTARVRAARQAFSEYVNAKDAGEIVMGASTTMLIRILSEGLMGKLGAGDEIIVTDTDHEANIGPWLKHEARGVKIKVWHCDPETFELDPADLRNLMSERTKLVCVTHASNILGTINPIAEISKIAHDGGAEVCVDGVAYAPHRAIDVQALGCDYYVFSTYKLFGPHFAVMWGKREKLLELDNIYHFFFGKDSVPHKLEPGNINYELAHGSVGAIDYVNELGSQAGAADGRNAIEAGFADIAEHERAITSRLFDFLQSRNSIRIIGRTTDAIEERVATVSFTVGDQNSKSIVDRIDAHKIGIRFGDFYARRLIDNLGLSDRNGVVRVSMVHYNTHDEVDRLIGALEPLI

SEQ ID NO: 7683 - protein, 485 aa, Zingiber gramineum
  misc_feature (453)..(453): Xaa can be any naturally occurring amino acid
MRTNPTTSSPVVSTLEEKKLGRIAQIIGPVLDVVFPPGKMPNIYNALVVKGRDTVGQQINVTCEVQQLLGNNRVRAVAMSATDGLTRGMEVIDTGAPLSIPVGGATLGRIFNVLGEPVDNLGPVDTSTTSPIHRPAPAFIELDTKFLIFETGIKVVDLLAPYRRGGKIGLFGGAGVGKTVLIMELINNIAKAHGGVSVFGGVGERTREGNDLYIEMKESGVINEKNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKMERFLSQPFFVAEVFTGSPGKYVGLAXTIRGFQLILSETVFPSKPFIWWVTSMKLPRKL

SEQ ID NO: 7684 - protein, 305 aa, Zea mays
MEKRKKPCFVCGLFGHNAKQCTQGQDCFICKKGGHMAKDCPDKHRRNDHQSTLCLRCGEIGHEMFGCTNDYPPDDIEKIRCYVCNQKGHLCCSDFFDDSLEQVSCYNCAQSGHSGLGCAKQRREASAVTTPTLCFKCGEEGHFARGCTKNAKSDGPKGWSSPHSQRKGRWKNDGKSPSHIRRKEKWKKDSSARSAPHDACTTSKSNSPSFEERMGASNHKSKWRGGWTGDDDLPSKKYKPNGWGSPATPKRSYTNHQYLSGGGDYFTPQSSRRHNHGTASPGARKHRFSSSIFAASNTHVRFKRS

SEQ ID NO: 7685 - protein, 427 aa, Vitis vinifera
MDVELKEMLDDLQALKRSLPDPSHQASIDKLQVHVEHLTNLAQYAPARRSKVKDMSAEVVDSNPYSRLMALQRMGIVENYERIREFSVAIVGIGGVGSVAAEMLTRCGIGRLLLYDYDKVELANMNRLFFRPEQVGMTKTDAAVQTLSDINPDVVLESYTLNITTVQGFETFMSSLRKKTFRPKKEGSGVDLVLSCVDNYEARMVVNQACNELNQTWMESGVSEDAVSGHIQLLIPGETACFACAPPLVVASGVDERTLKREGVCAASLPTTMGVVAGLLVQNTLKFLLKFGHVSPYLGYNALKDYFPTMEMRPNPQCSNASCLERQKEYLLAKPARDAAAKAKMEAEALVVAECPIHVDNEWNISVVDDSELDRTDGRSSDALPEGLTHELPTADEFEKQPTPETTFNSVDDLDDLRRQLDALNAD

SEQ ID NO: 7686 - protein, 493 aa, Zea mays
  misc_feature (124)..(124): Xaa can be any naturally occurring amino acid
  misc_feature (143)..(143): Xaa can be any naturally occurring amino acid
  misc_feature (193)..(193): Xaa can be any naturally occurring amino acid
  misc_feature (297)..(297): Xaa can be any naturally occurring amino acid
  misc_feature (384)..(384): Xaa can be any naturally occurring amino acid
  misc_feature (398)..(398): Xaa can be any naturally occurring amino acid
  misc_feature (409)..(409): Xaa can be any naturally occurring amino acid
  misc_feature (419)..(419): Xaa can be any naturally occurring amino acid
MASRVASGLLRRRAGATLGLLRSYAHVRSYNSQLSALVSATSECSNLPRCYYLPNPSPYQVWSRSFASDNGDKFEAVVPFMGESVTDGTLANFLKKPGDRVEADEPIAQIETDKVTIDVASPEXGVIEKLIASEGDTVTPGCXVQYSPDSAQTARPHEASIDVASPEASSIEKLIASEGDTVKRATKVAIISXSAQPAETHVAPSEEATSKESSPPKVEDKPKVEEKAPKVDPPKMQAPKPTAPSKTSPSEPQLPPKERERRVPMPRLRKRIANRLKDSQNTFAMLSTFNEVDMTNXLMKLRSDYKDEFVTKHGVKLGLMSCFVKAAVSALQNQPIVNAVIDGDDIIYRDYVDISVAVGTSKGLVVPVIRDADTMNFADIEKGXKQPCKESKLRGRSXIDDMAGGTFHXSPNGGVYGSXLLSTPIINPPQSSILGMHSIVQRPVVVNGDILARPMMYLALTYDHRLIDGREAVFFLRRIKDVVEDPRRLLLDI

SEQ ID NO: 7687 - protein, 182 aa, Burkholderia sp. 383
MKTVGDKLEAFTVVAAKPGFNHHEENGQSAFETVTEASFPGKWKIIYFYPKDFTFVCPTEIVEFAKLTKQFEERDAILLGGSSDNEFVKLAWRREHKDLDKLNHYAFGDVKGELIDQLGVRDKEAGVALRATFIVDPDNTIQHVSVNNLNVGRSPEEVLRILDGLQTDELCPCNRAVGGATL

SEQ ID NO: 7688 - protein, 638 aa, Mycobacterium sp. JLS
MLEQIRGPADLQHLSQSALSELAGEIRQFLIHKVAATGGHLGPNLGVVELTLALHRVFDSPHDPLIFDTGHQAYVHKMLTGRSHEFDSLRKKDGLSGYPSRSESEHDWVESSHASAALSYADGLAKAFELTGHRNRHVVAVVGDGALTGGMCWEALNNIAAARRPVVIVVNDNGRSYAPTIGGFADHLAALRLQPGYERVLEEGRKAVRGLPVIGEFCYQCMHSVKAGIKDALSPQVMFTDLGLKYVGPIDGHDEHAVESALRHARGFNAPVIVHVVTRKGMGYAPAENDEAEQMHACGVIDVATGRATMVAAPGWTSSFSEALIDYGAKRRDIVAITAAMPGPTGLSAFRDRFPDRFFDVGIAEQHAMTSAAGLAMGGLHPVVAIYSTFLNRAFDQLMMDVALHKLPVTLVLDRSGVTGPDGASHNGMWDLSVLGIVPGMRVAAPRDGARLREELGEALDVNDAPTAIRFPKGDVGEDIPAVRRHRGVDVLAEPADGLSDDVLLVAVGPFASMALTVAERLRKQGIGVTVVDPRWVLPVPEVLTEFAAAHKLVVTVEDNGLHGGIGSSVSAALRHAEVDVPCRDVGLPQQFFDHASRGEVLADVGVTDRNISRQITGWVAALGATPADADEVSERLD

SEQ ID NO: 7689 - protein, 159 aa, Triticum aestivum
RPTRPGLIDGDKSRLDINNTESSIDSTIYKLEMMSIELFSVYGKQFMIDPQDFQDAEPDLLSNHASDIIKRVKENSDQCTMALRSLCSRKKGLTVEDASLIGVDSLGIDVRAFSGLEARTVRFSFNAQALSERSAEKKIKRMLFPRYRKTVKASTEDEC

SEQ ID NO: 7690 - protein, 161 aa, Burkholderia sp. 383
MDFRIGQGYDVHQLVEGRPLIIGGVTIPYERGLLGHSDADVLLHAITDALFGAAALGDIGRHFSDTDAAFKGADSRVLLRECVARINAAGFTIQNVDSTVIAQAPKLAPHIDGMRANIAADLGLPLDRVNVKAKTNEKLGYLGRGEGIEAQAAALLVKQGG

SEQ ID NO: 7691 - protein, 266 aa, Gossypioides kirkii
LSVEEIEVAPPQKNEVRVKIHFTSLCHTDVYFWEAKGQNPLFPRILGHEAGGVVESVGEGVKDVQLGDHVLPIFTGECNECPHCLSEASNMCDLLRINTERGGMLHDGKTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHDKPVQEVIAEMTGGGVDCSIECTGSIQAMISAFECVHD

SEQ ID NO: 7692 - protein, 439 aa, Vitis vinifera
MAQSARVAVIGAGVAGLAAARELHREGHHVVVLEKRHSLGGTWLYDSRVDSDPLSLDPARDVVGTSLYHSLRTNLPRQLMGFLDYPFAKRPHEDQRTFPGHEEVLRFLNEFADEFRLRELIRFCTEVVRPSEGTTRGWLNLGITGLTRQEVYDAVVVCNGHFTEPQLAEVPGIEKWCEYQIHSHNYCTPKSFMGQVVVLIGLGPSAFDISREVATVAKEVHITTRAPNVTVGKSDNHENIWLHKMIEFVYEDGKVVFQDGSSVHADTIFYCTGYKYHFPFIETNGIVTIDDDNRVGPLYKHVFPPHLAPWLSFIGMPKQDTPFLTTELQSKWLAHVLSGKVLLPTEEEMMSDVENYYHHMEETGVPKSFTHVLPPNEIEYRNWLLAQVEMPPLKEWRGRMYRECVKFAKAKLDGYRDQWDDDYWDAVIASQVDSTLPKT

SEQ ID NO: 7693 - protein, 263 aa, Arabidopsis thaliana
  misc_feature (124)..(124): Xaa can be any naturally occurring amino acid
  misc_feature (210)..(210): Xaa can be any naturally occurring amino acid
MSQEEQPKRPQEPVTYGDVFEVSGELADKPIAPEDANMMQAAETRVFGHTQKGGAAAVMQSAATANKRGGFVHPGDTTDLAAERGVTVAQTDVPGARVTTEFVGGQVVGQYVEPRPVATAAVYXAEVVGLSLQSAITIGEALEATVQTAGNKPVDQSDAAAIQAAEVRACGTNVIAPGGIAASAQSAANHNATIDRDEDKIKLIDVLAGXATGKLAADKAVTRQDAEGVVSAELRNNPNLSTHPGGVAASITAAARLNERADI

SEQ ID NO: 7694 - protein, 463 aa, Vitis vinifera
MALLARVAVIGAGVAGLAAARELHREGHRVVVLEKRHSLGGTWLYNSRVDSDPLSLDPARAVVGTSLYHSLRTNLPRQIMGFLDYPFAKRIHGDQRTFPGHEEVLWFLNEFADEFQLRELIRFCTEVVRAERAEGRNDEWVVESRSRGSESAKVVREVYDAVVVCNGHYTEPHLFEVVPSIEKWRGYQIHSHNYRIPKPFTGQVVVLIGFGPSAFDISRDVATVAKEVHIATRAPNVTVGKLDNHKNIWQHEMIEFVDEDGKVVFQDGSSVHADTIFYCTGYKYHFPFIETNGIVTIDDNRVGPLYKHVFPPRLAPWLSFIGMPKQGTPFMTAELQSKWLAHVLSGKALLPTKEEMMSDIEKYYHHMEETGVPKRFTHVLPPNEIICMVIRISTSMENIEYMNWLLAQVGMPPLKEWTGRMYKECAMLAKAKRDGYKDQWDDDYWDAVIASQVDSIVPKNLIS

SEQ ID NO: 7695 - protein, 116 aa, Magnetospirillum magnetotacticum MS-1
MTAPRLGLAPKIGAGTVICPRCCISTDCEIGEHVLINSASGVGHDAIVGPYSSLLGAVSINGNVKVGEGVLFGAGSMVYPGKKIGDWAKIGLGSVVLRNVPDRAVMFGNPAQRIDA

SEQ ID NO: 7696 - protein, 334 aa, Photobacterium profundum SS9
MKYLVTGAAGFIGSAVSERLCAQGHEVIGIDNLNDYYDVSLKHARLDRAEHDKFTFVELDLADRDGMAALFADQQFDRVIHLAAQAGVRYSIDNPMAYADSNLVGHLAILEGCRHNKVKHLVYASSSSVYGLNQKMPFNTSDSVDHPISLYAATKKSNELMAHTYSHLYDVPTTGLRFFTVYGPWGRPDMALFKFTKAIVDGETIDVYNNGDMRRDFTYIDDIVEGVMRIQDVIPQKNPDWTVEAGSPATSSAPYKVYNIGHGSPVKLMDYIEALEDALGIEAKKNFMPMQPGDVYATYADTEDLFKTINYQPAVKVKEGVKAFVDWYRAFYKC

SEQ ID NO: 7697 - protein, 105 aa, Zea mays
MLVCMSHAWSAEATLAGAKAAAVATIASAIPTLASVRMLPWAKANINPTGQALIVSTVAGMAYFIAADKKILSLARRHSFEQAPEHLKNTSFQGTGRPHPAFFRP

SEQ ID NO: 7698 - protein, 368 aa, Dichelobacter nodosus VCS1703A
MTIHSTEEIIADLRAGKMVIIMDDEDRENEGDLMILAEHITPEAINFMTKYGRGLICLTINQARNDRLKLWPQAMNNGSQFATNFTVSIEAAEGVTTGISAYDRATTIKKAVAKEALPEDLVQPGHVFPIVAREGGVLVRAGHTEAGCDFARLAGFEPAAVIVEILKDDGTMARRPDLEAIAEEHGLKIGTIADLIAYRLAREQIVVQISTCELPTRYGTFTLTAYQSILDKTLHYALVKGKISPQKATFVRVHVQNPFSDLFGAPLSERNFTLDDALSRLAQEEEGIVVVLDEGEKQNHIINRMHAFAHQNPPPKPQQEDDLRTYGIGAQILIDQGVRRMRLLSTPYKFTGLSGYQLEVSEFLTELK

SEQ ID NO: 7699 - protein, 262 aa, Zea mays
MPDQTSAAAAGGAAFDRCLLALYLISPLTVLALRFISAPYGKLSRPGWGPVLPAPLAWFLMESPTLWLPPLVLLRWPPPPLSGPLAALPAALYAFHYVHRTLVHPLRLARLRRAPAPVPLLIAACALGFNILNAYLQARSFALHAGRQASPFRCLAGLALFAWGMRTNIAADKELLRLKEAGGGYKIPRGGWFDLVTSPNYFGETVEWLGFAVVAWTPAAWAFFLYTCANLGPRARDHRRWYVQKFRGEYPASRKAFIPYIY

SEQ ID NO: 7700 - protein, 398 aa, Rickettsia typhi str. Wilmington
MSIKIIIPSLGESVTEATIAKWYKKLGDAVKTDELLLEIETDKVTLEVNAPCNGTIGKISKTDGANVTVGEEVGEINEIADTDTAWINNKKQEVSQHTSEQLVDKPAMASNILAPSVQKLVTENKLDPNNIKGTGRGGRITKYDVLETINTTPITIETHAINKTNEERTQRVRMSRLRKTIAQRLKDSQNTAAILTTFNEIDMSKVIALRNQYKEEFEKKHTVKLGFMSFFVKATIEALKLIPSINAEIDGDDLLYKNYYDIGVAVGTEQGLVVPVIRDADKMSFADIEQAIGNLAKKAREGKLSISDLSGGTFSISNGGVYGSLLSTPIINPPQSGILGLHKTEERAVVIDGKIEIRPMMYIALSYDHRIIDGKEGVSFLVKIKNLIENPEKLLLNL

SEQ ID NO: 7701 - protein, 673 aa, Oryza sativa
MQKACSVQLLRPSRSRRRESWPQLGGSVVTGRPCYLRGSRGLSRLNGMVLCFQPPQSASVVHLEEEDKYSCIDHSTSYLHVQSVRDFPIEKLNAEVVLVRLDSELLCNPLGSCNLSLERTVSTIKYLHKAGAKVLLVTSWTPVLQSVYPVLKSTETFADYMSSLLQVKVVPVNGVPGLTSFKPEGWMQNDIILFENLLNFKGENANCNDFSQKLASGAAIFVNDSFSLSHKMLASTVGITRFCHASLAGFHFEEELMQLRKITDTTRRPFIAIIGGSNFLGKAPALNLLASLCDGLFFVGKLSLQIMNGFGIPVPSCFVEKNSTKEVLQLIQTAHNRNIPIYYPTDTWCLNNKNNNHEKLEILDSAELLPGWTPADIGPSTLEKISSLMPLYKKVLWIGPTCFDLTEEFSGGAAQLGRILDKASHDSCDVILVGSAACKAVKGISGSSSKYTTFKNASVVLEFLKGKILPGVAALDKSYPYQIPWNAIFSDSSQPLVVDIGSGNGLFLFQMARNWEGSNFLGLEMNKKLVVRCLRDVASVDKRNLYFVSTNATSTFRSIVSSYPGQLALVTIQCPNPDFNIEQNRWRMVRRMLVEAIADLLQPNGKVYLQSDVESVLLRMKEQFMTHGKGQLVVDDDGGGDHQMDNPFGAASDWERHVLARGAPMYRTMLRKV

SEQ ID NO: 7702 - protein, 468 aa, Salmonella typhimurium
SAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 7703 - protein, 214 aa, Listeria monocytogenes EGD-e
MTFVAPSLLAADYMNMANSIKEAEDAGADYLHIDVMDGHFVPNLTFGIDMVEQIGKTATIPLDVHLMLSNPENYIEKFAAAGAHIISVHIEAAPHIHRVIQQIKAAGCKAGVVLNPGTPASVLDAVLADVDLVLQMTVNPGFGGQAFIDSTIKNMRYLDNWRRKNHGSYVIEVDGGVNAETAEKCKQAGVDILVAGSYFFGATDKAACIQGLKK

SEQ ID NO: 7704 - protein, 509 aa, Oryza sativa
MQPMATANLLYAALLVPTVLYLAVTRRRSRRLPPGPVGLPLVGSLPFIDPNLHTYFASLAAKHGPILSIRLGSKVDIVVNSAQLAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRLSKPELYYS

SEQ ID NO: 7705 - protein, 224 aa, Listeria monocytogenes EGD-e
MRKIAASIMCADQLHLGDELQRLESAGVELLHCDVMDGVYVNNLALGPEYLEIVRNNTEIPLDIHLATITPLKYIDMFGPVKPEYISFHVEVAEDVSEIIRKIRSYNVKPSIAINPETPIEAIYPYLDDVEMVLMMTVNPGFAGQKFQTDVLQKLHDLKAKLAGKIHAPLIEVDGNINKETVGLMRDCLPDIYVLGTSALFHDRDKTSYAERLVHIWSNVEKHV

SEQ ID NO: 7706 - protein, 412 aa, Zea mays
MHISRATAEATKQAGTTSHYSPRLCRPFSSRRRRPRLHPRGTRMAAPALRITARLGLALDGATAARRREASAPVAVPAAPWLKKAAVRCQRAVGAAVAEKKDAPVSVAQERSGDGGAAPELTVVMKFGGSSVASAERMREVADLILSFPEEHPVVVLSAMGKTTNKLLMAGEKAVGCGATNVSELDELSFVKELHLGTLDQLGLDRSIVCGLLDELEQLLKGIAMMKELTLRTRDYLVSFGECMSTRIFAALLNKIGVKARQYDAFDLGFITTDDFTNADILEATYPAVARRLHVEWINDPAIPIVTGFLGKGWRSGAITTLGRGGSDLTATTIGKALGLREIQVWKDVDGVLTCDPNIHPKAKPVPYLTFDEAAELAYFGAQVLHPQSMRPAREGDVPVRVKNSQYHGHSG

SEQ ID NO: 7707 - protein, 504 aa, Oryza sativa Japonica Group
MQPPILLPLLLLLLLLAAASPRPVLSRRHASPPLATETLDVAASLSRARAAVSAEAVPLHQSAAAAVSTEVVGEEHEEGRLALRLHSRDFLPEEQGRQRHASYRSLVLARLRRDSARAAAVSARAAMAADGVSRFDLVPANVTAFEASAAEIQGPVVSGVGLGSGEYFSRVGVGSPARQLYMVLDTGSDVTWVQCQPCADCYQQSDPVFDPSLSTSYASVACDNPRCHDLDAAACRNSTGACLYEVAYGDGSYTVGDFATETLTLGDSAPVSSVAIGCGHDNEGLFVGAAGLLALGGGPLSFPSQISATTFSYCLVDRDSPSSSTLQFGDAADAEVTAPLIRSPRTSTFYYVGLSGLSVGGQILSIPPSAFAMDSTGAGGVIVDSGTAVTRLQSSAYAALRDAFVRGTQSLPRTSGVSLFDTCYDLSDRTSVEVPAVSLRFAGGGELRLPAKNYLIPVDGAGTYCLAFAPTNAAVSIIGNVQQQGTRVSFDTAKSTVGFTTNKC

SEQ ID NO: 7708 - protein, 136 aa, Mycobacterium sp. JLS
MSAPKVQLTDDEWRQKLSPEEFAVLRRAGTERPFTGEYTDTETEGVYQCRACGAELFRSSEKFESHCGWPSFFDPADSDAVILRPDDSLGMRRVEVVCANCHSHLGHVFEGEGYPTPTDQRYCINSISLRLVPAGG

SEQ ID NO: 7709 - protein, 272 aa, Vitis vinifera
MPMLNRVLLGKVALVTGGATGIGESIVRLFLKQGAKVCIVDVQDDLGQKLCDTLGGDPNVSFFHCDVTIEDDVCHAVDFTVTKFGTLDIMVNNAGMAGPPCSDIRNVEVSMFEKVFDVNVKGVFLGMKHAARIMIPLKKGTIISLCSVSSAIAGVGPHAYTGSKCAVAGLTQSVAAEMGGHGIRVNCISPYAIATGLALAHLPEDERTEDAMAGFRAFVGKNANLQGVELTVDDVAHAAVFLASDEARYISGLNLMLDGGFSCTNHSLRVFR

SEQ ID NO: 7710 - protein, 321 aa, Oryza sativa Japonica Group
MKMPGRLLAAGAAALLVAASVMVATLLTAPLPFLPSLMPCLPAVTAPSGSGYSPPGLAALADAAVRYATTPTVPQQSRAEISLSLAVLRRRAPLRLLVFGLGHDSPLWHALNPGGATVFLEEDPSWYSVVRGQSPFLRGHLVAYRTRLDHADRLLATYKDHPSCLPGGGGNGGGDVPRVRGNAECPLALHNLPAEVYEKEWDMVMIDAPKGYFASAPGRMAAVWTAAAMARGRRGEGDTDVFLHDVDRRVEKAYAEEFLCERFRVGATGRLWHFRIPPASRRGNGTAARRAAPAPAMGGDPSAKEVRIAIFGGAFLQNGLD

SEQ ID NO: 7711 - protein, 899 aa, Cryptococcus neoformans var. neoformans B-3501A
MAPSHSHPAHYRRPPSPLPDLGAPLFSLAPSASASASSRTARPHGDTDSVQDVAEMSLESLTLSPPTTATTITTTVAPPTPTTPTSSSTAAATHPVATGGTAAEYPETAAAGIATGAVFTGIGINPPTPAPSPGPHIRGFDDSDTHIREHLEQLLYHGDTTTDPHGQNLDHVQVQAKPHAKPQAQGKTLPHEPYPSPSPAPTPTPTPQTVLSQYTSLPPLLRSKFLNLLIPHLALHEALSLSRKIEPLLRRDFLRELPWEVALHVLSFVISRYWNTLLQDETTWRDLLARHHHRHRYASGGGIGISGRDPPQHARATSREGMEGMTGKEEEEKGWDVGSGLGPPADPNAATSTNTNTNTNTSSRRGGSTSSSQAGTSKQRSKTRDNALGTGSGTKQACCIKRVTPFGLEKRVLNLSSGLTGLPPPISPFSPSPSPFPSPSPSSQHSYKTRVKLAYLTETNWLTAGVLLAKHLSADDSVVTTLSFDETWIVVGMANSKIHVFSAFNGGWKRSLEGRAAHTQGVWAMVLVSPPPRTATATQTATANQMQMQEQDMKRMRGTRGMGWYGAQASASTSTSTSPNGWFGINPPSSYPHPQTQTQTQTQSETQENETPYQHGRENQSRGQDQGGNENEDEDENEGSNLCGSVRGWQGLKTSLVVSGGCDKQVKVWDVETGQCIHSLPGHTSTIRCIKVLPHRPIAVSGSRDYTLRVWDIQRGRCLHTLRGHTKSVRCVEIWGNMAVSGSYDNTAKLWNLDTGECLQTFTGHYSQIYSIAFNGSLVITGSLDSTVRVWSPTTGECLALLQGHTALVGQLQLSGSKLVTGGSDGRVIIFDLSSMSCIHRLCAHDNSVTCLQFDKRFIVSGGNDGRVKLWDVKTGGFRREDCGALSERGEDLFGGGQF

SEQ ID NO: 7712 - protein, 499 aa, Ralstonia solanacearum GMI1000
MADAVVSHYIAGQRHAGTATRSADVFNPATGAVSAQVLLGGKAEVDAAVAAARAAAPAWAETSPLKRARILFKFKELLDQHHDALAAAITREHGKVFSDAKGEVTRGIEVVEFACGIPNLLKTEFTDNIGGGIDNWNLRQPLSVVAGITPFNFPVMVPMWMFPVALACGNTFVLKPSERDPSPSLMIADLLKQAGLPDGVFNVVQGSKEAVDALLAHPDVQAVSFVGSTPIAEYIYAEGTRRGKRVQALGGAKNHLVVMPDADLDQAVDALIGAAYGSAGERCMAISVAVAVGGVADRLVPRLAERARALQIGNGMEPRSEMGPLVTGAHKVKVEGYIAKGVEEGAQLVVDGRGHTVEGHAEGFFTGGTLFDHVTPDMTIYKEEIFGPVLSVVRVHDFAEAVDLINAHEYGNGVSCYTSDGGIARAFARQIQIGMVGINVPIPVPMAWHSFGGWKRSLFGDHHAYGEEGVRFYTRYKSVMQRWPDSIAKGAEFVMPTAK

SEQ ID NO: 7713 - protein, 445 aa, Ralstonia solanacearum GMI1000
MKPAPHPLETTDLSYFWMPFTANRQYKAAPRLLVSAQGMYYRDADGREVLDGTAGLWCVNAGHCRKAIVDAITAQAAAMDFAPTFQMGHPVAFRAAEKVAEIMPAGLNRIFFVNSGSEAVDTALKIALAYHRARGEGQRTRFIGRERGYHGVGFGGISVGGIAPNRKAFSANLMPGVDHLPHTHAPEHNAFSKGQPAWGAHLADELERIVTLHDPSTIAAVIVEPLAGSTGVLVPPKGYLERLRALCDKHGILLIFDEVITGFGRLGAATASAFFGVTPDLLTMAKGINNAAVPMGAVAVRQSLHDAVIEAGAPGAIELFHGYTYSAHPLAAAAAVAAIDLYRTEGLFERARALSPAFEAAAHSLKGAPHVKDIRNLGLVAGIELEPRPGAVGARAYEVFLKCLERGVLVRYTGDTLAFSPPLIISEAEIARIFDTVRTVLQEVA

SEQ ID NO: 7714 - protein, 522 aa, Borrelia garinii PBi
MNNNKETKLKDLENQEFDLIIIGGGATGLGIAVDAITRGYKAILIEKFDYAKGTSSRSSKLIHGGVRYLAQWNISLVKEALHEKAILEKNAPHLINECAFITPIYNILEIPYYYLGLTYYHNLMGKEKATKYKTKLLSKKSTIEKATNIKTKGLKCSVLYYDDSFDDARMAITLLRTFTEKGGIALNYTELVQFNKENGKLSGVLIQNKLSKEQISLKSKCIINATGIFSDEIRRLDDEKALNIIKPSQGSHLIIKKDKFPQNYAILIPKTSDNRILFAIPWYDGVVCGSTDIPIKEIEVEPKRLDEEIDFIINNLNNYLNIKIEKSDVKSVYTGIRPLIMDPKVEGNTSKISRNEKIFISDSNLITIAGGKYITYRKMAEKTLLKAIEKNLLPNYPPTTENLKLHGYLKKEEAVKIPESFRTYGSDFEILKNMEGFDKKIHESLDLNEAQIAFSIEFEQAKTIDDVLARRTRSLPLNPQAAIEAAPRVAEIMMKKLNKSEKWKNEQIKTFLEISKKYLIKN

SEQ ID NO: 7715 - protein, 119 aa, Glycine max
MAEEGQVVGVHTVDAWNQQLQNGKDSQKLIVVDFTASWCGPCRFIAPVLAEIARHTPQVIFLKVDVDEVRPVAEEYSIEAMPTFLFLKDGKIVDKVVGAKKEELQLTIAKHVSAAAASS

SEQ ID NO: 7716 - protein, 335 aa, Yersinia pestis CO92
MNQFYKRHFLRLLDFTPAEIIALLDLATELKKDKKSGCEQQKLVGKNIALIFEKDSTRTRCSFEVAAYDQGARVTYLGPGGSQIGHKESIKDTARVLGRMYDGIQYRGYGQRVVETLAEFAGVPVWNGLTDEFHPTQLLADLLTMREHLPNKSLNKMTLAYLGDTRNNMGNSLLEAAALVGMDLRLVAPKACWPEEAFVISCQALAQKTGGKITLTEDIAEGVNGADFLYTDVWVSMGEPKEVWQERINLLKPYQVNMRVLTLTGNPQVKFLHCLPAFHDDQTTIGKQMAEQYDLPGGMEVTEEVFESAHSIVFDQAENRLHTIKAVMVATMSKI

SEQ ID NO: 7717 - protein, 238 aa, Candida albicans SC5314
MDLKLPPTNPTNPQQAKTFMKSIEEDEKNKAEDLDIIKKEDIDEPKQEDTTDGNGGGGIGIVPTLQNIVATVNLDCRLDLKTIALHARNAEYNPKRFAAVIMRIRDPKTTALIFASGKMVVTGAKSEDDSKLASRKYARIIQKLGFNAKFCDFKIQNIVGSTDVKFAIRLEGLAFAHGTFSSYEPELFPGLIYRMVKPKIVLLIFVSGKIVLTGAKKREEIYDAFESIYPVLNEFRKN

SEQ ID NO: 7718 - protein, 261 aa, Zea mays
MSAQAGPGTYSPAAAAGDRRRERKEELRRHLAEDADWPRADGRSFHDCRPAFMQTGPTTAASGSAYAEFGKTKVIVSVFGPRESKKAMMYSDVGRLNCNVSYTTFATPVRGQGADNKEYSSMLHKALEGAVMLHTFPKTTVDVFALVLESGGSDLPIIISCASLALADAGIMMYDLVTSVSVSCFRKNIIIDPTSDEEAWQDGSLVVAFMPARKEITQLTLTGEWSDGRITNAVELCMDACSKLGDILRDRLKDTATLTCE

SEQ ID NO: 7719 - protein, 336 aa, Dichelobacter nodosus VCS1703A
MKSLGEFIIEKQAEYPQAKGSLSGILSAVRRAAKIINRDINRAGVVSDLVLGSMGRENVQGETQMKLDVFAHEAMKAAFYSRDDIAGFASEEEEEFTAFDTERGHNAKYIILMDPLDGSSNIDVNVSVGSIFSIYHRVTPIGTPVTLEDFLQPGHKQIAAGYIIYGSSTMLVFTTGNGVNGFTYDPSLGTFLLSHENIKIPKDGAIYSINEGGYLKFPQGIKKYIKYCQEDAPEEHRPYKSRYIGSLVADFHRNMLKGGVYMYPQASNYPNGKLRLSYECNPMAFIAEQAGGVATTGHERILDIQPQALHQRTPFIVGSEHMVNKIKDFIAQYPDN

SEQ ID NO: 7720 - protein, 286 aa, Frankia sp. EAN1pec
MTGPRTVLITGATDGHGRALAHRLAAEGTTLILHGRDPDKLARTADDIQTTHRVSRPRTMQADLAELAQVRRLASDVQAVADRLDVLVSNAGIGAGHPDGHTRRTSVDGYELRFAVNYLAGFLLTLDLLPLLRRSAPARIVNVASIGQHPLDLGDLMIERGYSGTRAYGQSKLAQIMSGFELAQRLPGAEVAVNSLHPATYMPTKIVLAEIGHHIDSIDDGVSATHRLVTDAAFAGVTGRFFDRTSDTRPNIQAYDEQARAELWRRSLELVDRSGVHGRGVRGVMI

SEQ ID NO: 7721 - protein, 329 aa, Zea mays
MELFARAKVVRLRSHHDKFLYADEDEVRVTQDRDGSSANARWTVEAAPHSAGAVRLRSRYGRYLTASGEPFLLGMTGRKVRQTAPAAPRPANASVDWEPLRDGFQARLRTKAGHFLRANGGLPPWRNSVTHDVPHRTATQDWVLWDVEVVQLLTPAPRPERTGSAPVAKLPDSPPAPDLGKPPQAHGPHHRPSKSYATPPPTLEPVAPPPPPPPPSRLNKLESSLSFSAPLHKVEGRAIHYHIADDLGNVDEGTVGHSFTFNGSNLEELAHKLQEETGLEDIIICTRSPINGKLTPLRLQLPPNNAAMHIVLVQESSKVAKSFPWPYGS

SEQ ID NO: 7722 - protein, 392 aa, Clostridium perfringens ATCC 13124
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNREELQKIVDVLKDRDVIIISDEIYAELSYDEDHVSIASFPEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 7723 - protein, 216 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKEPFVNIPDDKIREALKVVLDPRNQPLLIHCKRGKHRTGCVVGCLRKLQEWCLSSVLDEYHRFAAAKARITDQRFMEMFDVSSLKHLTPSHC

SEQ ID NO: 7724 - protein, 429 aa, Bradyrhizobium sp. ORS278
MGVEVTKLPTGLTVVTDTMPHLETAALGVWAGVGGRDEKPDEHGISHLLEHMAFKGTTTRSAREIVEAIEAVGGDLNAGTSTETTAYYARVLKADVPLALDVLSDILANPSFVPEELEREKNVIVQEIGAAQDTPDDVVFEHLNELCFPDQPMGRSLLGTAKTLEAFDRDKLHGYLSTHYRGPDMVVAAAGAVDHHRVVEDVSRRFASFNGGEGPKPQPAAFGKGGSRVVHRDLEQAHLTLALEGVPQADPSLFSLQVFTNILGGGMSSRLFQEVRENRGLCYSVYTFHAPYSDTGFFGLYTGTDPADAPEMMEVVVDIIGNAVETLSEAEVARAKAQMKAGLLMALESCSARAEQLARHILAYGRPQTLQEMVAKIEAVSVESTRDAARALLARSKPAVVALGSGRGLDTAVTFAEGLAGPKSKAQLH

SEQ ID NO: 7725 - protein, 178 aa, Brassica juncea
VMKKLQQEIRVTLGDNKEKITEQDLEKVHYLKLVIQETFRLHPPAPLLLPRETMSDIKIQGYNIPKNTMIEINTYAIGRDPNCWENPNDFVPERFIDSPVEYKGQHYELLPFGAGRRICPGMATGITIVELGLLNVLYFFDWSLPDGMTIEDIDMEEAGAFVIAKKVPLELIPTPHKW

SEQ ID NO: 7726 - protein, 298 aa, Neisseria meningitidis Z2491
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 7727 - protein, 500 aa, Vibrio fischeri ES114
MTISDNNTIVIFGASGDLTYRKLIPALYHLYASNQLPSTFSILGVSRTQYDDESYREKMKQSLRELEKTEPEILDAFCHHLHYQALNTSDVDEYSKLVCKLDQLADKYQLEQQNTLFYLATPPSLYGVIPSCLAAHGLNDESNGWKRLIIEKPFGYDLASALELGKQIHQYFEEHQIYRIDHYLGKETVQNLLVLRFSNVMFEPLWNRNFIDYVEITGSEFLGVEERGGYYDGSGAMRDMFQNHLLQVLAMVGMESPSAINADSMRDEIAKVLQSLQPLTEQDLRNNLVLGQYTESEVRGQFLPSYRDEQGVADDSRTETYVGLKMFINNWRWNGVPFYVRTGKRLPTRVTEVVVHFKKTPHPAFAENAPENKLVIRIQPDEGIQMRFGLKEPGSGFNVKDVSMDFHYQSLAETQMLTAYERLLLDALNGDATLFARSDAVNACWKFVQPILDFKQDPQALFGYACGTWGPKEADQLLERDNRKWRFPCKNLTDTDYCEL

SEQ ID NO: 7728 - protein, 163 aa, Oryza sativa
  misc_feature (40)..(40): Xaa can be any naturally occurring amino acid
  misc_feature (48)..(48): Xaa can be any naturally occurring amino acid
LEPEGMPSGLLETINVDKKMLVDRVRQALYASKICSYAQXLARIWKGXCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 7729 - protein, 482 aa, Vibrio fischeri ES114
MKGDIGVIGLAVMGQNLILNMNDHGYKVVAHNRTAEKVDEFLQGPAKGTNIVGAYSLQELVDKLESPRKIMLMVRAGDVVDSFIDKLVPLLDKGDIIIDGGNTNFPDTNRRVAALKEKGIHFIGSGVSGGEEGARFGPSIMPGGSPEAWPFVKPIFQAISAKTENNEPCCDWVGNDGAGHFVKMVHNGIEYGDMQLITEAYQFMKDGLGMTHDEMQSVFIEWNKTELNSYLVEITSDILGYKDTDGEPLVEKILDTAGQKGTGKWTGINALDMGIPLTLITESVFARCLSSLKDQRVEAEELFGKKESIVEGDKQVWIEALRQALLASKIISYAQGFMLMREASNENGWDLNYGNVALMWRGGCIIRSAFLSNIRDAYDIDPELSFLGSDSYFKGILENSMSAWRKVAAKSMEVGIPMPSMTSALTFLDGYTTARLPANLLQAQRDYFGAHTYERVDKPKGEFFHTNWTGKGGDVSSTTYNS

SEQ ID NO: 7730 - protein, 371 aa, Trifolium pratense
MADGPQYPSVAQKLGGHSYLVSRLSPNLNSRSYSTSGTFAYGGLQNSGLAIGSPLSSIMVPAPSEKGAAGFLVDFLMGGVSAAVSKTAAAPIERVKLLIQNQDEMLKSGRLSEPYKGIGDCFARTMKDEGVIALWRGNTANVIRYFPTQALNFAFKDYFKRLFNFKKDRDGYWKWFAGNLASGGAAGASSLLFVYSLDYARTRLANDAKAAKKGGERQFNGMVDVYRKTLQSDGIAGLYRGFNISCVGIIVYRGLYFGMYDSLKPVVLVGGMQDSFFASFLLGWAITIGAGLASYPIDTVRRRMMMTSGEAVKYKSSLHAFQTIVAKEGTKSLFKGAGANILRAVAGAGVLAGYDKLQLVLFGKKYGSGGG

SEQ ID NO: 7731 - protein, 85 aa, Glycine max
  misc_feature (41)..(41): Xaa can be any naturally occurring amino acid
  misc_feature (46)..(46): Xaa can be any naturally occurring amino acid
MIWNGPMGVFEFNKFAVDTEAVAKNLANLSEKGVTTIIGRXDSVTXIEKVEVTNIISHISTNNNTNLKLLKSKELPRVLTLNKAI

SEQ ID NO: 7732 - protein, 518 aa, Photobacterium profundum SS9
MRDKLMSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 7733 - protein, 263 aa, Bordetella petrii
MNASERPLEGRHALVTGGARGIGLSCAQALLQRGAAVTLLGRDRAALDAAAAALGRLGAVRAVAADVADQASVQAAFEQAAQDGGAVDILVNNAGQAASQRFERTDAALWQAMLAVNLTGTYYCIQAALPGMLAAGWGRIVNVASTAGLIGYAYVSAYCAAKHGVVGLTRALALEVARKGVTVNAVCPGFTETDIVRGAVDNIMQKTGRTASEARAELAARNPQGRLVQPEEVAEAVAWLALPASASINGQAIAVDGGEVMPG

SEQ ID NO: 7734 - protein, 575 aa, Schizosaccharomyces pombe 972h-
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 7735 - protein, 472 aa, Arabidopsis thaliana
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 7736 - protein, 338 aa, Photobacterium profundum SS9
MNQNVNNAITMTVLGAGSYGTSLAISLARYGANVILWGHDAEHIAQLEIDRANEAFLPGVAFPESLILSADLEMAVQASRDLLVVVPSHVFGLVLSDVKPFLREDSRICWATKGLEPETGRLLKEVAVDAVGAEVPLAVLSGPTFAKELAAGMPTAIAVSSPDDAFVEDLQEKIHCSKTFRVYSNSDFIGMQLGGAVKNVIAIGAGMSDGIGFGANARTALITRGLAEMCRLGAALGAQKETFMGMAGLGDLVLTCTDNQSRNRRFGLALGQGKSVDQAQIDIGQVVEGYRNTKEVWALAQRYGVEMPISEQIYQVLYQGKDAREAAKDLLARDKKYE

SEQ ID NO: 7737 - protein, 558 aa, Rickettsiella grylli
MSQHAIYTLQAVNKVVTPQKEILKNIWLSFYAGAKIGVLGLNGAGKSSLLRILAGIDTDFTGEAQAQAGIRIGYLEQEPQLDPLKDVRGNVEEAILETKKLLERFHEISMKFAEPLSESVMNQLFEEQGALQTQLDASGGWELERKLSIAADALRLPRWDARITQLSGGERRRVALCRLLLSNPDILLLDEPTNHLDAQSVAWLERFLTDYSGTVIAVTHDRYFLDHVAGWILELDRGQGIPYEGNYSAWLAQKQQRLAQEGKQRAAHEKSLKAELDWVRTHPKGRQAKSKSRLARFEELSSQEFQKRAETQELYIPPGPRLGDSVLEFDQLTFGYNGKRLIDNFSFIVPKGAIVGIIGPNGVGKSTLFRLIMQQERPDSGCIRQGASVKLAYIDQHRDALNPSHTVWQEISEGLDIMTIHQFQMPSRSYVGRFNFKGSCQQKLIKNLSGGERNRVHLAKLLRTGGNVLLLDEPTNDLDVETLRALEEALLNFPGCVLVISHDRWFLDRIATHILAFQDNQKIDCFTGHFTAYENDRLKRLHHDEQPKKKIKYKKLVN

SEQ ID NO: 7738 - protein, 518 aa, Volvariella volvacea
MQSLLNTLTAMVTVVGWGANFAAAALSSHTLTLTNGFASPDGHSREVVLVNGGLFQAVIAGNKGDDFEIEVDNQLTVEILRKSTSIHWHGLFQRGSAWADGPAFVTQCPIAPGNTFTYEFTPTDEVGTFWYHSHLDAQYCDGLRGPFVIYDPNDPHLALYDVDDEDTIITLADWYHTAAELLTGVVIPDSALINGLGRTSTTTTSPLAVINVVQGTKYRMRLISISCDPNNYIFSIEDHEMTVIEADGISVDPVTVTSLQIFVGQRYSFILHANQPVDNYWIRANPNLGPTGFSGGINSAILRYQGAPVADPTGPGLQDALNRLAETDLHPIVNPGAPDPVDIDLVINIGFSAGLFNIDGTSYVSPDVPSLLQILNGVPVSSLLPSGSYIELPPNKVVQLSFPVIAGQGSAIGAPHPIHLHGHAFDVIRSAGSSTYNLVDPVRRDVVSIGTPGDNVTIRFVTDNAGPWYLHCHIEWHLRAGLGVIFAEDAAGSLLQPAPPTAWGDLCDIYDLLPPEDQ

SEQ ID NO: 7739 - protein, 273 aa, Photobacterium profundum SS9
MRECQQKEIWQAIKLEARAQSEQEPMLASFYHATIIKHDNLAAALSYILANKLATPSMPAMAVREVVEEAFAADCMITESAACDIRAVVERDPAVEMYSIPLLYLKGYHALQGYRVANWLWKQKRVALAVYLQNQISVTCQVDVHPAAVIGQGIMFDHATGIVIGETAVIENDVSILQDVTLGGTGKVGGDRHPKIREGVMIGAGAKVLGNIEVGVGAKIGSCSVVLNPVPPHTTVAGVPAKVVGRPSSDMPSMDMDQQFNGSTQTFIAGDGI

SEQ ID NO: 7740 - protein, 530 aa, Streptomyces coelicolor A3(2)
MSTVEERPAGGSLPVTMDARVAELAELRERVLAGPSQRATEAQKGKGKLTVRERLELLFDKGTFAETEAFRRHRATGFGLEDRKPHSDGVVTGWGQIDGRTVFAYAHDFRIFGGALGEAHAQKIHKLMDLAETAGAPVVGLCDGAGARIQEGVTALAGYGGIFQRNVRNSGVIPQISVIMGPCAGGAAYSPALTDFVFMVRGTSQMFITGPDVVQAVTGEQITQEGLGGADVHAGTSGVAHFAYDDEEQCLEDVRHLLSYLPANNRELPPAEVPDDPADRRTEALLTLVPADPNRAYDMRRVIEEIADHGEYFEVHERWAPNIICALTRLGGQVVGIVANQPQSMAGVLDIESSEKAARFVQTCDSFNIPLVSLVDVPGFLPGVDQEHNGVIRHGAKLLYAYCNATVPRISLVLRKAYGGAYIVMDSRSIGADIALAWPTNEIAVMGAEGAANVVFRREIAASDDPEAVRKARIDEYRDELMHPYYAAERGLVDDVVDPAETRSVLIGALRMLRDKHAPLPTRKHGNQPQ

SEQ ID NO: 7741 - protein, 184 aa, Oryza sativa
  misc_feature (172)..(172): Xaa can be any naturally occurring amino acid
MTTVGEGKWSESAVVSPFRRDLLKGKVALVTGGATGIGFSITRALALHGARVAITGRRANKLEEAINQLKADGVPADALLGVQGDVREFASVSKAVQDVVNRFGRLDILVNNAAGNFLCPAKDLSPNGFKTVIDIDLVGTFNSSRAAYEHLKAHKSGVIINISATLHYGATXWQLHAPSGKEGI

SEQ ID NO: 7742 - protein, 425 aa, Gloeobacter violaceus PCC 7421
MLITSIEAHEILDSRGNPTVEAQVALENGTTGSAIVPSGASTGEKEAVELRDSDPKRYGGKGVLSAVANVNDSIAPEIIGMEVTDQRSIDRKMIEIDGTANKATLGANAILAVSMAVARTAALSLGLPLYRYLGGTNASLLPVPCMNVINGGKHADNTVDFQEFMIAPHNAPNFAEALRMGAETFHALKSILRGKGYSTGVGDEGGFAPDLKSNEEAVEVILLAIEKAGYRPGEDISICLDPATSEMWKDGKYLFFKSDQSTKTSEEMVDLWASWAGQYPIVSLEDGMGENDWEGWKMLTDRIGATVELVGDDLFCTNAKILAEGIEKGVANSILIKLNQIGSVSETLDTIELAVKHNYKCFVSHRSGETEDTTIADLTVATAAGQIKTGSGCRSERVAKFNQLLRIERQLGEAARFAGKSAFAR

SEQ ID NO: 7743 - protein, 414 aa, Shewanella sp. MR-4
MSDIRQQALDYHEFPVPGKTAVCLTKPAETSHDLALAYSPGVAEPVREIAANPDNAYRYTNKGNTVAVITNGTAILGLGNLGPLASKPVMEGKALLFKHFANIDSTDIEVTHNTAEEFINTVAAIAGTFGGINLEDIKAPECFVIERELIERCNVPVFHDDQHGTAIVTAAGMINALEIQGKLISDATFVCMGAGAAAIACMTMLVKCGANRANIYMLDTKGVIHTGRTDLNEYKALFANDTDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKVAAVHAIAGLAKEEVPASVLKAYPKVNSLSFGPEYVLPKPMDPRLLPRVARAVAQAAIDSGVAAITTLPQYAD

SEQ ID NO: 7744 - protein, 252 aa, Nitrosomonas europaea ATCC 19718
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 7745 - protein, 188 aa, Triticum aestivum
  misc_feature (168)..(168): Xaa can be any naturally occurring amino acid
MASSTSTLEIEARDVVKIMLQFCKENSLHQTFQTLQNECQVAQLKLPRKKLEDLYEQIVLEMAELRELDTARAILRQTQVMGVMKQEEPERYLRLEHLLVRTYFDPNEAYQESTKEKRRAQIAQAIASEVSVVPPARLMALITQALKWQQHQGLLPPGTQFDLSRGPXALKQDEKEAYPTTLSLQIRS

SEQ ID NO: 7746 - protein, 505 aa, Arabidopsis thaliana
  misc_feature (111)..(111): Xaa can be any naturally occurring amino acid
MEDETQTLILITILILTLITLTFLIKKLKPKPNLPPSPPFSLPIIGHLRLLKPPLHRLFLTISKSLNDSPIFSLRLGNKLVFVVSSHSIVEECFTKNDVVLANRPKSIASXHISYNYASMVSAPYSEHWRNLRRIGAVEIFSNHRLNSFYTIRRDEIRRLIARLSRSPNASLEFAKVEMNSMLSNLAFNNIIRMVTGKCYYGDGAEDDPEAKRVRQLIAEAMSCFGAGHAADHLPMLRWITDFERRVKKIAARLDEFFQRLVDEKRVAKEKKENTMIDHLLSLQVSQPEYYTDHTIKGTMLSLILAGTDTSAVTLEWALSSLLNNPEVLKKVRDEIDNQIGLDRLLEESDIPNLPYLQNIVSETLRLYPAGPLLVPHISSEDCKVGGYDMPCGTMLLVNVWAIHRDPRLWDDPASFKPERFEKEGETHKLLTFGLGRRACPGSGLARRLVSLSLGSLIQCFEWERIGEEEVDMTEGGGLTMPRAIPLVAMCRARAFVGKIPHESG

SEQ ID NO: 7747 - protein, 330 aa, Arabidopsis thaliana
MHIGQAAAKEGESQMIVMMGNNLSLTSIILNGDPSIEHKGKLPCLDEQVKISQFYHCEGLLLCILKDDSRFVVCNPYLEQTRWIEPRYSHRPHGWDRFSYALGYVNTDSCCYYKLLGLIDYYYNAHEKQFFWYGIYDFDSDLWTTLDVTPHWRIAFCNRGVSLKGSTYWCAAERNVDVDEVLADRLICFDFTSERFGPLLPLPFSGGHIDCMTLSCVREEKLAVLLQHDESNPYELDLWITTKIETGEEKKVAFGFDGRNRERVIVIGEAGYLRGLDLVGDFGDQECRTDLCSYVPSLVQIKQPEGGESKQQSDLEKCRYDENMLRLVSL

SEQ ID NO: 7748 - protein, 223 aa, uncultured bacterium
MLDMIAPYVKAGVTTDELDKICHNFMVNVQGTIPAPLNYHGFPKSICTSVNNVVCHGIPGDKKLKKGDIVNIDITVIKDGYHGDTSKMFIIGKSSIKAQRICRIAQECLYIGIKKVKPGIHLGEIGKAIGAHAIKNNCAIVRDYCGHRIGRLFHTEPQVVHYDDGGIKNSQILEAGMSFTIEPMVNLGKWEVTTSQKDGWTVTTKDRSLSAQWEHTILVTKDG

SEQ ID NO: 7749 - protein, 198 aa, Helicobacter pylori
MVVTKLAPDFKAPAVLGNNEVDEHFELSKNLGKNGVILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 7750 - protein, 262 aa, Photobacterium profundum SS9
MIWRKTMRHPVVMGNWKLNGSKEMVVNLLNGLNAELEGVTGVDVAVAPPALFIDLAEHTLTEAGSAIILGAQNSDLNNSGAFTGDMSPAMLKEFGASHIIIGHSERREYHNESDEFVAKKFAFLKENGLTPVLCIGESDAQNEAGETMAVCARQLDAVINTQGVEALEGAIIAYEPIWAIGTGKAATAEDAQRIHAQIRAHIAEKSEEVAKNLVIQYGGSVKPENAAAYFAQPDIDGALVGGAALDAKSFAAIAKAAAEAKA

SEQ ID NO: 7751 - protein, 255 aa, Oryza sativa Japonica Group
MSSSSTSGSAEPAAAVRVLGSWTSPFVMRVVVALKLKGVEEYELLQETRGKKSELLLRSNPVHKKIPVLLHHGKPLAESLIIVEYIDEVWPASDGAPAILPRDPYCRAVERFWAQYIDDKPDDFALILDNLCAVSSGDSRVERNRGRRGTVVEMSTALKHLEEAFVKCSQGKKYFGGDKIGYLDIALGSFLGWIKAVEKFAGVELLDEAKVPNLAAWADRFCAHPAVVDAMPDADKLVEFAVKHAASMKALDAPK

SEQ ID NO: 7752 - protein, 700 aa, Sulfolobus tokodaii str. 7
MISQQFFFVRVYEGRVKQDVALVSSNIMQSYGLLPGDVILLLGNRQIPFYVQESSDNKIDGIVIGENKLKLLGIRSGERVPVRKVSVSSIKEITLAPSEQKNYDLRKLNLELRGRLVTRGITLESKEGTFAVISYSPQVEVGYISSETRINIAPESIRIAQKNIPYVTLDDVGGLSKQIRELLEIVELALTKVEVARMLGLRPPKGVLLYGPPGTGKTLIAKAIANTIMANFFYISGPEIGSKYYGESEKRLRDIFEQAEKNAPSIIFVDEIDAIAPNRDTTSSETDRRIVAQLLTLMDGLTSGSGVVVIGATNRPNALDPALRRPGRFDREIEIPVPDKQGRLEILKIHTRRVPLSQEVDLEKIAERTHGFVGADLEALVREAVLSAYHRCNGNLECMQVTMSDFDEALKNVEPSALREFRIEIPNTTWEDIVGLEDIKLELKEVVEWPLKDPGLYEEMKAEIPSGILLYGPPGTGKTMLARAVAHESGANFIAINGPELMSMWVGETERAIREVFKKARQSSPTIIFFDEIDAIAVARGADPNKVTDRIVSQLLTEMDGISKRREKVVIIAATNRPDIIDPALLRPGRLEKLIYVPPPDYQTRIALFSRLINNRPHEEIDIERLAKLTENYTPAEIKGIVNKAVLLAIRRAKLKNEKPELTMSDFEEALKTVKPIVTQTMLDYYVSFYQRVRRASGYA

SEQ ID NO: 7753 - protein, 249 aa, Nitrosomonas europaea ATCC 19718
MKKLVLLRHGESIWNQENRFTGWTDVDLTPKGLKEAEEAGRLLRENGFSFDIAYTSLLKRAIRTLWIALDEMDQMWTPIELNWRLNERHYGALQGLNKAETAKQYGDEQVLVWRRSYDIRPPSITINDERYPGFDLRYRNMSSGDIPLAESLKDTVARFLPYWNQSIAPQIKAEKKVIIAAHGNSLRALIKHLDNISDQDILNCNIPTGIPLVYELDDDLKPLNSYYLGDAGQIGEAISAVANQGKSGA

SEQ ID NO: 7754 - protein, 335 aa, Dichelobacter nodosus VCS1703A
MPDNSAWRFCVAPMMDWTTPACRQIHRILLPKARLYSEMITTGAILFGDAQRYLTHQNDEPCALQLGGSNPDELARATAIAQSYHYAEMNLNVGCPSDRVQNNQIGACLMKSPRLVAQCLTAMQKESDVPVSIKHRLGIDEQDEHLVFDFVDQISQESPCRIFIVHARKAWLSGLSPKENRTAPPLHYEIVYKIKEQFPELTIIINGGIDFIAACQNHLHYVDGVMLGRAAYQQPQLLLAARALFGDAVMSETEIVPQITQLLMNALDRGERLHDYTRHLLGLFHGKNGAKRFRQILSECAPRAGSDINVWQQALAAMAPQSAIIQPPNADEDNL

SEQ ID NO: 7755 - protein, 654 aa, Thiomicrospira crunogena XCL-2
MLNIQSVSLMAGLKPLLQNASLTLHPGQKIGLIGQNGAGKSTLLKAILKEVSLEAGNIAMPDTWQVGYVEQEQTHLSFSAMEYVTTGDTLYANARARIDQAELNNDHDALVASYDELDRISGYEVPQKAQQLLYGLGFSEAEFNKPVESFSGGWQVRLKLARALMQRADLLLLDEPTNHLDIEAVSWLIQWLKGFSGAVIVISHDRHFLDEVVQGIAHLDQGKIQYYSGNFAAFERQRNEQLMQQQSLHDKQKQQMQHLKSFIERFKAKASKAKQAQSRVKALERIESVAAVQASNPFQFHFTEPDHLPDPMLFSDELSFGYDDHLILKDVDLTLRAGDRIGLVGVNGSGKSTLLKLLIKENTPKSGKLVHSKGLKIGYFAQHQLESLNLDQTPLAHMLSLTKEDMERVTDQEARDFLGQFGFSHDKTLNPIKHFSGGEKARLSLALMVYQKPNLIILDEPTNHLDMETRDALEMALQEFSGALILVTHDQHLLTSIVDQFWWVHDQRVERYHGDLEAYLQQRLRLLKEKQAEIKAEKSTRPGHISEANNGNSANKKAQRQENAHYRKQLKEATRDQSKRLTKVEKQLSDAQKQLTKLHAEMEDASLYEASRSEELKTILKQEAQLKVSVESLEEEWLLLEAEIEEITNSFLET

SEQ ID NO: 7756 - protein, 507 aa, Oryza sativa
  misc_feature (153)..(153): Xaa can be any naturally occurring amino acid
  misc_feature (168)..(168): Xaa can be any naturally occurring amino acid
  misc_feature (184)..(184): Xaa can be any naturally occurring amino acid
MYRAASGLGAIKRHGLDGQMLNVAIRCASTSVAQRSSGGFWTWLTGARSNALPPPDFTLPGVTIPPPLPDLVEPGKTKITTLANGVKIASETTPGPSCSVGVYVNCGSVHEAPETLGATQLLKKMAFTTTTNRSHLRVVREIEAVGGNVKASXNREMMSYSYAAPLKXTYMPEMVEVLIDCVRXPAFLDWEVKEQIMKLKAELAEASSNPETFLLEALHSTGYSGALATPLIASESSVSRLNTNVLEYFLAENYTAPRIVLAATGVDHDELVSIAEPLLSDMPGVTGPAKPKSTYVGGEYRRTADSSNTDVALAFEVPGGWLKEKEFVTVSVLQTLLGGGGTYSWGRHGKGLHSSLNHLANEFDQIRSIAAFKDVHSNTGIFGIHTSTDAAFVPKAIDLATRELTSLATPGKVDQTQLDRAKATAKSAILMNLESKASATEDMGRQILAFGERKPVEHLLKAVDGVTLKDITALAEKIISSPLTMASHGNVLNVPTYDSVSGKFRSK

SEQ ID NO: 7757 - protein, 496 aa, Trifolium pratense
MAKHEELPIPIYNNLEPVYGGGSSLEEAQLRFDILKSKFKEFFGHTPQLFARSPGRVNLIGEHIDYEGYSVLPMAIRQDTIIAIRKNESEKVLRIANVNDKYSICTYPADPLQELDLKNHKWGHYFICGYKGFYDYAKLKGVNVGEPVGLDVLVDGTVPTGSGLSSSAAFVCSSTIAIMAAFDVNFPKKEIAQVTCDCERHIGTQSGGMDQAISVMAKTGFAELIDFNPIRATDVQLPDGGTFVIGHSLAESQKAVTAATNYNNRVVECRLAAIVLAIKLGMKPAEAISKVKTLSDVEGLCVSFAGTKNSSDPVLAVKEYLKEEPYTAEEIEAVTGEKLTSFLNINASYLDVIKAAKQYKLHQRAAHVYSEAKRVYAFKDVVSSNLSDEEKLKKLGDLMNESHYSCSNLYECSCPELEELTKVSRDNGAFGARLTGAGWGGCAVALVKESIVPQFILNLKEHYYQPRIDKGVIKKDDLGLYVFASKPSSGSAIFKF

SEQ ID NO: 7758 - protein, 364 aa, Populus trichocarpa x Populus deltoides
MGSTGETQMTPTQVSDEEAHLFAMQLASASVLPMILKTAIELDLLEIMAKAGPGAFLSTSEIASHLPTKNPDAPVMLDRILRLLASYSILTCSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 7759 - protein, 423 aa, Yersinia pestis biovar Microtus str. 91001
MTLLALGINHKTAPVSLRERVTFSPESMDQALNSLLQQPLVQGGVVLSTCNRTELYLSVEQQENLHEQLTAWLCNYHKLSPDDVRQSLYWHHGNDAVRHLMRVASGLDSQVLGEPQILGQVKKAFAESQRGQSLSSELERLFQKSFSVAKRVRTETEIGASAVSVAFAACSLARQIFESLSELHVLLVGAGETIELVARHLREHQVKHMIIANRTRERAQSLASEVGAEVITLPEIDARLADADIIISSTASPLPIIGKGMVERALKTRRNQPMLFIDIAVPRDIEPEVGKLSNAYLYSVDDLQAIIQHNMAQRQAAAVQAESIVQQESMNFMTWLRAQGAVETIRDYRSQAEQVRSEMTAKALVAIEQGANVEQVINELAYKLTNRLIHAPTKSLQQAASDGDMERLQLLRDSLGWISISFL

SEQ ID NO: 7760 - protein, 486 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 7761 - protein, 183 aa, Triticum aestivum
  misc_feature (144)..(144): Xaa can be any naturally occurring amino acid
MAVSELEVDGVVFPPLARPPGSEHAHFLAGAGVRGMEIGGNFIKFTAIGVYLQADAAVSALAAKWAGKPAADLASDAAFFRDVVTGEFEKFTRVTMILPLTGAQYSDKVTENCVAYWKATGVYTDAEAAAVHKFKEAFGPHSFXPPGASILFNHSPGGASSRSPSSKELVRGRESRAGLGHST

SEQ ID NO: 7762 - protein, 481 aa, Vibrio fischeri ES114
MSNRLRRTKIVTTLGPATDRDNNLEKIIAAGANVVRMNFSHGSPEDHIERTRKVREIAAKLGTHVAILGDLQGPKIRVSTFKEGKIQLAIGDKFTLDSDLPKGEGNQDSVGLDYKELPQDVTTGDVLLLDDGRVQLRVTAVEGNKVHTEVTVAGPLSNNKGINKQGGGLSADALTEKDKADIITAAAMKVDYLAVSFPRNGEDMNYARRLARDAGLEAQLVAKVERAETVASEEALDDIILASDVVMVARGDLGVEIGDPELVGVQKQLIRRARSLNRTVITATQMMESMISSPMPTRAEVMDVANAVLDGTDAVMLSAETAAGDFPVETVTSMAGVCMGAEKVPTVNVSNHRLDRRFTTPEETIAMSTMYAANHMEGITAMITLTESGRTPLMMSRLSSGLPIFALSRNEGTLNRAALYRGVTPVFFDEKADSGLPSTYAAINTLKSKGLLSTGDQVIITQGDVMDIVGSTNCMRIITVE

SEQ ID NO: 7763 - protein, 397 aa, Symbiobacterium thermophilum IAM 14863
MRLSARARALTPSPTMAIDAMSKQMVAEGIDVVNFSVGEPDFDTPESIKAAGIAAIQQGETKYTPAAGTLELRKAICEKLERDNGLQYRPEEIVVSNGGKQSLYNAYQVLLDPGEEVIIQAPYWVSYPEIVRLAGGVPVVVETDESTGFRLTADMIREKLTNRTRVINLNSPSNPTGAVLSRRELEEIAALAVEHDLMIVTDEIYEKLLYDGAEHVSIASLGEEVKRRTITVNGLSKAYAMTGWRMGYTASERIYAKAMADLQSQSTSGPSSISQAAAVAALRGSQESVEQMRQEFDRRRRHMLERLNRLPGFSVKVAPAGAFYLFPNVSALFGETIAGRKITSSDDLAEVILEQAHVAVVPGTGFGAPHHIRFSYATSMERIDEGLDRIARLLARG

SEQ ID NO: 7764 - protein, 293 aa, Glycine max
MVLLHLPRFPLYLVTLSPSLTPRAYSKTTLLRPPKSTLTASEPVSVNPSPTELSLEKLFVPPETTVSLESSRVLNGSNILLSNYANDALVLQAEFVKSSVKTEDCPSDGLAEFALVGRSNVGKSSLLNSLVRRKKLALTSKKPGKTQCINHFRINNSWYLVDLPGYGYASAPHELRMDWEKFTKNYFLNRSTLVSVFLLIDASIPAKQIDLDYASWLGQNQIPMTLIFTKCDKRKKKKNGGKRPEENVNDFQDLIRGFFQSVPPWIMTSSVTNQGRDEILLHMAQLRNYWLKH

SEQ ID NO: 7765 - protein, 468 aa, Rickettsiella grylli
MAELEIKKTELLVLGSGPGGYSAAFRAADLDKKVILVERESTLGGVCLNIGCIPSKALLHAAKVIDDAKAMAKWGLDFGKPTIDLKKLRDFKSNVVKKLTQGLSLLAKQRNVEWIKGEGKFIGKNKLIVGKQKIVFDAAIIAAGSQPIRLPFLPDDPRIMDSTGALELKEIPDKLLILGGGIIGMEMATVYRALGSEITVVETGDMIINGPDKEIVTPLYKRLQKEYTFLLKTKVTQVDAKKDGLWVTFEGEGISKPQRFDQILSAVGRKPNGKNIGAEALGLSITEQGFIPVDKQLRTNIPHIYAIGDIVGHPMLAHKASAEGRVAAEVIAGKKHFFEPQCIPAVAYTDPEIAWVGLTVNAAKEKNVAYEKAVFPWLASGRSLGQGRDEGLTQLLFDPKTHRILGGGIVGPNAGELIAEITLAIEMGCTAEDIALTIHPHPTLSETVMLASEIFEGTITDLYMPKKK

SEQ ID NO: 7766 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 7767 - protein, 539 aa, Burkholderia sp. 383
MHDKILILDFGSQVTQLIARRVREAHVYCEIHPNDVSDDFVREFAPKAVILSGSHASTYEDHQLRAPQAVWDLGVPVLGICYGMQTMAVQLGGKVEWSDHREFGYAEMRAHGHTRLLDGIEDFKTDEGHGMLKVWMSHGDKVAELPPGFALMASTPSCPIAGMADEARGYYAVQFHPEVTHTLKGRQIIERFVLQIAGAKPDWIMKNHIEEAVAKIREQVGDEEVILGLSGGVDSSVAAALIHRAIGDQLTCVFVDHGLLRLNEGKMVLDMFEGRLHAKVVHVDASEQFLGHLAGVTDPEAKRKIIGREFVEVFQAEAQKLSKAKWLAQGTIYPDVVESGGTKTKKATTIKSHHNVGGLPETLGLKLLEPLRDLFKDEVRELGVALGLPPEMVYRHPFPGPGLGVRILGEVKREFADLLRRADAIFIEELRNTTATAHDAAAGLCGEADVGKSWYDLTSQAFAVFLPVKSVGVMGDGRTYDYVTSLRAVQTTDFMTAHWAHLPYALLGRASNRIINEVRGINRVVYDISGKPPATIEWE

SEQ ID NO: 7768 - protein, 246 aa, Triticum aestivum
  misc_feature (142)..(142): Xaa can be any naturally occurring amino acid
  misc_feature (180)..(180): Xaa can be any naturally occurring amino acid
  misc_feature (187)..(187): Xaa can be any naturally occurring amino acid
MSAYCGKDKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNVETTTQGFDDLGKRCAKYYEAGARFAXWRAVLKIGAPEPSQLSIDQNAQGLAPLCIICQENGLVXPIVEPKXLLDGPHEIDGGAYRPENVPGWPAKKPSHDQYVPPRGPPSWNPKRAPPGFPTPRRGPREG

SEQ ID NO: 7769 - protein, 397 aa, Rickettsiella grylli
MISALMPIYPHRLPVAFEKGSGIWLTDTQGACYLDALSGIAVCGLGHAHPAITETICNQATKLIHTSNTYHIPEQERLASALSRVSGMDQVFFANSGAESNEAAIKMTRLYARQKGIEQPIIIAMNNAFHGRTMATLSVSGSERLQIGFEPLLTRFIHIPFNDETALKNTIKKYKKNIIAIMLEPIQGDGGIKIATPRFLRAIRDYCDHYDFLMILDEIQTGLCRTGPWFAYQAYNIFPDILTIAKTLGNGFPISAYCSRGKANNLFPSGKHGSTFAGSPLACAVALTVIKILEKENISAHVTEIGDYLIRKLNDCLGQHPHVVAIKGQGLMIGVELDTECHHIPKIGLKHRLLFNIVSNHTIRILPPLILQKKEADEICHRLMKSIDEFYNLPSRL

SEQ ID NO: 7770 - protein, 357 aa, Schizosaccharomyces pombe 972h-
MDAPLVNESVEFQESQESLSLLEASKQLDLKKIQNLVDQGAVTSAIDIESGKNALHFIASYAEKETEVQAIEVTKWILSNGGVWNGIDRANETPGCIARRRNLLRLYETIVDAGVRSELLLSLLERKELTNEQLDTNEKYLQSALSYTQPTEDSSSLLDSDANAVMMSWERKIMHRSAEIIAPTKGRRVLNVGFGLGIIDTFLQEKEPSLHVIIEPHPDVLKHMRKNGWMDRENVIVYETTWENAINDIASKYVFDGIYYDAFAESYEDLRNFFDSVVGLLDPETDSKFSFFNGLGADNQTFYDVYKKLVPIDLVSFGLQCTYESMPVSSKDEEWKGAKRRYWDVSKYFLPIVTFDF

SEQ ID NO: 7771 - protein, 200 aa, Thiomicrospira crunogena XCL-2
MHSTPIQDALVPMVIEQTSRGERSFDIYSRLLKERVIFLVGQVEDHMANLIVAQLLFLESENPDKDIHLYINSPGGSVTAGMAIYDTMRFIKPDVSTMCIGQAASMGSFLLSAGAEGKRYALPNSRVMIHQPLGGFQGQASDIEIHAKEIIQIKQKLNKALADHTGQPIEVIENDTDRDNFMSADEACDYGLVDKVLTRR

SEQ ID NO: 7772 - protein, 213 aa, Oryza sativa Japonica Group
MLLLRAARASPAMAAVVRCKPTRLTPIAGLSSSSGGGRRKKAGRRGEAKPPPPPPPQLRGGETKKKKKPDARTAAEAAQGLQRHEVERRKKPPPPPPPPKQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACRFASPVLPRVSLG

SEQ ID NO: 7773 - protein, 180 aa, Oryza sativa Japonica Group
MLLLRAARASPAMAAVVRCKPTRLTPIAGLSSSSGGGRRKKAGRRGEAKPPPPPPPQLRGGETKKKKKPDARTAAEAAQGLQRHEVERRKKPPPPPPPPKQEKAKRVVRWKCAAGCGACCKLDKGPDFPSPEEIFAEHPEDLKLYKSMIGADGWCINYDKSTRTCNIYEGSHKLNRTNPV

SEQ ID NO: 7774 - protein, 486 aa, Streptococcus pyogenes SSI-1
MKFTIITNYDTLSRKSFTIEGDNMTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 7775 - protein, 371 aa, Oryza sativa
  misc_feature (353)..(353): Xaa can be any naturally occurring amino acid
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPKIXALTFVNSELDDGPSDPNK

SEQ ID NO: 7776 - protein, 370 aa, Zea mays
SVRIAATGAVRRPRRREKSIEPYHLEEGEVDTFGWIERLFTGHRTWPDQVAQYSLMGYVARGRSHSWLMKAVACLGCGDLVDQLWTMKPRMGASSREITGLVHAHVAGAWMEGHIAGADSFRAFNDYRGQWTLGNCREIGVGVSSMVVLMSSVSRPFDESVLVWHLATDFCFHLLQVQGDPSRATATATATARRCIEMSNYMAYLLFVKPEMLMPGARRSLFRDTCGELVGLLGEDRPGAPRARGKRGLAHKVVQLLKRDDGGGVLGSAGVGVVRRAWWVAEDFMDSHRGSEEKMWAVIQGVWVEMLCFSASRCKGYLHAKGLGTGGEYLSYVWLLLLYMGMETLAEKMQRTELYEGPTAAASSISGHNV

SEQ ID NO: 7777 - protein, 177 aa, Dichelobacter nodosus VCS1703A
MADFNQILDAGDVDGGVINVVVEIPAGSNHKIEWQRQLGVMMLDRVEPMIFAKPTNYGFIPQTLDEDGDELDALIITDNPLPTGIYLQARIIGVMNFIDDGEVDDKIVVVPADDRHRGDGIQTLADLPAQLVKQIEFHFNHYKALKKPNSTKVDHWGDVREAKHIIKSAQQRWKDQA

SEQ ID NO: 7778 - protein, 163 aa, Oryza sativa
  misc_feature (29)..(29): Xaa can be any naturally occurring amino acid
  misc_feature (48)..(48): Xaa can be any naturally occurring amino acid
  misc_feature (66)..(66): Xaa can be any naturally occurring amino acid
  misc_feature (78)..(78): Xaa can be any naturally occurring amino acid
HALAFPSLDDLHHSLSYHELNPPIRYGSXPVHHYMAWPLCHYFIYTGXKCYLTSNQLSCYCRDLPXIRAMQRGVRVIXLYMWPNSSKDNFNLLHGRTLTTQVYLLLCLLSIKEHAFDACFYPVIITLEDHLTPDLDDKSAKMALEGFGDFLYYPDLDHLKEFP

SEQ ID NO: 7779 - protein, 737 aa, Bradyrhizobium sp. ORS278
MAYKNFKLETDADGIALITWDIPGRSMNVLDETSTNELEALVKETTADAAIKGVVITSAKEAFCAGADLSMLEGMNRIYADVLKSKGEEAANQMLFDTSRRFSQINRAMETSGKPWVAAINGLALGGGFEITLSCHYRVAAENPKTRLGLPEIKVGLFPGAGGTQRVPRIVQPQDAMNLLLKGEALTLDKAKALKLVDAIVPAADLIKAAKDWIKGGGKAVQPWDEKGFKLPGGPVFSKNGMMMFPAGNAIYRRETYDNYPAARAIMSCVYEGLQLPIDAALRVESRYFTKILRSKEAAAMIRSLFLSMQELNKGARRPADVPASKIKKIAVIGAGFMGASVGYVSARGGLEVVLIDRDQESADKGRAHAQSVIEGLVKKGRAKPGEAEAIMGRITATADYAALKDCDLVIEAVFEDRKVKAETYAKAQAHLKDGAIFASNTSTLPITSLAEEFKDQGRFIGIHFFSPVEKMMLVEIIMGKATGDVALATALDYVRTIGKTPIVVNDSRGFFANRCVMRYIAEGNEMFLEGVPPALIENAAKMAGMPVGPLSLSDEVALDLGLKIMKATEHDLGPNAINQDHKKLMVELVEKQGRFGRKNGKGFYDYPEKGKGEKRLWPELAAMQPKHLDPDTLDVEELKQRFLVVQAVEAARTVEDHVITDVREADVGSILGFGFAPFTGGTLSYIDFMGTKTFVELCHKFTAKYGSRFAPPKLLEEMAAKGETFYGRFPPKKAAA

SEQ ID NO: 7780 - protein, 234 aa, Dichelobacter nodosus VCS1703A
MIMHARTQLLIGTQGLATLRAKTVMIAGLGGVGGFAAEAIARSGVGRLILVDYDCVTVSNLNRQLLALHSTLGRKKTAVMQARIHDISPDVAVIVKDVFIQSDNVAELCSETKVDYVLDCIDSLTSKAVLVKTAQEQNIPVISALGAGNCWDVTRVKTTYLDQTTVCPLARALRQKMKKLGGNLHYPVVFSDELRRQKTVSEEQERANGTISYLPALFGIMMAGYAVRQLLEPA

SEQ ID NO: 7781 - protein, 290 aa, Clostridium perfringens ATCC 13124
MNINSLKEEVDQSLKAYFNKDREYNKVLYDSMAYSINVGGKRIRPILMLLSYYIYKSDYKKILTPAMAIEMIHTYSLIHDDLPCMDNDDLRRGKPTNHKVFGEAIAVLAGDALLNEAMKILVDYSLEEGISALKATKIIADAAGSDGMIGGQIVDIINEDKEEISLKELDYMHLKKTGELIKASIMSGAVLAEASEGDIKKLEDFGYKLGLAFQIKDDILDVVGNAKDLGKNVHKDQESNKNNYITIFGLEECKKKCVNITEECIEILSSIEGNTEPLKVLTMKLLERKF

SEQ ID NO: 7782 - protein, 349 aa, Chlamydomonas reinhardtii
MATLIGPGRVGKAIAGMLGAELGAVVTRQSGAVDPHGQVGTEQSVCCVLAACGLRFTGMHTSREAVTSPFTATHPLRRAQHTGLAQGPIYVCTTNDALDWVLEQTPRNRRCDLVFFQNGWLAPWLAHNSLRLGPGSAAGAAAEGGAAAAAGREAEAARGDGGGAGGAEASGPGSAVEVTLVALYMAAGPDGTAKDGLRTVASGRWAQHVSRTLSRGAVRCRAVGGADMYGAVVEKLLWACVFWMMSAALGGMNVGDIVARHRGDVAALTAELLPPLCRQLRGIAAAGAGPEAAEAAAALEAPAGAERVVAALVEYSVSISSAVPSRDMALAEFRWRNGALLDMGPTPLH

SEQ ID NO: 7783 - protein, 330 aa, Arabidopsis thaliana
MASCLQASMNSLLPRSSSFSPHPPLSSNSSGRRNLKTFRYAFRAKASAKIPMPPINPKDPFLSTLASIAANSPEKLLNRPVNADVPPYLDIFDSPQLMSSPAQVERSVAYNEHRPRTPPPDLPSMLLDGRIVYIGMPLVPAVTELVVAELMYLQWLDPKEPIYIYINSTGTTRDDGETVGMESEGFAIYDSLMQLKNEVHTVCVGAAIGQACLLLSAGTKGKRFMMPHAKAMIQRPRVPSSGLMPASDVLIRAKEVITNRDILVELLSKHTGNSVETVANVMRRPYYMDAPKAKEFGVIDRILWRGQEKIIADVVPSEEFDKNAGIKSVV

SEQ ID NO: 7784 - protein, 506 aa, Shigella flexneri 2a str. 301
MNEGSMETKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDEGMHLPSPYGIRLIKGSHIVVPRVHTQKQAYILQNEDKRIVFVIPWMDEFSIIGTTDVEYKGDPKAVKIEESEINYLLKVYNAHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYTRTYGSNSELLLGNAGTVSDLGEDFGHEFYEAELKYLVDHEWVRRTDDALWRRTKQGMWLNADQQSRVSQWLVEYTQQKLSLAS

SEQ ID NO: 7785 - protein, 279 aa, Zea mays
  misc_feature (97)..(97): Xaa can be any naturally occurring amino acid
  misc_feature (106)..(106): Xaa can be any naturally occurring amino acid
MAEHLASIFGTEKDRVNCPFYFKIGACRHGDRCSRLHNKPSISPTLLLCNMYQRPDMITPGVDAQGNPIDPERIQEDFEDFYEDIFVELSKHDNLAXHMIGNVYVXQFREEEQAARALQALQGRYYSGRPIIAEFSPVTDFREATCRQFEEHSCNRGGYCNFMHVKQVGRDLRRKLFGHLHRSLRSHSRGSRSPSPYRRRGSLSRSRDRDDYHDYYYHYYRSGSGSRRSSERHRSHDSDGSRRRRGRSRSRSRSPVREGSEERRAKIEQWNREREAAQV

SEQ ID NO: 7786 - protein, 99 aa, Arabidopsis thaliana
METTKSNSSESDVNAKWDACLDLTARRFVYFSLGGAFAGLLFFRSPVTRWASIAFGAGIGIGSAYTDCFRVFDASSSTSATLLAAPKSTETSVFQAAEE

SEQ ID NO: 7787 - protein, 140 aa, Zea mays
  misc_feature (100)..(100): Xaa can be any naturally occurring amino acid
  misc_feature (117)..(117): Xaa can be any naturally occurring amino acid
MTGTLHIWTLTLEETSRRLLGQCYLLPHPSHTWWVGHKPTPDDKDYTVHLGGMQRKGRSRETNHHAFNEKETRSMKLEFFMAESVPQGAHCGMTGGGIQXHHCRATLGATQNMNFDXYLILRTSKLVGAHDPCWVGNLIA

SEQ ID NO: 7788 - protein, 270 aa, Rickettsiella grylli
MHPFLKIADRAARLAGKTILDGLNRLDRLRMQEKLDNRGVVTEIDLKAERIIISIIKEAFPQHALLAEESEPIEGDEYTWIIDPLDGTCNYVHDFPHFAISIAIKNNEKDRIEHALIYDPLRQETFTATRGQGAYLNNTQRFTRRLRVSLRSTIPESLLGIAIPSRGLTTLGASINKDALRAMMSQASGIRRTGSAALDLAYVAAGRLDAALELELAPWDMAAGILLVQEAGGIACDLKGGEDYFKTRHIIVANPKLCPLVLQAIDRNGV

SEQ ID NO: 7789 - protein, 519 aa, Chlamydomonas reinhardtii
MSQLLTHMNGLHAVARAGGGATAIARHRSRNKLLPRERIDALLDEGSPFLELSPLAGRGLYGDDDVAGGGIVTGIGKVQGRLVAIVANDATVKGGTYYPITVKKHLRLQEVAAQCQLPCLYLVDSGGANLPRQAEVFPDRDHFGRIFYNQARMSAAGIPQIAVVLGSCTAGGAYVPAMADECVIVRGNGTIFLGGPPLVKAATGEDVSAEDLGGADLHCSTSGVTDHYAQDEAHALAIARDIVAHLPLPPTTLGPPATSWQEPVYPVEELRGVVPADARRPFDVRAVLARLLDGSRLDEFKTNYGTTLVTGFGSVYGQEVGVVANNGVLFSAAAQKGAHFVQLCAQRGVPLLFLQNITGFMVGRAAEAGGIAKDGAKMVRAVANADVPKVTVVIGGSFGAGNYGMCGRAYSPHFMYMWPNARIGVMGGEQAAGVLAQVEADKQRRKGKQWAPEEEAKFRAAMTAAYDTQARPEYASARLWDDGCIDPADTRRVVGLSLAAATANVPRISTDSRFGPFRF

SEQ ID NO: 7790 - protein, 436 aa, Borrelia garinii PBi
MSNFFENYLRQVDDIETVSFVGRVQKIKGLLVESLGPQCAFGDLCLIDQRNNKKVFAEVLGFNGPYVSLMAYEGFSGIEVGNKVYSLNKGLEINLSDELLGRVIDSLGRPIDNKGSFLKNRYKELTFEKINPINRSIFEEQILTGVKVLDGFLPVEKGQRVGIFSGAGVGKSTLLGMIAKNSNADVNVIAFIGERGRELNEFIEHELGEERLKKSVLVVSTSDESPISRYKGAYVATMIAEYFRDQGKDVALLFDSITRFANAKREMSLSLGEPPVSKGYPPSVFVEIPILLERSGFNGNGGSVTGFYTVLVEGDDFTEPVADNIKAVLDGHIILDRDLFDRGIYPSINILSSTSRSINRIMNLEKQKLIMKARNLLSIYKDYEDLIRTGIYIKGSNKDVDFAISKYPKIIDFISQGINEIFDFENLEDEIREILS

SEQ ID NO: 7791 - protein, 412 aa, Magnetospirillum magnetotacticum MS-1
MLQDEPATLRADPARTNPEPWSEPLVTALLVLADGTVLEGYGIGQTGLADGEVCFNTAMTGYQEILTDPSYAGQIVTFTFPHIGNVGTNDEDLESLEAAPASGVRGAVIASAVTKPSNWRSSSHLDGWLKARGIVGITGIDTRALTALIRDNGMPNAVIANDPQGQFDREALKKRAAALAPMEGLDLVPPVTSRETTAWTETVWAVKGGYGSRAPGQDLKVVAIDYGVKRNILRLLAEAGCDVTVVPATTKAEDILAMKPDGVFLSNGPGDPAATGEYAVPVIRRLLDEKVPTFGICLGHQLMGLALGGRTVKMGQGHHGANHPVKDHTTGKVEIVSMNHGFAVDPQSLPETAVETHVSLFDGSNCGLSLTDRPAFSVQHHPEASPGPRDSHYLFERFVKLMRENRPETVRS

SEQ ID NO: 7792 - protein, 804 aa, Thiomicrospira crunogena XCL-2
MKNQRYIRFFDQIGIEDIPLVGGKNASLGEMYQALTPVGVPVPNGFAITADAYRALLTANNLWDSLHEILDPLDESNVTDLAERGLRARQLLLDAPLPDDLQAEILQAYQTLSSSFSTPISLAIRSSATAEDLPTASFAGQQDTYLNIQGEIALLDACKRCFASLFTDRAIHYRIDRGFGQFDVGLSIGVQKMVRSDLAASGVMFSIDTETGFKDAVFITGAYGLGENVVQGAVDPDEFYVHKPTFEQGYRHVLRRHLGAKKIKMIYAPDSKGSPVRNITTTEAERQQFCITDEEALKLTDYAIRIEKHYSEKAGKLRPMDIEWAKDGDDGQLYIVQARPETVISQMTGHTLKTYKITPKPDAEVLTEGRAVGGKVAQGQAHVIQDVAYIDQFQPGEVLVTDITTPDWEPVMKNASAIITNRGGRTCHAAIIARELGIPAIVGCPQATKDLESNPYVTVSCAEGDTGKVYLGEQPFEVFETDLSHLETPKTDIMLNLGNPDLAFQTSFIPNHGVGLARMEFIVNESVKAHPLALLQPEKVTAPKVREALDDLTKGYESGEAFFVDQLTSGIGTIAAAFYPKPVVVRLSDFKSNEYASLLGGKYFEPNEENPMLGYRGASRYISDSFEPAFAMECQAIKQVREEMGLSNVIVMIPFVRRVVEAQKVIALMEKYGLKRNKNALQIYMMCEIPNNVLEMDAFAPYFDGISIGSNDLTQLVLGVDRDSSLVADSYDERAEGVKTMIRWAVEGAKRNGLHSGLCGQAPSDYPEIAEFLVELGIDSMSLNPDSVLTTMQCVLELEQKMNE

SEQ ID NO: 7793 - protein, 323 aa, Oryza sativa Japonica Group
MAEAAITRYWCHECEQAIEEAMVDEIKCPSCGGGFVEEMTDEEIERLTNRQPEPGFSQWNPIEHPGETMDSDDEDNDLGREFEGFIRRHRRASTLRRVLDSIHDDLADDQERDSSILINAFNQALALQGSVLDPDEGQGDQGGSTNDDGLLEEYVLGAGLSLLLQHLAESDPSRNGTPPAKKEAVEALPTVKIEEVVSCSVCLDDLEVGSQAKQMPCEHKFHSSCILPWLELHSSCPVCRFELPSEETKDLNEPSNIGRVEDSHEEVRADGPGNVSESSNRPWAIVPWLNELFSTREAQNAGGVSTDQQSPHTSGTNPNAGHS

SEQ ID NO: 7794 - protein, 239 aa, Tropheryma whipplei str. Twist
MGTNIHIDMVIHGKHTAEIRKMFNRVAQAYDRTNLVLSFLQDAHWRRAACKMLGVTAGEEVLDVGAGTGASTRTVARTGAAVTGIDISPRMLQIARNRCKRFQNITWRLTNGDLPFPDKSFDAILMVFCLRNVSNIQGFLCDAARVLKPGGRLVVCEFSHPRRFVAPFYRLYLRYVLPRLAKLISSDPAAYEYLTESIEDWYEVDELAFMLEQCGFQNTSWKRLSFGAVALHRALRGPE

SEQ ID NO: 7795 - protein, 228 aa, Chlamydomonas reinhardtii
HTLVLIRHGQSAWNLSNRFTGWTDVDLTPEGERQALAAGRLLAAHHFRFDLVFTSVLRRAVRTAHILEGAMGLLHVQEVKSWRLNERHYGALQGLNKAETAAKHGEEQVHIWRRSYDTRPPPLEPNDPRHPRFDVRYGDLADEDLPATESLKDCVARSLPFWHSDIAAAVCRGRRVLVAAHGNSLRGIVKHLDRISDQDIVQLEIPVGCPLVYELDEHLTPLRHYYLG

SEQ ID NO: 7796 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLGALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 7797 - protein, 366 aa, Thiomicrospira crunogena XCL-2
MTNNTEKEQLTQIRDEIDAIDSEIQALISRRAECAQKVADIKTQGGKVEAVFYRPEREAQVLRAVKERNKSLISGDDMARLFREIMSVCLALEQPIKVAYLGPEGSYSHASVLKQFGSSVHPYAVSSIEEVFRSVEKNEAHYGLVPVENSSEGIVKQTQNELISTPLKVSGEVSLVIHHCLLSQANHLDDIKKVVAHPQALGQCETWLKNNMPSAEIEAVESNALAAQMAQKDASLGAIASEQAAQLYELKTLETHIEDRKDNTTKFWVLGPDETDPSGDDKTAMVIAMPNKAGALLSVLSSFAERDISMTRIISLPSSETKWDYLFFIDVIGHQKDASLMAAIKEVQQKTNFFKLLGSFPVSPLS

SEQ ID NO: 7798 - protein, 457 aa, Nitrosomonas europaea ATCC 19718
MSFENLNLHPAIVKAVLAAGYTAPTPIQQQAIPDLIAGHDVMASAQTGTGKTAAFMLPALHRLATPAQIRGRGPRILVLTPTRELALQVSDAASKYGKFLPRINVVSILGGMPYPLQNKLLSQTVDVLVATPGRLIDHIERGRIDFSRLEMLVLDEADRMLDMGFIQDVERIALSTPATRQTLLFSATLDVAIEKIATRLLKAPKRIQVAAQHTKLDHIEQRMHYVDDLTHKNRLLDHLLRDTTIKQAIVFTATKRDADSLADNLSSQGHKAAAMHGDMTQRERTRTLTGLRQGRLKILVATDVAARGIDIADITHVINFDLPKFAEDYVHRIGRTGRAGASGIAVSFASGKDVAHLKRIERFTGNRFEFHVIPGIEPRTKPRFGRSDDKPGRRPSSSAAAHKTRRSWSDNPNTRTASPGHRGDKDAGFGQPFGRETRKRPFRDSKFNSADRFARTE

SEQ ID NO: 7799 - protein, 383 aa, Hordeum vulgare subsp. vulgare
MGSSCSRPHSVNEAEAAGNTRSADIDRRILHETKADQHIHKLLLLGAGESGKSTIFKQIKLLFRTGFDEAELKGYTPVIHANVYQTIKILYDGAKELAQVELESSKYVISSDNQEIGEKLSEIGGRLDYPLLNKELVQDVRKLWEDPAIQETYSCGSVLQVPDCAHYFMENLDRLAEADYVPTKEDVLHARVRTNGVVEIQFSPLGESKRGGEVYRLYDVGGQRNERRKWIHLFEGVDAVIFCAAISEYDQLLFEDETQNRMMETKELFDWVLKQRCFEKTSFMLFLNKFDIFERKIQKVPLTVCEWFKDYEPIAPGKVQDVEHAYEFVKKKFEEVYFQSSKPDRVDRVFKIYRTTALDQKLVKKTFKLIDESMRRSREGTGT

SEQ ID NO: 7800 - protein, 325 aa, Tropheryma whipplei TW08/27
MKEGGLRNKVAVIGSGSWGTAIANLLCKAGNETILWGRDENVIDEINNARVNSKYLPGVELFLRATCDLDYAVADASHVYIALPSFALSKVLPKLSLDKFSIVISLIKCLEPDTGRRMSEVISEALDLGHNRLAVISGPNLALEVANDEPSVSVVASANIATANIVAGTLKCPGFYCIPSSDIKGVEICAASKNLVALISGIARGMDLGDNTRAALITLGFRELLRLVLENGGTEETVFGVAGLGDVVATCNSHLSRNNKAGVLLAKGAPLDEVKQTAEGVVAISGVLALAERSGVYMPIAQALSQVISGKRTAHSLLDICFSLA

SEQ ID NO: 7801 - protein, 390 aa, Nitrosomonas europaea ATCC 19718
MDIHEYQAKEILAEYGIKLAEGGLAHTVEEAVQRSREIDGNVWVVKAQIHSGARGKAGGVKVCRTHEEIEVAAESLLGKKLVTHQTGPAGKLCSRLYIEAGTEIAREVYLAFMIDRSHERIVMVGSAQGGMDIETLAATNPDAIKKIHIEPAVGLQDFQARTMAFALGLEDVLLNHAVKTIRGCYRAMRDLDANILEINPLVVTRNNELIALDAKMSFDENALFRRHRISELRDNSQIDSREIAAAEAGLSYVGLDGDIGCMINGAGLAMATMDMIKLAGGEPANFLDVGGGASAERTEKAFRLVLADNNVKAMLVNIFAGINRCDWIAEGVVQAVRNIGMTVPLVVRLSGTNVEEGRRIIADSGLPIITAETLADAAEKVVHARNQAAV

SEQ ID NO: 7802 - protein, 244 aa, Dichelobacter nodosus VCS1703A
MIELHIALVTGANGGIGTAITDTLAANGYLVIGTAISEEGAADITKRLQQNGYQGRGIVLDVTDPESVESAMTLIKAQYGSISVLVNNAGITKDNLLIRMKEEEWEQVINTNLTSIFRMSKAVVKDMMKSRYGRIINIASVVGVMGNAGQTNYGASKAGLIGFAKSLAREIGSRGITVNNIAPGFINTPMTQNLPEAQKKLMLDAIPLGRFGEAQEVADAVLFLAKSSYITGETLHVNGGMYMI

SEQ ID NO: 7803 - protein, 248 aa, Trifolium pratense
MDRYQRVEKPKADGPINENEIRITTQGRMRNYITYATTLFQEKGTDEIVLKAMGRAINKTVTITELIKRRIVGLHQNTVIGSTDITDTWEPLEEGLLPLETTRHVSMITITLSKKELDTSSTGYQPPLPADQVKPLNEYEEDGEGSPRMRGRGRGRGRGRGRGRGMYNNGGMEYGGDGWDGGRGYGGRGRGRAWGRAFRGRGRGYGAQPAGYYDNGEYDAPPPAPRGQGRGRGRGRGRGRDAGRGAAA

SEQ ID NO: 7804 - protein, 148 aa, Rhodospirillum rubrum ATCC 11170
MQRRIVPDVVRDQTIFFVSAETTAREVARTLADNKIAAVVVMEDGVLKGIITERDVTARLVAKGGDPDSVMARAIMTPDPDTLAPEDTAEDALRMMRLRGYRHLPVVDGEGVVGMVSIRDLYAVVTDQLERDMKTHESFIYGEQYGIS

SEQ ID NO: 7805 - protein, 461 aa, Tropheryma whipplei TW08/27
MSEDFILPALGESVSECVITRWLKEAGDRVEVDEPLVEVSTDKVDTELPSTLTGILEEILVQRDETAKPGQILARIAVDKDETKSNFDHGVKQSDVITGDSAGNLLGNTRPIEDNEWPVTLHTAESKPDLSAKADHIGDEGDKQGNLYAAHNAEIPYATPIVRQLARKLNIDLTNIVGSGVGNRILREDVLLASNRTTNTSTECAQNIPSSPEHDKSAASFDSEVSELRGTRIKMSRLRNIIAERAVHSMQNTAQLSTVIEVDLTRIVDYRNSIKEKFKEAEGVNLTVLPFIINATVQALRKYPVINSHIVDDQIVFPDYENISLAVDTERGLLTPVIKNAGDMTVAQFAKSVFDLARRARNNKLSPDELTGGTFTVTNTGSRGALFDTPVVFLPQLAILGIGAIARRPVIVLDAQGNECISIRSVAFFALSYDHRVIDGADAARFLGYIKSLLETGNCTV

SEQ ID NO: 7806 - protein, 450 aa, Tropheryma whipplei TW08/27
MDYDLIVLGAGSAGYATAIRATQLGMKVALAEGDKVGGTCLHRGCIPTKSLVQCAKAAHIAKNASKFGVINSFSGVDINAVNVFKNGIVESKYRGLQSLLRSYGIHVYPNFATLSSQNSVRIGTEDITGKNIVIATGSRPKGIPGLSGGCIFDSDSILEIDHLPSSLAIIGGGVIGVEFASIFNYLGVDVSILEAQETLIPSEERGVSKQLERVFRRRGIKLYLGHKIMDVSQTDGVVVSLDSNEKVNADLLLVAIGRAPATDAIGKVGIEIDGGAISVDEKLRTTVPNVFAAGDVVGGLQLAHRGYQQGIYLAEQIAGLDPSAVADINIPRVIYTSPEVASVGYTEAGAAEIYGVNEIVTYEYNLAGNAKSSIMGAAGSIKVVQHKNKDVLGVHMVGDGVSELVSEAQLIVNWEANPSDVASLIHPHPTQAEAIGEAMLALAGKPLHGI

SEQ ID NO: 7807 - protein, 367 aa, Rhodospirillum rubrum ATCC 11170
MGFKCGIVGLPNVGKSTLFNALTSTAAAQAANFPFCTIEPNVGRVAVPDPRLDTLVEIGKSANKVPTQLEFVDIAGLVRGASKGEGLGNQFLANIREVDAIVHVLRCFEDGDITHVDGSVDPLRDAETVETELMLADLESLEKRHYNLSKKAKGGDMDAKALIGVIEPALEALRAGKTARTVAPRDAEERKLFAQLQLLTSKPVLYVCNVEEASAASGNALSAKVADQAAKEGALAVVISAAIESEVAQLEEEAEKAEFLESLGLAETGLTRVIRAGYDLLELITFFTCGPKEARAWTVRRGSRAPQAAGVIHSDFERGFIRAETIAYADYIAQGGESGAKEAGKMRSEGKDYVVQDGDVFLFRFNV

SEQ ID NO: 7808 - protein, 211 aa, Symbiobacterium thermophilum IAM 14863
MPAPRAVIAIAGGTGSGKTTIANYISAAFPDDVALLPHDAYYKDNRNLTYEERSQLNYDHPDAFDNDLFIAHLKALKAGQAVERPVYNFSTHLREHQTLRVEPAAIIVVEGVLVLAHPELRALYDLSVFVDTDADVRILRRIVRDIHERGRTLDSVINQYLSTVKPMHEAFVEPSKRYANVIIPEGAHNKPGLEVLIAQVRHLIAQHEPSA

SEQ ID NO: 7809 - protein, 800 aa, Burkholderia sp. 383
MTNAANVAKDQAYVIPFEQLRMTDVEIVGGKNASLGEMISQLSEAGVRVPTGFATTALAFRDFLTHNDLTDRIAKRLESLDIDDVKALAEAGAEIRKWIVDAPMQARLEQEIREQFEILKNSSPGELSFAVRSSATAEDLPDASFAGQQESYLNVVGIEDVLDRMKHVFASLYNDRAISYRVHKGFTHAEVALSAGVQRMVRSDVGAAGVMFTIDTESGFKDAVFITSSYGLGETVVQGAVNPDEFYVFKTTLAQDKYPIIRRSIGSKLIKMEFTQPGEPGRVKTVDVPHEQRNRYSITDEDVIELAKYAVIIEKHYQRPMDIEWGKDGRDGKIFILQARPETVKSQATGKAEQRFKLKGQSQVLATGRAIGQKIGAGPVRVIQDPSEMERVQPGDVLVADMTDPNWEPVMKRAAAIVTNRGGRTCHAAIIARELGVPAVVGCGDATDILKDGALVTVSCAEGDEGKIYDGLLETEVTEVQRGELPEIPVKIMMNVGNPQLAFDFSQLPNGGVGLARLEFIINNNIGVHPKAILEYPNIDQDLKKAVESVARGHASPRQFYVDKLTEGVATIAAAFYPKPVIVRLSDFKSNEYKKLIGGSRYEPDEENPMLGFRGASRYIAEDFAQAFEMECRALKRVRDEMGLTNVEIMVPFVRTVKQAERVVGLLEKFGLKRGENGLRLVMMCEVPTNAILAEDFLQFFDGFSIGSNDLTQLTLGLDRDSGMELLAVDFDERDPAVKFLLKRAIDTCRKMGKYVGICGQGPSDHPDFAQWLTDEGIVSISLNPDTIIDTWQALAANRK

SEQ ID NO: 7810 - protein, 197 aa, Oryza sativa
MSGVIGHKAPAFSTEALMPDGSFKKVSLSDYAGKWLVLFFYPLDFTFVCPTEIIQYSERVEEFNTIGAEVVAASVDSVFSHLAWTKQPRKAGGLGPMKIPILGDITKEVSKAYGVLNEGGVAFRGVFIIDPEQNIRQITINDLPVGRNVDETLRLLQAFQFVAQHGEVCPAGWKPGAKTMKADPKGSQEYFAAAAAQ

SEQ ID NO: 7811 - protein, 416 aa, Photobacterium profundum SS9
MSEDFRQQALNYHAYPVPGKTAIALTKPADTVQDLALAYSPGVAEPVREIAQNAENVYKYTGKGNMVAVITNGTAILGLGNLGPLASKPVMEGKSLLFKRFAGLDSIDIEVKHRTIDEFVDTVANIADTFGGINLEDIKAPDCFEIEKRLIERCSIPVFHDDQHGTAIVTAAGMLNALEIQGKEISESVIVCLGAGAAAVACMELLIKSGAQREKIYMLDRKGVIHTRRDDINEYKQLFANNTDKRTLEDVIDGADIFVGVSGPNLLAPEALKLMADKPVVFACSNPDPEIKPELAHAVRDDLIMGTGRSDYPNQVNNVICFPFIFRGALDVRASEINDEMKLAAVKAIRELTKEPVPAEVMKAAGVDELEFGINYIIPKPMDPRLLPRVAKAVAQAAIDSGVAQIDMPVGYMEDK

SEQ ID NO: 7812 - protein, 260 aa, Photobacterium profundum SS9
MSKIPLVIKLGGAVLSCNDTLEKLFTAISAYQASAQRPLLLVHGGGYLVDDLMKKLQLETIKKEGLRVTPKAQIPFIAGALAGTANKMLQGRAIKSGVAAVGLSLADGGLCQITELDPELGSVGKAAPGNGALVSQIMASGYLPIVSSIGLDANGELMNVNADQAAVAVAAALDAELVLLSDVSGVLDGKGHLISALTEQQAEDLITQAVITDGMIVKVRAAIEAAKALGRPIEVATWRYPDKLAALFDGQNIGTKFSSS

SEQ ID NO: 7813 - protein, 483 aa, Oryza sativa
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDNLFIVDEVITGFERLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 7814 - protein, 248 aa, Zea mays
MVKPAFGSFGDSFSAASLKAYAAEFIATLLFVFAGVGSAIAYSQLTKGGALDPAGLVAIAIAHAFALFVGVSMAANISGGHLIPAVTFGLAVGGHITILTGVFYWVAQLLGASVACLLLQFVTHGQAIPTHGVSGISEIEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVGQQEYP

SEQ ID NO: 7815 - protein, 359 aa, Vitis vinifera
MNCPQDWPEPIVRVQSLSDSGVAVIPDQYIKPSMERPEGFSENTQTNIPVIDLEGLFDDQHGLMLNSSIIELIYQACREWGFFQVVNHGVSPDLMDQAREVWRDFFHLPMEMKQVYANSPKTYEGYGSRLGVEKGAILDWSDYYFLHYRPSSLKDHNKWPSPPLALREVIEEYGKQVVELAGKLMKVLSINLGLKEEYLQNAFGGDDIGACLRVNFYPRCPQPDLTLGLSSHSDPGGMTFLLPDHDVPGLQVRKDHKWITVKPAPHAFIVNIGDQIQVLSNAIYKSVEHRVMVNSLKERVSLAFFYNPKSDILIEPVKALVTPDTPALYPGMTFDQYRLYIRMRGPRGKSQVESLKSPR

SEQ ID NO: 7816 - protein, 462 aa, Oryza sativa Japonica Group
MARGRGRWLLPTRLLNVCLAALCRGGSLAAAESVLVDAIRLGLPPDVVTYNTLLAAHCRAAGLEAGLVVMGRMREAGVEPDAVTYNSLIAGAARRGLPIHALDLFDEMLRSGIAPDSWSYNPLMHCLFRSGHPEDAYRVFADMAEKGIAPCDTTYNTLLDGMFRAGYAMNAYRMFRYLQRAGLPVSIVTYNTMINGLCSSGKVGYARMVLRELGRTDHAPNIITYTAVMKCCFKYGRFEQGLDTFLSLLDRGYISDVYPYCTVISALVKKGRLGEANNYCDLMLQNGSRLDSVCYNTLIHMRCQEGKLDDAFELVSMMEDGGLESDEYTFAILVNGLCKMGHIEAAEKQLFYMEIKGMQSNVVAYNCLVDALCKFQEVDAAIRLLQCMKLKDDFTYTSLVHGLCRVGRYHMASKFLRICLHEGNNVLASAKRAVIAGLRSSGFKNDLRKVRVALNMAKLLRP

SEQ ID NO: 7817 - protein, 130 aa, Triticum aestivum
EALRSDAAEPPVPSSVPRSVPVRVAYELQQAGHRYLDVRTEGEFSAGHPEGAVNIPYMNKTGSGMTKNTHFLEQVSRIFGKDDEIIVGCQSGKRSLMAATELCSAGFTAVTDIAGGFSTWRENELPTTIH

SEQ ID NO: 7818 - protein, 517 aa, Bradyrhizobium japonicum USDA 110
MIGSPLATSCEPGSLPLVRPSNAMELQQSQALNYGPAVSAVATDRIIETSIPSRLDALPWSGFHTRVVLALGITWILDGLEVTLAGALSGALKQSPSLQFSNLDLGIANSAYLAGAVLGALGFGWLTDRIGRKKLFFITLALYLSATAATALSWDIASYALFRFLTGAGIGGEYTAINSTIQELVPARYRGWTDLVINGSFWIGAAMGAVAAIVLLDPALIGPDLGWRLAYLIGASIGLVVLLMRMWIPESPRWLMIHGRPDQAHAIVDEIERSVIGHDQDASDRRFTRIRLKMRDHTPIREVMHTLFTVYRQRALVGLVLMGAQAFFYNAIFFTFALVLTDFYGISADHVGWYLLPFAAGNFLGPLLLGRLFDTLGRRAMIMFTYGASGLLLALSGYLFSIGALSAQGQTIAWMVIFFFASPAASAAYLTVSETFPLEVRALAIAVFYAVGTGIGGVIGPALFGALIDTGSRTSVFAGYLLGAFLMIAAAIVAWRYAVSAERKSLEQIARPLAFME

SEQ ID NO: 7819 - protein, 363 aa, Nitrosomonas europaea ATCC 19718
MSLKCGIVGLPNVGKSTLFNALTKAGIAAENYPFCTIEPNVGIVEVPDSRLTELSRIVNPQRVQPAIVEFVDIAGLVAGASKGEGLGNQFLANIRETDAIVNVVRCFDDPNVVHVAGKVDPLADIEVILTELALADLATVDKAIARDGKKAKSGDKEAIKLVTVLEKLIPHLNQGQPARTFPLSNEEKEIIRPLCLLTIKPAMYVGNVLEDGFENNPYLDRLREYAAKENAPVVALCAKIEAELADLDEADKKEFLADLGLEEPGLNRLIRAGYDLLGLQTYFTAGVKEVRAWTIHKGNTAPQAAGVIHTDFEKGFIRAQTVSYADFIACGGEAGAKEKGKMRVEGKDYIVQDGDVMHFLFNV

SEQ ID NO: 7820 - protein, 570 aa, Chlamydomonas reinhardtii
MATTVSPADANLGLHIANRLVEIGCTSCFAVPGDFNLLLLDQLLKQPELSLVWCCNELNAGYAADGYARKRGVGCLCVTFCVGGFSALNAVGGAYSEDLPLIVISGGPNSQDHASNRILHHTTGANEYGQQLRAFREVTCCQVVIQHIEDAHMLLDTAISEAMLKRKPVYIEVACECVVTWYLLGGRVMGGPSLWAAVEAAVEWLGGGVKPLLLAGVRTRPPAARKAMLALAEASRYPVAVMPDAKGMFPEDHEQYIGMYWGPVSTPCVCEVVESSDIVLCVGGVWTDYSTAGYSLLLKPEKMLRVDNNRVTLGNGPTFGCIVMTDFLEALAKRVAPNDTGHVIYKRMALPPSEPPPQAEGELLRTNVLFKHIQHMLTPSTSLISEVGDSWFNTLKLKLPAGCEYELQMRYGSIGWSVGAVLGYGVAERQTAPDRRVVACIGDGSFQMTAQEVSTMLRYGLDPIIFLINNGGYTIEVEIHDGPYNVIKNWDYPGMVRALHNGQGKLWTAEARTEPELQAAVAEAVQRRGELCFIMVVTHRDDCSKELLEWGSRVAAANSRKPPTTGYGGH

SEQ ID NO: 7821 - protein, 277 aa, Oryza sativa Japonica Group
MRKNFRKRNLEADAAADHSDDDDARRVALEEIKYMQKLRERKLGIPAAAAAAGASSAASADGASPRGRGGGGGGLAAGGDAEKEDLVLQDTFAQETAVTIEDPNMLRYVENELLKKRGKKVDVKDKEEKDQVDELYTVPDHLKVRKKNSEESSTQWTTGIAEVQLPIEYKLRNIEETEAAKKMLQEKRLAGKTKSDANIPSSYNADFFHRGKDYTEKLRREHPELYKDQGSQANGTGGKSMGGNHPDGAGAGRREAATDELLLERFRKREKFRVMRR

SEQ ID NO: 7822 - protein, 97 aa, Alocasia macrorrhizos
ATYKVKLVTPQGQQEFDCPDDVYILDQAEEEGIDLPYSCRAGSCSSCAGKVKQGEVDQSDGSFLDDEQMEQGWVLTCVAFPTSDVVIETHKEEELTA

SEQ ID NO: 7823 - protein, 314 aa, Geobacillus stearothermophilus
MDVVTIGESMAVFTPTSVGLMRQATTFTMRIGGRESNVAVGLARLGHRVGWISKVGSDEFGKAILSFLKGEGVDVSRVKWMGNTDRHLLKEQRRLNDTRVYYYRKGSAASRLTPADLDEKYIAEAKYLHITGITPALSENCRDTVFAAMAMARRHGVKIVFDPNLRLKLWNEADRAKEVMLRMAAESDVVLPGEAEASFLFGKHSVEEWGSRLLDMGASLVVIKLGANGAHYFTNAHHEYVQGFLLKGYDPVGAGDGFVEGYPDCLKDFVLTEAVQRANAVGALVTMVEGDADGMPERDDVERLINQRRKMLRR

SEQ ID NO: 7824 - protein, 535 aa, Zea mays
  misc_feature (67)..(67): Xaa can be any naturally occurring amino acid
  misc_feature (187)..(187): Xaa can be any naturally occurring amino acid
  misc_feature (299)..(299): Xaa can be any naturally occurring amino acid
PPPPQLSVDGDARTPANDRDPAGLLQHDDTENQQQQQACWERFLLKETLNVLLVESDDSTRQVVSAXLLRCCMYQVISAENGQQAWAYLEDKRNTIDLVLTEVFMPGVSGISLLSRIMSHNICKNIPVIMMSSSDAMSTVFKCLSKGAVDFLVKPIRKNELKNLWQHVWRQRCHSVSCSWSGLNIWXVEVKVAFRRRSVPSQKVPSLELSLKRSRSCGDGANDTVNDDEQRNSALRRSNLSAFTRYHTSAASNQGGTGLVGSCSPHDNSSEAVKTDSTYNMKSNSDAAAIKQGSNGSSXNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 7825 - protein, 98 aa, Alocasia macrorrhizos
ATYKVKLVTPSGQPLEFECPDDVYILDQAEEEGIDLPYSCRAGSCSSCAGKVKNGNVDQSDGSFLDDDQIGEGWVLTCVAYPTSDVVIETHKEEELTA

SEQ ID NO: 7826 - protein, 409 aa, Trifolium pratense
MGVCLSAQIKAESPYNTGLNSKNSNSAGNDLSSTNSKVSTGSVPQTPRSEGEILKSTNVKSYTLAELKSATRNFRPDSVLGEGGFGSVFKGWIDENSLAPAKPGTGIVIAVKRLNQESFQGHREWLAEVNYLGQFSHPHLVRLIGYCLEDEHRLLVYEFMPRGSLENHLFRRGSYFQPLSWSLRLKVALDAAKGLAFLHSSETKVIYRDFKTSNILLDSDYNAKLSDFGLAKDGPTGDKSHVSTRVMGTYGYAAPEYLATGHLTTKSDVYSYGVVLLEMLSGKRAVDKNRPSGQHSLVEWAKPYLANKRKVFSVLDSRLEGQYSSDESYRVATLALRCLSTESKYRPNMDEVVRILEQLKVPNVNVGNQRRYRRKSADDVTHARTHKKSCASARAHTSYPRPSASPLYA

SEQ ID NO: 7827 - protein, 434 aa, marine gamma proteobacterium HTCC2143
MDIETFNCDLLEFLAASPTPFHAVQQMEIRLSQAGFVVLREADDWTLHAGGRYCVIRNSSSIVAFTLGEKSILDQGLRMVGAHTDSPCLKVKPQPELFKKGYFQLGVEVYGGALLNPWFDRDLSLAGRVSFRDTSGNIGSVLIDFKRAIATIPSLAIHLDREANSARSINAQTDIPPVVMQTNDKQTSFRELLLAQIRQEHPSCEACKVLDYELSFYDAQPAAIIGLHNEFIASARLDNLLSCYIGLQAILADSTEYRVLVCNDHEEIGSQSAAGAQGPMLRSVISRLLANEKEFTRTIDRSMMISVDNAHGVHPNFSDRHDANHGPLLNGGPVIKINANQRYATNSETSSLFRHWCESADEPVQAFVVRTDMGCGSTIGPITASEIGVQTLDIGVPTFAMHSIRELAGSSDAYSLYKVLEMFYRTEDVAVDRH

SEQ ID NO: 7828 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEILGNQVKKAVEGLSDDQLKEVVIAYEPIWAIGTGKSSTSEDANEMCAHVRQTLADLSSQE

SEQ ID NO: 7829 - protein, 278 aa, Zea mays
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGAGWVVSGRGYKEYRLGDYSTWLQRRVENSQNWAKIRSCLQDGKVCQKLASRKETAAQFVNSNLSPIQLMNLSHVQSGCCKPPTGCNFTYQSETVWTKPAGFNTTTDDPDCTTWSNDQTVLCYDCMACKAGVLANLKNDWKKIAPVNIVFLIFLVVVYSVGCCAFRNNRQDNLSPAWK

SEQ ID NO: 7830 - protein, 242 aa, Photobacterium profundum SS9
MFASKEGQAVPQVTFHTRQGDAWVDVTTEELFANKTVVLFSLPGAFTPTCSSSHLPRYNELASVFAEHGVDEIVCVSVNDTFVMNAWKADQEAENITFIPDGNGEFSKGMDMLVDKEDLGFGPRSWRYSMLVKNGVVEKMFVEQEEPGDPFKVSDADTMLNYIAPNHKLQESITVFSKPGCPFCAKAKQNLIDKGLQYEEVVLGKDATTVSLRAITGRSTVPQVFIGGKHIGGSEELETYLA

SEQ ID NO: 7831 - protein, 345 aa, Triticum aestivum
MEAFRKQASKFKEQVAKQQQAVIKQFSTTGYERSDSVVIDEVELQQHQRLEKLYSSTRSGRDFQKDIVRAAEGLVSIGSKHIEVGTKFSEDCYRYGGENNADGEALTKAASLYGGALRNVEKEYEDFNRTLCSQIIDPLKAMAVCAPLEEARGFAQRYSRMRHEAEILSAEIARRKARVRESPVAEHTTKLEQSEGKMIEHKASMAVLGKEAVAALGAVESQQKRVTLQRLVGMVEAEKLFYLRLAAILDDVEAEMSSEKQKRESAPPSRKRAEMAQYFIAEAVHNFNGTTEKELSLIVGDYVVVRQIAPNGWAEGECRAKAGWFPAAYVERRENIPPNKVFPQA

SEQ ID NO: 7832 - protein, 141 aa, Staphylococcus epidermidis
IGAQNAYFEESGAYTGETSPVALSELGVKYVVIGHSERRDYFHETDEEVNKKAHAIFNHSMTPIICVGESDEEREAGKANEIVGNQVKKAVEGLSDDQLKEVVIAYEPIWAIGTGKSSTSEDANEMCAHVRQTLADLSSQE

SEQ ID NO: 7833 - protein, 460 aa, Pseudotsuga menziesii
MKISNDNPTRRQPQEVTTALPARGDSLSSLAMSKPHWEDSPYFDGWKEYARNPYHPINDPSGIIQMDLAENQLSLGLLESWLYTHPEASIWTEEGLSMFREIASYHDNLGLPACRKGIAMFMEEVGGRKAKFERDRIVLTAGATAAHEVLTFCLVDPGEAFLVPTPYYPRFDRDLKWRTGVDLIPVQCSSCNDFQITIPALEAAYEQARARNIEVKGLLITNPSNPLGTTMENSTLRNLLAFVYEKNIHLVCDEIYSGSVFSSPKFTSIAEILATEKICQTDRVHIVYSFYEDLGLPSFRVGVIYSYNDTVVTAARRMSRFSLVSSQTQHLIASMLCDTDFVRKYLTENSKRLRERHEMFVSGLRVAGINCLNSNTGLFCWVDLRHLLQFRNQEGEIILWTIILKEIGLIVSAGSSCHCSEPGWFRFCFANMDDQTVQESLNRIHLFVESKTPNQRGMAG

SEQ ID NO: 7834 - protein, 442 aa, Glycine max
MRVLQLGLFLALASGFAAISIYITGLSDPFVYPSYHLTDEDTQALLSLHDTFQKCVTANGLGLKATRGTDYCQTTINFPSDTIPKWKDPKTGELEALSFDFNLCEAVATWEQVRNSTTILTKEFIDSLPNGWEEYAWRRINKGIQLNRCENKTLCMEKLSLVLPETPPYFPRQFGRCAVIGNSGDLLKTKFGNEIDGYEVVIRENGAPTQNYTDYVGRKSTFRLLNRGSAKALDKVVELDEQRKEVLIIKTTIHDIMNKMIREVPIKNPVYLMLGASFGSAAKGTGLKALEFALSMCDSVDMYGFTVDPGYKEWTRYFSESRQGHTPLHGRAYYQMMECLGLIKIHSPMRADLNRVVKWVPSRHIIRSARIASEKLLRRVGAGSEDPLAACSIIKKQVKRNLNAVSKLRKAALDHLRYVKRTTMYPLEHSPGHGSLCTVPTD

SEQ ID NO: 7835 - protein, 163 aa, Pseudomonas fluorescens Pf-5
MRHIISLLLENEPGALSRVVGLFSQRNYNIESLTVAPTEDPTLSRLTLTTVGHDEIIEQITKNLNKLVEVVKLVDLSESAHIERELMLVKIKATGAQRAEVKRTTDIYRGQIVDVSASVYTVQLTGTSDKLDSFIQSIGTASILETVRSGVTGIARGDKVLSI

SEQ ID NO: 7836 - protein, 271 aa, Burkholderia sp. 383
MAITLKNEHDIAEMRVACRLASEVLDFITPHVVAGVTTAELDRLCHEFMLNEQGTIPAPLNYQPPGYPPYPKATCISVNDVICHGIPGEKVIKNGDALNIDVTVIKNGYFGDTSRMFIVGEGSILAKRLVQTTYECMWLGIDQVKPGAHLGDIGYAIQKHAEAQGYSVVREYCGHGIGTVFHEDPQVVHYGRPGTGIELKAGMIFTIEPMINAGKRDIRTMPDQWTVKTRDRSLSAQWEHTVLVTETGYDVLTVSAGTPARPVFAQPAAAV

SEQ ID NO: 7837 - protein, 301 aa, marine gamma proteobacterium HTCC2143
MEFPTIEDYVGGSPLVRLQRINGTTSSNTILLKLEGNNPAGSVKDRPALSMINRAEARGDIKAGDTLIEATSGNTGIALAMVAAIKGYNLKLIMPSHMSQERKLAMAAYGAELIDVTQKEGMEGARDLALQMQADGQGVVLDQFANVDNPMAHYEGTGPEIWRQSQKRVTHFVSSMGTTGTIMGVSKFLKEQNPNIEIVGLQPCDGSSIPGIRRWPEAYLPSIFERTRVDRVIDVDQRDAEVMMKRLAAEEGVFCGVSSGGSVVGALKIAEHVENAVIVAIICDRGDRYLSTGVFDSTLQK

SEQ ID NO: 7838 - protein, 399 aa, Pseudotsuga menziesii
MCKPTTQRQQQANPRMPARGVCLSSLATSKAHGEVSPYFDGWKEYDANPYHPTDNPSGIIQMGLAENQLSFDLLESWLLAHPKASICAEEGVSRFKEIALYQDYHGLPACRKAIAKFMEEVGGRKAMFEKDRIVLAAGATAAHEVLTFCLADPGEAFLVPTPYYPGFDRDLRWRTGVELIPVHCSSDNDFQITIPALEAAYQNARDRNIQVKGLLITNPSNPLGTTMDATALRKLLAFVSGKNIHLVCDEIYSGSVFSSPKFTSIAEILATDKTYQSERVHIIYSLSKDLGLPGFRVGVIYSYNDTVVTAARRMSSFSLVSPQTQHLLASMLSDMEFVRKYLAENSKRLQKRHEMFVSGLRLAGINCLNSNGALFCWVDLRHLLESHDQEGEIILWKIV

SEQ ID NO: 7839 - protein, 206 aa, Mesorhizobium sp. BNC1
MSGTLILVRHGQSEWNLKNLFTGWRDPGLSELGHEEATSAGRKIKDRGLRPDIAFTSVLSRAKVTNTHILEVLGLPALETIEDVALNERDYGDLSGLNKDDARKKWGEEQVHIWRRSYDIPPPGGESLRDTGARVWPYYLREILPQVLRGKTVLVSAHGNSLRSLAMVLDGLSGEEIVKMEIATGVPIVYRLNPDSTVASKEILEG

SEQ ID NO: 7840 - protein, 155 aa, Polaromonas sp. JS666
MKVLDILRVKGNTLYTVQPDEPLAKATQIMADKDIGSLVVMEHGDLVGMLTFREVIVCIVKNGGEIGNTLVRTAMDDHPLTCTSETELDEVRRMMLDRHARYMPVMNQKMLMGVISFYDVAKAVVDSQNFENKMLKAYIRDWPAGQEEEGESKLP

SEQ ID NO: 7841 - protein, 855 aa, Yarrowia lipolytica CLIB122
MIRATRGMARVVPRVCASVAAPQIAAPATKFVALKQSIRPISTRSTVVQLLNNIGSKREVEQYLKYFTSVNQQQFAVIKVGGAIITQQLQELASCLASLYHVGLYPIVLHGTGPQINEILEQEGVEPDYIDGIRITDPKTMSVVRRCFLEQNLKLVEALESMGVKARPITGGVFQAEYLDKDKWQLVGKITRVDKTPIESSIKAGALPILTSLAETADGQILNVNADVAAGELSRVIEPLKIVYLNEKGGLHNGTTGEKISIINLDEEYEDLLKEPWVKYGTKLKIKEIKELLDFLPRSSSVAIISVESLQKELFTDSGAGTLIRRGYKLVTRDNLNQFASTDALRAALSRDKDIASNKVSVASYLRELETSPFKAYGDEPLEVLAIVRESPHGAYLDKLLASKNGWLNSVTDNVWTAIKKDHNKMWWTVPEEDENTSWHFDKADGSFAKNGQVLFWYGFEADEVSKLIASFVANAKAEAFTGVRSMHTGTGLGNGRKTGAPGVGRYFRPTIHSSLTPKTRHFTTNPNPPIEKGTNTKPAKVALIGARGYTGKALIDLIDNHPHLELSHISSRELDGKPLEGYKKAQMKYCNLQVEDIVRLEEKGAVDVWVMALPNGVCKPFVDAIEGVRNKSIMIDLSADYRFDTTGDWTYGLPELVDRQAIVNAKKISNPGCYATGSQLAIAPLLPYLGGQPTIFGVSGYSGAGTKPSPRNDIDNLRDNLIPYSLTDHIHEREVSSQLGTPVAFVPHVASWFQGISLTVSIPLAKPLTSRDIRNIYQDRYAGEKLVQVTGEAPEVRHISEKHHVSIGGFGVSSKEDRVVVVGNIDNLLKGAATQCLQNINLAMGYGEYDGIPL

SEQ ID NO: 7842 - protein, 230 aa, Picea sitchensis
MAAAAAGAATVLSCIPTMSTTGIATYSTHLAVGLTSKVSNKAYKIQVTPLRSDFGSNANRRRSKSNTFTVSAAAQLLTGSITKTEGLHFAVVAARFNDIVTKPLVEGALEAFRRHSVREEDIDVIWVPGSFEIPLVAQTLGKSGKYHAVLCIGAVVRGATTHYDAVANSAASGIVSASLNSGIPCIFGVLTCENMEQALDRAGGKVGNKGAEAAVTAIEMASLFQHHIKC

SEQ ID NO: 7843 - protein, 157 aa, Triticum aestivum
  misc_feature (78)..(78): Xaa can be any naturally occurring amino acid
  misc_feature (92)..(92): Xaa can be any naturally occurring amino acid
  misc_feature (132)..(132): Xaa can be any naturally occurring amino acid
MAPTVMASSATSVAPFQGLKSTAGLPVSRRSNGASLGSVSNGGRIRCMQVWPIEGIKKFETLSYLPPFRTEALLKQVXDYLIRSKRVPCLEXFSKVGFIFREHNASPEYYDGRDWTMWKLPMFGCTDPTQVXNEVEEVKKEYPEGVGPALSGFENME

SEQ ID NO: 7844 - protein, 357 aa, Thiomicrospira crunogena XCL-2
MSLKNSLLTPNSIRSSASQFSVAPMLDWTDRHCRVFHRQLTKHAWLYSEMVTTGAIIYGNNLERFLGHSEMDSPVVLQLGGSNPEELAHCAKLGEEWGYSEINLNVGCPSDRVQNNMIGACLMAHPNIVADAVSAMKTAVKEIPVTVKSRIGIDEQEDFDTLVEFVSAIQTAGVDGVIIHARKAWLQGLSPKENRDVPPLKYDWVRQIKALFPELEIAINGGIQTPQAGLNFLEILKDDEQSLPAVDGVMLGRAVYEKPYLLTEVDALYYDDASPVKSREAVLEAMYPYIENHLTQGGKLNQVSRHMLGLFAGLPGGRMWRRYISENAFKSGAGIDVLQEAYRRVVNEIQRMEEQNR

SEQ ID NO: 7845 - protein, 316 aa, Nitrosomonas europaea ATCC 19718
MSYDSLMVFTGTANPKLAHDVVKYLNINLGRANVGRFSDGEVMVEILENVRGNDVFVLQSTCTPTNDSLMEILVIVDALKRASASRVTAAIPYFGYARQDRRTRSARVPITAKVVANMLTSVGVDRVLTMDLHSDQIQGFFDIPVDNVYGMPILLGDIWKHDYQNLIVVSPDVGGVVRARHLAKRLECDLAIIDKRRPKPNESKVMNIIGDVRGRTCVIIDDMVDTANTLCEAASALKREGAASVIAYSTHAVLSGKAVERVQTSDLDKLVVTDTIPLREDASKCNRIHQLSVASLLGESMLRISNESSLSSLFIE

SEQ ID NO: 7846 - protein, 614 aa, Medicago truncatula
MEMETDEGINSLKARIETQHKSHMYMLSSVQSVIPNFVSSLDLSLKVLSSFNHRPFAPTPPLTNFNPPKSSSLQQLPQKPSVKTLKTSLVVTTNPVLEKVTPLSVVLSMVAVCLLSRLPFMEIDSSTLWRKLENDETFTPQDKAAFQELAGDSGGPTLAVEIALRSMADDNGAVELEEFAVSGKSRIMVLNIDRTRLLRQLPETAQHQLQQQQDELSLGDGNMNQNQQQIAKCSMNLEDVDALINKKSFREMQKYETAKELLKIIQTPSIREAAVAAKFKTKGGSQMRPYCDLPTKEDCRRRTGSFIACNKLHFRRIIALHTDINLGDCPFLRTCRHMNTCKYVHYEEDPTPDLPPTMMCAPPPPLKPLKQQRAEYCSEAELGQPQWINCDIRNFRMDILGKFGVIMADPPWDIHMELPYGTMADDEMRTLNVPALQTHGLIFLWVTGRAMELGRECLERWGYKCVEEIIWVKTNQLQRIIRTGRTGHWLNHSKEHCLVGIKGSPEVNRNIDTNVIVSEVRETSRKPDEMYAMMERISPGTRKVELFARMHNTHAGWMSLGNQLSGVRLVDEGLRARFKAAYPDVEVQPASPSRASAMELDSSVAAQTTTSAMM

SEQ ID NO: 7847 - protein, 611 aa, Thiomicrospira crunogena XCL-2
MFEYLSIPLQLSLLVLFGMLSQWLGWKLRLPAIIFLLLVGILLGPVLEWLNPDVLLGDLLFPFVSLGVAIILFEGSLTLRFSEIKGVKYYIRNLTTIGVLITWIVMAVGAHYLASLDWPIAFLFGAIVTVTGPTVIMPMLRSMKITERVGSVLRWEGIIIDPIGAMLAILVYVFIVSSANHTDVLLTFLELIAIGSALGLLGGWFIAKCLKNHWIPNYLTNFFSLTVVLLMFTVSNQISHESGLVAVTVMGIYLANQKDISMHSILDFKEHLTVLLISLLFIVLAARMDFDLLFSLSWSALLLLVIAQFVARPLSVFISTIGGKELKLNELILLSWISPRGIVAAAISALFAIRLEENGISGAETILPLVFIMIMGTVLFQSLTAGFIARKLKLSHIDTQGALIVGSNKVSIAIAQALKDQGLEVMIATQSRAADKEAKMHGIKTYYGDLLSKKAELYLDINPYKVMLLMDFKSELHPLYYTHFRADFGPENIYALSTVPSSEISEEKSLSTNLNPRVLFGDEVTWPMLSNLINQGAEVKATNITESFSFNDYQEYWQNKAIPLFAISPKEEFYIFAEDSSMKIEAGWKIGALVLDTKKDTPKKELPEKKK

SEQ ID NO: 7848 - protein, 329 aa, Magnaporthe grisea 70-15
MQHGVRSILPLVLTACLFLGAANASVGDRLPEFRECVQVCLHENCEAGTLAHKVETPLINRLLLWTCPAECDYTCQHIITSDRIESGQPVVQFHGKWPFYRVLGMQEPFSVIFSAGNLYAHLLGFRWLRRHIPESYPLRKYYVGFSFAGVASWLFSIIFHTRDTRATEQLDYFAAGASVLYGLYLAVIRIFRLDRPGSTDGGKTPTGTASSSSSISSSTPRAIRLWTAACLVAYGCHVAYLKLVRWDYGYNMAANVCVGLAQNVLWSAFSYRKYTREGRTWATYPGLAVAWIMLAMSLELFDFPPLWGALDAHALWHLGTIAPAVLWYR

SEQ ID NO: 7849 - protein, 494 aa, Thiomicrospira crunogena XCL-2
MSEACTYVVFGATGNLSLTKLMPSFYHLEQIDRLAEGVKILAIGRRQWDKAKWIDVVKEAIEPKARGGLDPEIFQRFCERLDYCVMDIENGESYPAMYDKILSSGWSNNIAYYLSLGPGSFASVVRYLGEAGMLQEADGWKRVVLEKPFGFDSDSAKQLQAQLNKYLKEEQTYRIDHYLGKGMVQNIMVFRFANLLMEPLWNRNFIDHIQITHAEDKPIGTRAGYYDSSGAMRDMIQSHLLQLMALVAMEPPASMDAEDLRDEKVKLLKSIRPIAKKNVKAQSYRAQYTAGEINGQPVPAYLDEPGMAPDSVTETYAALKLYVDNWRWAGVPFYIQTGKNMPKNKTMVSICFKHSPKQFFRESQVKKMHPNWIIFGIQPDESIKVEMMAKQPGLEMNTQQISLDAAMRPAGIDSNDAYEELLLDVIKGDRSLFLRYDEVKAAWKVVDPVIETWGMETAYIDTYRSGTWGPEGANKLFDHPDEQGWRYHVHPEVD

SEQ ID NO: 7850 - protein, 482 aa, Thiomicrospira crunogena XCL-2
MSKADIGLVGLAVMGQNLVLNMADHGYHVCVYNRSKEKTDDFIQNRVEDRPVSGASTLEELVGCLKAPRKVMLMVKAGDVVDSFIDQLVPLLDKGDMIIDGGNSLYTDSTRRTQALKEKGILFVGTGVSGGEEGARTGPSIMPGGNPDAWASVKPIFQDIAAKSDNAPCCDWVGPEGAGHYVKMVHNGIEYGDMQLITEAYQLMREGLGLSADECHQVFSDWNNGVLDSYLIEITADILSFKDKDGEPLVDKILDAAGQKGTGKWTGISSLELGMPLTLITESVYARCLSALKTERVAASKLYPRKKIVSKTNKDAMLQAIHDALYASKIISYAQGYMLMSEAAKEFDWELNYGGIALMWRGGCIIRSTFLAEIKKAYDESPNLSNLLRAPFFEDAIKNAEENWRKAVVFGVESQIPTPALSSALAFFDGYRSERLPANLLQAQRDYFGAHTYERVDAPRGEYFHTDWIQSGGNVSSSTYEV

SEQ ID NO: 7851 - protein, 503 aa, Tropheryma whipplei str. Twist
MRPVLVVDFGSQYSQLVVRAIRECGYYAEFASPSISAAECLALSPIAIFLSGGPASAYKDNAPKLDEEILNCGIPVFGICYGFQLLAQAFGGSVKKANAPEYGPADITIVNKAFFSGQPDRQTVWMSHGDSVIRAPKNFCILSTSQDAVLSFCNRDRTIAGVQWHPEVKHSRFGKHTIKAFLSSFAAPNWDPEQTICGTVDSIRKTVGCKRVLCALSGGVDSVVAATLTHRAIGDRLRCVFVDHGLLRLNEREQVEEYCSSLGLNVSTYDASDCFLSALSGIRDSEQKRKVIGREFIACFSKLQERFDIKPHFLLQGTLYPDLVESGATPGGATIKSHHNVGGLSDNLGFELLEPLKYLFKDEVRKIGLQLGIPKHIVHRQPFPGPGLAIRIIGEVTNKKLSILRAADAIVRHELRDWTDIWQCPVILLSDVQSVGVRGDSRSCGFPIVIRPVSSDDAMTADWYRLPYDVLARISGRITNEIPEIVRVVLDITPKPPATIEWE

SEQ ID NO: 7852 - protein, 411 aa, Zea mays
  misc_feature (273)..(273): Xaa can be any naturally occurring amino acid
  misc_feature (399)..(399): Xaa can be any naturally occurring amino acid
  misc_feature (409)..(409): Xaa can be any naturally occurring amino acid
MMDLADPQQQQRLIAGAALLLATAAFLRLLLGSRSGGGKRLPPTIPGAPVVGGLVKFMRGPIPMIREQYARLGSVFTVPIITRRITFLVGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRXTSEGEVTGLLIAALFGGQHTSSITSTWTGAYMLRFKQYFTEAVEEQKDVMKRHGDKIDHDILAEMDVLYRCIKEALRLHPPLIMLLRQSHSDFTVTTKGSKVYDIPKGHIVATSPSFANRLPHIYXNPDSYDPDRXRP

SEQ ID NO: 7853 - protein, 137 aa, Arabidopsis thaliana
  misc_feature (45)..(45): Xaa can be any naturally occurring amino acid
  misc_feature (56)..(56): Xaa can be any naturally occurring amino acid
  misc_feature (92)..(92): Xaa can be any naturally occurring amino acid
  misc_feature (106)..(106): Xaa can be any naturally occurring amino acid
SKRKTKEEEKQQEEVSGFLYVLLHRLWLPSPAQATMVAPFTGLKXSASFGVTRKAXNDITSITRNGGRVSWMKVWPPIGKKKFETLSYVPDXLSDVELDKEVDYLXRNKWIPCVEFEWEHGFVYREHGNTPDNMMEE

SEQ ID NO: 7854 - protein, 390 aa, Schizosaccharomyces pombe 972h-
MSNRKADEKHHMSSSSLTNDRSYIRNLSNRKTSISRKVPITRTLEDPSNFVAKDGTKLVQAPLFLLVWQKEICLSIIAICFACLLSPSLRPYAEPFIFLSYKQPDGSYGKGPKDACFPIFWVIVFTAFRVIVMDYVFRPFVLNWGVRNRKVIIRFCEQGYSFFYYLCFWFLGLYIYRSSNYWSNEEKLFEDYPQYYMSPLFKAYYLIQLGFWLQQILVLHLEQRRADHWQMFAHHIVTCALIILSYGFNFLRVGNAILYIFDLSDYILSGGKMLKYLGFGKICDYLFGIFVASWVYSRHYLFSKILRVVVTNAPEIIGGFHLDVPNGYIFNKPIYIAFIILLFTLQLLIYIWFGMIVKVAYRVFSGEEATDSRSDDEGEDEEASSTNEDK

SEQ ID NO: 7855 - protein, 485 aa, Schizosaccharomyces pombe 972h-
METLQVEVFFLFDFTSIMAGFKVPSWITYKSFWIAVSSSVTTACVILGTLEFRKHRSIRRLQSMIVPEAGKSIQLSSSGVPIEIYDAGEEDEGISKGVPYDENLIREQLARNYAFFGEDGMERLRNSFVIVVGCGGVGSWVINMLARSGVQKIRIVDFDQVSLSSLNRHSIATLQDVGTPKTLAIKKAIKKFAPWIEVDARNALFNPDSADDLLSGNPDFVIDAIDNIQTKVDLLSYCYNHKLPVIASTGSACKSDPTRVNIADISATSEDPLSRATRRRLRLLGIMEGIPVVFSTEKPDPRKASLLPLSEEEFEKGDVDELSALPEFRARILPVIGPMPGIFGLTIATYVLTSIAKYPMDPISTMTRPRLYEEAVKRLHAEARKAGVNLDKTFNASEMSYIIEEVYVGRSALPPHESQKVTVVRWNPQLPFDHTNLVAMTRNEARYHEDNVLAKNVDPSTVYGKDVIEVVHSFLRRLRMWEMLY

SEQ ID NO: 7856 - protein, 458 aa, Trifolium pratense
MDQQNKQSFQNPKHIIFDKYEMGKVLGQGNFAKVYHCRSLSTNESVATKVIKKEKLRKERLVKQIKREVSVMRLVRHPHIVDLKEVMATKGKIFLVMEYVKGGELFAKVAKGKLKEDVARKYFQQLISAVDFCHSRGVTHRDLKPENLLLDENEDLKVSDFGLSALPEQHREDGMLLTPCGTPAYVAPEVLKKKGYDGSKADLWSCGVILYALVCGYLPFQGENVMRIYKKAFKGEYEFPEWISPQAKILISNLLVADPKKRYSIVDIMNDPWFRIGFVRPIAFSMNGSSIEDNDKDINIDFNEVGEDNVDVPELIMVKPSRPFYNAFEIISSLSHGFDLRNLFETRKKLPSMFISKFSASTVLEKLEVMAKKLNFRMTGKKEFVVRFEGTKDGRKGKVAVTMEVFGVAPDVAVVEFSKCGGDTLEYVKLCDEQLRPSLKDIVWSWQGDDNHNDNNSQ

SEQ ID NO: 7857 - protein, 244 aa, Zea mays
MSLMIMERGDEELKLLGMWASPFVLRVQLALSLKGLSYEYVEVDISNKSELLLHSNPVHNKVPVLIHNGNPVCESQLILQYIDEAFAATGPCLLPADPYERAVARFWAAYIDDKVLASWMQASRGKTEEDRAEGRKQWLVVVETLEGALRDCAAGKGMMMPFFGGDSVGYVDVVLGSLLGWVSANQEVWGIECFHPRRAPLLAAWADRFAALQTVQTVVPQVSRLVELGKMLRARQSDGAAAES

SEQ ID NO: 7858 - protein, 488 aa, Chlamydomonas reinhardtii
MPGLLSRVLHPGSASSVSTLGRGLLSQVSDGCRAFLSSFPAVETKEATTPRMPDFAHTPAPYSGPSAEEVIALRKQYLSPSLFWHFKKPVMIVEGKMQYLFDEKGRRYLDAFAGIVTVSVGHCHPAVNEAINKQNALLQHTTTIYLNNQIAEYAKELTDRMPGNLKVVYFVNSGSEANDMAIMLARLYTGNWDMLCLRNAYHGMSIGTMGTCGQHTWKQPMPQGFGYHHALNPDPYRGPYGDDGARYAADMADLISGATPGRVAGFIAETIQGVGGTVPLATGYLPAVYKMVREAGGVCIADEVQTGFGRTGGHYWGFQRQGVIPDIVTMAKGIGNGLPLAAVVTTPEIAASMASRLHFNTYGGNPVCSAAGRAVLRVVDKEHRQAHCAAVGEHLLRRLRGLQAKHDIIGDVRGTGLMLGVELVKNRTTKEPAKAETAAVMESMKDMGVLMGKGGLHGNVFRIKPPMCFSHQDADFLVDVMDAALCKL

SEQ ID NO: 7859 - protein, 291 aa, Mesorhizobium sp. BNC1
MRRVFIFGAGYSGRAIARVLAHKADSIAGTTRSAEKAEALARMGIKPLIYAEGGFTPELTGTLRETTHLILSIAPGENGDAVLAELIRRGRGAMPNLQWICYLSTVGVYGDHNCAEVTEESECQPISARSHRRLETEKAWSRFGDEIGVPVAILRLSGIYGPGRNAIVNLVEGAARRIVKPGQVFNRIHVDDIAGAARHLLNAKAHGTFNVSDDEPSPPQDVVAFAAHLTGVEPAPEIPFEEAKLSPMARSFYSECKRVSNAKLKGLGYSLRYPNYREGLSALWKTGLWRG

SEQ ID NO: 7860 - protein, 220 aa, Sulfolobus tokodaii str. 7
MKYKAVLVDFGNTLVGFKPVFYEKVYQVLKDNGYDLDLRKVFRAYAKAMGMINYPDEDGLEHVDPKDFLYILGIYPSERLVKELKEADIRDGEAFLYDDTLEFLEGLKSNGYKLALVSNASPRVKTLLEKFDLKKYFDALALSYEIKAVKPNPKIFGFALAKVGYPAVHVGDIYELDYIGAKRSYVDPILLDRYDFYPDVRDRVKNLREALQKIEEMNKE

SEQ ID NO: 7861 - protein, 347 aa, Rickettsiella grylli
MATHELEGTIQRLTIHGKGILAADESQATIAKRFSPLHIESTAENRRHYRELLFTTPGIEAFISGVILHEETLGQKTKDGLLFSDYLDNEGIVPGIKVDKGLISLNTEEKMTQGLDGLAERLLTYKNLGACFAKWRAVFSISNTLPSSLAITANTQALARYASICQHNGVVPIVEPELLIEGDHSLSRCAEATETVLYSVFEELHKHHILLECMLLKPSMVIAGNQYTPQPHIAEVAAATLKILRRTVPAAVPSINFLSGGQSPEAATAHLNTMNKLQPSRHPWRLSFSYARALQEPALKIWNGKAHNIKAAQRAFYKRAKLNAAACKGHYQSSMEKEEKEVETNFV

SEQ ID NO: 7862 - protein, 189 aa, Brassica napus
MASPSKRREMDMMKLMMSDYKVDTINDDLQMFYVTFHGPTDSLYEGGVWKIKVELPEAYPYKSPSVGFVNKIYHPNVDESSGAVCLDVINQTWSPMFDLINVFESFLPQLLLYPNPSDPFNGEAASLLMRDRAAYEKKVKEYCKAYAKPEDIGAPEEISSDDDDDEDDSMSERGSDSDDNDEIAGKADP

SEQ ID NO: 7863 - protein, 390 aa, Pseudomonas fluorescens Pf-5
MAQPYSARSRAIEPFHVMALLARANELQAAGHDVIHLEIGEPDFTTAEPIIKAGQAALSAGKTRYTAARGIPELRGAISGFYQQRYGLDIDPERIMITPGGSGALLLTSSLLVDPGKHWLLADPGYPCNRHFLRLVEGAAQLVPVGPDVRYQLTPDLVERYWDQDSVGALVASPANPTGTVLSRDELAGLSTAIKARNGHLVVDEIYHGLTYGTDAASVLEVDDSAFVLNSFSKYFGMTGWRLGWLVAPPAAVGELEKLAQNLYISAPSMAQYAALACFEPQTLEILEERRAEFGRRRDFLLPALRELGFGIAVEPEGAFYLYADISAFGGDAFAFCRHFLETEHLAFTPGLDFGRHQAGHHVRFAYTQSLERLQEAVERIARGLQSWHA

SEQ ID NO: 7864 - protein, 303 aa, Thiomicrospira crunogena XCL-2
MAIFSIYLFPVWVLIFSAYALIFPAPLVEMKSSIVPLLMAVMLGMGMTLRWQDFAEVLQRKSAVLLGVGIQFVVMPLAALGLSNVLNLSQELTIGLMLVGATAGGTASNVMTYLVKGNVALSVSMTLVSTLFAIVLLPFLTWFYLDETVAVPAWEMVLSLIQLILIPISVGVLLNHFFAKPLQLIQPVLPVFSMFAIIFIIAIVVALNHLQLQSIVWVLALAVVVHNAIGLISGYGISKLVGFDERTARTVAIEVGMQNSGLSVALALKYFTAMSALPGAMFSVWHNVSGSVLAAYWQRKDQQ

SEQ ID NO: 7865 - protein, 456 aa, Salmonella enterica subsp. arizonae serovar 62:z4,z23:--
MTTRLTRWLTALDNFEAKIALLPAVRRYGRLTRATGLVLEATGLQLPLGATCIIERQDGPETKEVESEVVGFNGQRLFLMPLEEVEGILPGARVYARNGHGDGLQSGKQLPLGPALLGRVLDGGGKPLDGLPAPDTTETGALITPPFNPLQRTPIEHVLDTGVRAINALLTVGRGQRMGLFAGSGVGKSVLLGMMARYTRADVIVVGLIGERGREVKDFIENILGPDGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILDGHIVLSRRLAEAGHYPAIDIEASISRAMTALITEQHYARVRLFKQLLSSFQRNRDLVSVGAYAKGSDPMLDKAITLWPQLEAFLQQGIFERADWENSLQALDLIFPTV

SEQ ID NO: 7866 - protein, 385 aa, Dichelobacter nodosus VCS1703A
MKTLSDLDVRGKKVLMRLDLNVPMQNGVITSDARITAALPTIELALKKGAAVLIMAHLGRPKEGHYDEAFSLLPVAQHLSQLLKQEVPLIKDYLTKTPQVRAGEVVLLENVRFNVGEKDNDATLAAQYAALCDVFVSDGFGVVHRAQASTVGVAQKAPVACAGLLVEKEVTTLEKILKHPERPLLAIVGGAKVSTKLLILKSLIEKVDTLIVGGGIANTFLAATGHAVGASLYEPDLLPAAQELLALAERRGVKMPLPSDVVVANECSATAARMKSVNDVGEQELILDIGDETAAVYARLIAESKTIMWNGPVGVFELPPFANGSRKIAEAMAQGDGFTFIGGGDTLAALEAFKLTDKMDYVSTGGGSMLEYLEGKVLPGIDVLK

SEQ ID NO: 7867 - protein, 171 aa, Dichelobacter nodosus VCS1703A
MAQQKEHQQESEFLERLVAVNRVTKVVKGGRQFAFAALVVIGDGKGKVGYGYGKAKEVPVAIQKAMDQAKKNLVTIALNKDTLQHAITGHHGAARVFMQPASEGTGIIAGGAMRAVFDVVGVKDVLAKCQGTRNPGNVIRATINALTSMATPEKVAAKRGKSVEEILSHVQ

SEQ ID NO: 7868 - protein, 638 aa, Pseudomonas aeruginosa PAO1
MIRLLNLTLQRGPQRLLEAAELTLHAGQKAGLIGANGAGKSSLFALLRGQLGQDAGDCLLPADWRIAHMRQEVDTLDRLAVDYVLDGDSRLREIQAALAVAEAAHDGSALARLHTELDNADGYTADARARKLLAGLGFSSEQMERRVGDFSGGWRMRLNLAQALMCPSDLLLLDEPTNHLDLDAILWLEEWLKGYPGTLVLISHDRDFLDAVVDHVVHLENRKLTLYRGGYSAFERTRAERLAQQQQAYEKQQAQRAHMESFIARFKAKATKARQAQSRIKALERLEELAPAHVDSPFNFSFRESDKISRPLLDLGEGRLGYGDKAVLEKVKLQLVPGARIGLLGPNGAGKSTLIKTLAGDLPELGGRLLRGENLAIGYFAQHQLDSLDPQASPLLHLQRIAPGEREQTLKDFLGGFDFRGVRVDEPVLNFSGGEKARLALALIAWQKPNLLLLDEPTNHLDLEMRLALTMALQEFSGAVLVVSHDRHLLKSTTDEFLLVADGRVVPFDGDLDDYARWLVDYRARKAPQAETAPGAPTERTDKRAQRQAAAALRQQLAPHKREADKLERELGGLHEKLAAIEARLGDSALYDVSRKDELRELLSEQSSLKVREGELEERWLEALETLEALQKELEASE

SEQ ID NO: 7869 - protein, 272 aa, Agrobacterium tumefaciens str. C58
MADRDTSTSHAGETASIVEEIARKAGDLALAHFRSLSSLSVETKGHLDLVTKADKEVETFLIAQLREAFPADGIFGEEGGEIKARSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCCAATLSMVEVAMGETDGYVSLGDSTWDVMAALPILSNLGVADTIDWDRTDLSAKLRFACGSHDFLEKVKPLLDKVALAA

SEQ ID NO: 7870 - protein, 251 aa, Shewanella sp. MR-4
MSEGESKNTHFGYKTVEADKKADLVAGVFHSVAAKYDIMNDVMSFGIHRFWKRYTIEVSGARPGMKVLDLAGGTGDLTAKFSHLVGEKGEVVLADINDSMLKVGRTKLRDRGIVGNVSYVQANAEALPFPDNHFDIITIAFGLRNVTDKDAALRSMNRVLKPGGKLLVLEFSKPQHELMRKVYDLYSFKVLPKMGEIITKDADSYEYLAESIRMHPDQETLKQMMVDAGFEQVDYTNMTDGIVALHRGYKF

SEQ ID NO: 7871 - protein, 136 aa, Tropheryma whipplei TW08/27
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLDVIQNIVHASDSVKSAKRELDIWFP

SEQ ID NO: 7872 - protein, 189 aa, Lupinus luteus
RVFTQKIHDLIGTHVDVPAPDMGTGPQTMAWILDEYSKFHGYSPAVVTGKPIDLGGSLGRDAATGRGVLFAAEALLNEYGKSVSGQSFVTQGFGNVGSWAAQLISEKGGKVVAVSDVTGAIKNSNGIDIPSLLKHSSEHKGVKGFRGADPIDPKSILVKDCDVLIPAALGGVINKENANEIKAKFIIEA

SEQ ID NO: 7873 - protein, 402 aa, Clostridium perfringens ATCC 13124
MIILYLEKIIKAKKNIEDVVIKTPLIYSEVFSRKSGNQVYMKCENLQLTGAYKIRGALNKIRSLSDEDKAKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLKDVDVILCPIGGGGLISGVTLAAKALNPNVKVIGVQAEGANAMVKSFKAGEIIALDSVDTIADGIAVKRPGDLTFKFIKEYVDDIITVSDHEIVEAFFTLSEKHKLLAEASGAVSLAASSKLNFKGKNVVSIISGGNIDMVTITALINSALVAKGRLFGFSLEVPHKPGQILKIAKVLADTNANIVKLEHDHFKATDALKNMVIEVTLETNGHSHIDEIKKALTDQNYVIKQIY

SEQ ID NO: 7874 - protein, 189 aa, Lupinus luteus
RVFTQKIHDLIGTHIDVPAPDMGTGPQTMAWILDEYSKFRGYSPAVVTGKPIDLGGSLGRDAATGRGVLFATEALLNEYGKTVSGQRFVIQGFGNVGSWAAQLISEKGGKVVAVSDVTGAIKNSKGIDIPSLLKHSREHKGLKGFHGADPVDPNSILVEDCDVLVPAALGGVINRENANEIKAKFIIEA

SEQ ID NO: 7875 - protein, 189 aa, Lupinus luteus
RVFTQKIHDLIGVQRDVPAPDMGTNAQTMAWILDEYSKFHGHSPAVVTGKPIDLGGSLGREAATGLGVIFATEALFAEYGMSISGMTFAIQGFGNVGTWAAKSIYDRGGKVVAVSDISGAITNPNGIDIPALLKHKESNGNLTEFSGADAMDPNDLLVHECDVLIPCALGGVLNKENAADVKAKYIIEA

SEQ ID NO: 7876 - protein, 456 aa, Xylella fastidiosa Temecula1
MVIHSSVLELIGNTPIIKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDKSGTWLVEGIGSDCLPPISDFRRIKKTYAISDAESFHTARELLSKEGILGGSSTGTVLAAALKYCREQIEHKRVLVFVCDTGNKYLLNMYNDDWMLDNGFLKRPHYGDLRDLILHPYSQRHTVVVDPNDLLTVAYQRMKRYGVSQLPVIEDRQLVGILDESDVLLHVYGDETRFCDPVSTAMVSKLHRLDVKSPIEALLPVFERGQVAIVMEDDQFLGLITRIDLLNYLRRRIQ

SEQ ID NO: 7877 - protein, 475 aa, Triticum aestivum
  misc_feature (168)..(168): Xaa can be any naturally occurring amino acid
  misc_feature (208)..(208): Xaa can be any naturally occurring amino acid
MCLWHLKPSPRPPLPSVNNATLMAIRAHRSTADLNPHVDDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHXLYRMDYEKFIQAHRENRCLILLLLPWPMDEERATAFGPYXKFDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 7878 - protein, 117 aa, Methanococcus maripaludis S2
MAVYVKFEISQELEEKTAEVVANAEKIKKGANEVTKAVEKGIAKLVVIAQDVQPEEIVAHIPVICDEKGIAYSYSSTKEALGKAAGLEVPTSAIAVVAEGSADELKDLVEKLNGLKA

SEQ ID NO: 7879 - protein, 403 aa, Rickettsiella grylli
MSIEVKVPMLPESVTDATIVTWHKKPGETVKRDDNLVDLETDKVVLEVPASADGILGDIIKQTGAVVKAGEILAYLNTEKEVTMKPEQPAHQETKIETEEKTKHDNRAEPVAGPAARRSAAEQNLPLKNITGSGKAGRVTRNDVLQHAHSPRQNPLSSESDARSSLRHADDRLEKRVPMTRLRARIAERLLAAQHHAAILTTFNEINLQNVIALRQRYKESFEKKHGIRLGFMSFFTKAVIEALKLFPAVNASIDGNDIVYHGYFDIGIAVSTDRGLMVPILRDADRLSFADIEKTISNYGRKAKENQIAIEDMTGGTFTITNGGVFGSLLATPIINPPQSAILGMNKIEERPIAEKGQVVIRPMMYVALSYDHRIIDGKESVSFLKTIKERLEDPARLLIDI

SEQ ID NO: 7880 - protein, 370 aa, Zea mays
  misc_feature (204)..(204): Xaa can be any naturally occurring amino acid
  misc_feature (233)..(233): Xaa can be any naturally occurring amino acid
MPLTRVAADAFGVLTIGLLALLAALGLFCIFQSVYFRCQIRRGPSFLPLGYFNGPWVTRVALVLITIWWGVGEVARLSFLKQKLFSSLTWQRNICDAYILSNLGFAEPGIFFAFAFLLHGSLQKKELGTLNQRWNWKSMAYTLVFCVPVFSVQAVLVFVVGPRLVRDSDHDLGRRKIAKFLVRTHTPVGDTSVCTYPLLGTIFXLGLVDAFLMSYVSYVGSRALSLVINKSLXFEGIVFLSFLTMLSCTAVGILLLVYYPVADSLALRDMGQRDTAAEMVPYDDYYCYEGASLVANRSFRELERNSDTSTKPGSISFRTMIREDQLQQDGAADEIGFSSRSGAHIGSPSPAGSSPSAAMPMLPVKEIPRY

SEQ ID NO: 7881 - protein, 380 aa, Oryza sativa Japonica Group
MVAKIKRQIGGLSLLAKLGLLLLALLLLLAAILLLVFLLPRHHRRPLPPGSPPVNASDPDNIVAFDFSPFLILYKSGRVHRMDGTDRVPAGVDEATGVTSKDVVIDRSTGVGARMYLPPAKGAGKKDLAGALPVLVFFHGGAFVIESAFTAKYHDYLNKVTAKARVVAVSVDYRLAPEHPVPTAYDDSWQALNWVAKNGRSGPEPWLRDRGNMSRLFLAGDSAGANIAHNMAMRAGKDGGQLEGGVAITGILLLDPYFWGKNPVGAETTDPARRRQYEATWSFICDGKYGIDDPLVDPLSMPAPEWRKLACSRVAVTVSDLDDFKERGKAYAAALRDSGWGGEVEEYETAGEVHVYFLDKPSSPKSAKELTFVAGYLSHE

SEQ ID NO: 7882 - protein, 462 aa, Gibberella fujikuroi
MGYLYYLLHPYQLRSIIQWKVWHDPVHQRDPSTESPELKECFRYLDMTSRSFAAVIQELNHELLVPITLFYLCLRGLDTIEDDMTIPLDKKVPLLRNFHITMEEDGWQFHESQEKDKELLEHFDVVVTELKKIKAPYYQIIQEMTRKMGNGMADYAQNEEMIKNGVQTIEEYELYCHYVAGLVGEGLTRLFVESELANPKLAERPSLTESMAQFLQKTNIIRDIHEDWQDGRRWYPKEIWSQHVDKWEDMFDPSQQTKALECVSAMVLDALKHSEECLFYMAGIKDQSVFNFVAIPQGMAIATLELVFRNPEVLKRNVKITKGDACKIMFECTQNLYTVCEVFKRYARQIAKKNDPRDPNFLAISAQCAKIEQFIETLFPKQDPKKLSMTQAQVQNKEPTMDGGETLVLFGVVIAALVCISGLMIGTAWIFGARFDTIFREASVFLPGGEKATPMITGHEEL

SEQ ID NO: 7883 - protein, 490 aa, Helianthus tuberosus
MDFLIIVSTLLLSYILIWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSGKEFREVITNIMVDSAKTNLVDVFPVLKKIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 7884 - protein, 329 aa, Picea sitchensis
MAATNIGMMDAAYFVGRNEILHWINTTLSLHLHKIEDAASGAVHRQLMDATHPGVVPMHKVNFDAKSEYEMIQNYKVLQDVFNKLKISKHIEVSKLVKGRPLDNLEFMQWMKRYCDSFNGGIVNNYNALERREACKGGKQANQKAAPSTTTRRHDPPVVNAGHKRARSVVPNNTAGSTGSVQTSAATATATGRLFPVDTVPPVAPAQIQSLNMQITGLKLSVDSLEKERDFYFAKLRDIEILCQNPDVEHLPVVAAVQSILYATEDSPAVIADAKAAIGQQTSSLSKSHNMPKKEAPKRKFAMTPEGEDVANAILSPRRRREPLADYNL

SEQ ID NO: 7885 - protein, 233 aa, Synechococcus sp. CC9605
MKPGDPAAVEQLFDAVAPRYDRLNDVLSFGLHRQWKRQLVRALKPVAGEHWLDLCCGTGDLALELGRWVRPAGAVTGLDAAAAPLERARQRQRQQPWLPVTFQQGDALQTGLPSACADGAVMAYGLRNLADPLQGLQELRRLLKPGGRAGVLDFNRLPQSGAAAAFQRFYLRRLVVPAAASVGLREEYAYLEKSLERFPAGPEQERLARQAGFAGASHRSLVAGQMGVLTLRA

SEQ ID NO: 7886 - protein, 554 aa, Pseudomonas fluorescens Pf-5
MAYYRTPHDVTALPAWQALKDHRQAMQDFSMREAFNADPQRFSQFTLSSCGLFLDYSKNLITSETRDLLVNLAKEVGLSDAIKSMITGELVNASEGRPALHTALRRPVGDKLSVNGVNVMPEVHKVLNQITELVGRIHDGLWRGYTEKPITDVVNIGIGGSFLGPELVSEALLSYAQKGVRCHYLANIDGSEFHELSAKIRAETTLFIVSSKSFNTLETLKNAQAARAWYLAQGGSEAELHRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVATDTGPVIWGGVGCNGQHAYHQLLHQGTQLIPADFIVPIVSFNPVADHHQWLYANCLSQSQALMLGKTRAEAESELREKGLSEAEIAKLAPHKVIPGNRPSNTLVVERISPRRLGALVALYEHKVFVQSVVWGINAFDQWGVELGKELGKGVYNRLVGSDETLADDASTQGLINYFRGRHRG

SEQ ID NO: 7887 - protein, 368 aa, Ralstonia metallidurans CH34
MKTKAAIAWKAGAPLTIEEVDLDGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPAREAMARKFGMTHFVNPKDVDNVVDHIVQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 7888 - protein, 186 aa, Picea sitchensis
MNESLKMGDAEELPMDAKIVKTILKSMGVQQYEPRVVHQFLELCHRYVVDVLSDAQLYSEHASKPTIDTDDLKLAIQSKVNFSFSQPPPREILLELARNRNRLPLPMSIGGPGMALPPEQDTLINPNYQLAIPKKPATQAAEEMEIDEEEGNKGDLGNFQSLQEQKVDHEAAAQRVSFSLSAKRPR

SEQ ID NO: 7889 - protein, 189 aa, Gossypium aridum
HVGLNGNGEPFVACHDCNFPICKTCFDYELKEGRKACLRCGNPYDENRLDDAEKASGDRSTIAAHMDKSQDAGIHARHISSVSTLDSEMTEDNGNPIWKNRVESWKEKKNKKKKTSIKVEIEAQVPPEQLMEDKLAADAFQPLSTVIPIPKSRLAPYRTVIIMRLIILGLFFHYRVTNPVDSAFALWLT

SEQ ID NO: 7890 - protein, 840 aa, Yarrowia lipolytica CLIB122
MSSPSSSREPSEIYPQEGEVDYFSPDSEDHVYLPQYHAHNPRVRDWFYKNVFSHPGERVKNYTLSLFPIVRWIYRYNLVWLTYDLIAGITVGCVVVPQGMSYAKLANLPPEYGLYSSFVGVLIYCFFATSKDVSIGPVAVMSQQVGRVIMHVQGEYPEASGPMIATMLAVLCGSIALGIGLLRLGFILEFIPAPAVMGFMTGSAINIVTGQVPALMGIDKLFNTKDATYMVIINSLKNLKHSNYNAAFGVVALFILYLIKYSCQYLSKKFPKYKKVFFYIEIMRSALIIIFGTLISWAVCHPHKKSGKFPISIIKTVPRGLIHTGVMKVDTIYMSKMASELPVSTVVLLLEHIAISKSFGRVNDYKISPDQELIAIGVTNLVGTFFNAYPATGSFSRSALKAKCGVRTPLAGIYTGVVVLIALYALNTVFYWIPNAVLSAIIIHAVFDLVAHPRQLFHFWKIAPIDAVIFFVAIILTVFVTIEAGIYFAVAASLVWLLLKVAFPAGDLMGKIEIVDVEDPLIVQQTADVEEIAAAEAARNTKLGKVKGLISKAGKLIEDGPVVDADVQHGLPLLAPQEVEKSTTAAALSHVPRRTVWVPLSRKNVNPDIKISPPRPGVIVYRFTEAFTYPNCSRQTDKLVDVIREKTRRAEGVRYKTLGERPWNDHGPRHPKESETVDLRPILEKVVLDFSVVSSTDSTGIQNLVDARGEINRYVGREVEFHFSGLLSPWVRRALVGSGFGGVPKGQHLSNYQVTAARRATALDRQTLPNDTTMVIEGDSLSNDSDEEYAKKKPFDEEEAIGGLDTKSVSSSSQDDKEFGGYIPVVSTDTPFFHLDIPDL

SEQ ID NO: 7891 - protein, 194 aa, Wigglesworthia glossinidia endosymbiont of Glossina brevipalpis
MNLIPTVVEKNARGERSYDIFSRLLKERIIFVTGKIEDYMANLIIAQMIFLESEDPEKDIFLYINSPGGVVTSGMSIYDTMQFIKCEVSTLCIGQSSSMAALILASGEKGKRFSLPNARIMIHQPLGGSQGQATDIAIHTTEILKIKKCMIELLSKHTGQSAEIISKDTERDRFFSGSEAVIYGLIDKVITCRK

SEQ ID NO: 7892 - protein, 172 aa, Zea mays
MMLRAAGRRLLGVGGGDPAPAVAAAVAASRSRGYHERVVDHYNNPRNVGSLDKDDTDVGTGIVGAPACGDVMKLQIRVDEGSGRIVDARFKTFGCGSAIASSSVASEWVKGKQVEEVVAIKNTEIAKHLSLPPVKLHCSMLAEDAIKAAVKDYEAKKGKKMAKAEEQDTPCP

SEQ ID NO: 7893 - protein, 589 aa, Neisseria meningitidis Z2491
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAISDGNGQLAGFNVLAGGGLSMEHGNTKTYPNISLELGFVPPEHALKAAEAVVTTQRDFGNRSDRKNARTRYTIQNMGLDNFRAEVERRMGMPFEPIRPFKFTGRGDRIGWVKGIDGNWHLTLFIESGRLVDEGGKQLLTGVLEIAKIHKGDFRITANQNLIVANVPEGGKARIEQLARSYGLIHDGVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILAELDDLIGKWAAERNIGEGFGDFAIRTGIVKPVLNAPVDFWDASKAVAIARA

SEQ ID NO: 7894 - protein, 567 aa, Prochlorococcus marinus str. MIT 9515
MSQKPESLKDKETKNFSEFSQLADFSLMNSLKADPHSTKNGNDHRPRPVYSGHYVPVTPTPIPEPKYIAHSKTLFDELGLSSDLTKDKKFCSFFSGDIEVSEYPMRPFGWATGYALSIYGTEYTQQCPFGTGDGYGDGRAISVFEGLFNEKRMEMQLKGGGPTPYCRGADGRAVLRSSVREFLAQEFMHALGIPTSRSLILYVSGTEIVRRPWYSKGSKYYEPDIMLDNHAAITTRVAPSFLRVGQIELFARRVRSNSHNEAFNELKLIVQHLIDRNYKEEIDPSKSFAEKIIKLAYLYRERLISLVSNWMRVGYCQGNFNSDNCAAGGYTLDYGPFGFCELFDPRFQPWTGGGEHFSFFNQPFAAEINFKMFCLSLKPLLLENKKDIEKLEQIKNDFSKVMNKKIQLMWARKLGLEKYEETLTHELFNLMFTSKADFTIFFRKLSNIPENISSLKKSFYVPLTDELEQKWNIWLKKWQDFIKKEIDIKEISKSMRQVNPKFTWREWMIVSAYEDAEEGNYSKIKELQTILSNPYEEQSLETEQKYDRLKPNQFFNYGGISHYSCSS

SEQ ID NO: 7895 - protein, 341 aa, Mycobacterium sp. MCS
MEAIVLNGTNDVGLTSVPDPAPQDGEVIIEVAATGLCGTDLHEYVAGPTFSQPPVVLGHEVSGRIVEVGAGVDQSRIGEGAAVIPMDFCGSCHYCHRSLYHLCQRPGWIGFTRNGGLANYVAVPSRLAVRVPDVVDLEEAALTEPTAVAFHAVRRAELLLGETVMVLGAGALGLTVIQCARAAGAARIFVTEPSGVRASLARDLGATLVLDPHDPGTTACILEETRGVGVDVVFHVAGSAEAFTQGLDCLRKQGRFMEMSSWAGAASLDVNRHLLKEIQLRMVFGYDMFDDFPAVLALIADGKLALAPQITARVPLDRAVKEGLGGLLEGREGLVKVLVKP

SEQ ID NO: 7896 - protein, 400 aa, Xanthomonas campestris
MAPKPKNTNAAGGTAKSATKASSKKATKLAGKDSAKPLATAAPVLADVRAKIDEIDRGIQALIAERANFAHQVGKAKGKLAAAVDYYRPEREAQVLRMVVDRNEGPLSDEVLVHVFREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLAGHVEDESMKQALAELEAHSAQIKVLGSYPVAIP

SEQ ID NO: 7897 - protein, 479 aa, Flagellaria indica
  misc_feature (436)..(436): Xaa can be any naturally occurring amino acid
KNKGSIIQIIGPVLDVNFPSGKLPNIYNALVVKGRDTVGHQINVTCEVQQLLGNNRVRAVAMSATDGLTRGMEVIDTGAPLSVPVGGATLGRIFNVLGEPVDNLGPVDTSATSPIHRSAPAFIELDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRVLAAKGIYPAVDPLDSTSTMLQPRIVGDEHYEIAQRVKETLQRYKELQDIIAILGLDELSEEDRLTVARARKIERFLSQPFFVAEVFTGSAGKYVGLAXTIRGFQLILSGELDGLPEQAFYLVGNIDEATAKAMNLEGENKL

SEQ ID NO: 7898 - protein, 414 aa, Gibberella zeae PH-1
MVSTTNFPAEVVPQAPEDPLFGLAREYKADDSPNKIDLGIGAYRDENAKPWVLPVVKKADEILRNDPELNHEYAPIAGIASFTSKAAELVFGPDSSAIQDKRSTTLQTISGTGAVHLGALFLAKFYKGNQTVYLSNPTWANHHQIFKNVGMSIDTYPYFHKETKGLDFEGFKKTLQSAPEGSVFVLHACAHNPTGVDPTQDQWTEIASIMKEKNHFPFFDTAYQGFASGDLVKDAWAIRYFVDQGFELVVAQSFAKNFGLYGERAGCFHAVTSPAPEASNTITRIGSQLAILQRSEISNPPLYGARIVSTVLNDRDLFAEWEENLRTMSGRIISMRDVLRAKLEELETPGTWNHITDQIGMFSFTGLSEKQVLQLREEFHVYMTKNGRISMAGLNENNVEYFAKAVDKVVRDAA

SEQ ID NO: 7899 - protein, 281 aa, Agrobacterium tumefaciens str. C58
MHEDIPAVTLPSGNEVPALGLGTWNMGETRSSADDEIESIRKAIDLGMTLVDTAEMYADGRSEEVVGTAIAGRRDEVFLVSKVYPWNASARGTAEACERSLARLGTDHIDLYLLHWRGEHPLGETVAAFERLKSDGKIGNWGVSNFDTDDMEELFTVPEGKNCAANQVLYNLSRRGPEFSLLPWCQEHGVPLMAYSPIEQGRILKNHELIRIAKAYQATPAQLALAFLLDRDGVIAIPKSASVSRIVENRGATDLEITEEDWTALDAAFPPPTRKTSLEML

SEQ ID NO: 7900 - protein, 480 aa, Sparganium eurycarpum
KNLGRIAQIIGPVLDAVFPPGKMPNIYNALVVKGRDTLGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEVESNLK

SEQ ID NO: 7901 - protein, 526 aa, marine gamma proteobacterium HTCC2143
MSVDIHAQRILILDFGSQYTQLIARRVREIGVYSEVRAFDMDADEIKAFQPRGIILAGGPESVTEGQSPRAPAIVFELGVPVLGICYGMQTMAEQLGGKVASSELREFGYAQIKVQGSSALLHDIKDHVDSKDGAALLDVWMSHGDKVSEMPVDFQLMASTESCPIAGMYHPEKNFYGIQFHPEVTHTLQGKRIFEHFVLELCDCDVLWTPANIVEDAVDTVRSLVGTDKVLLGLSGGVDSSVVAALLHRAIGSQLTCVFVDNGLLRKNEGDQVMDMFAKNMGVKVIRADAADIFLGNLVGESDPEKKRKIIGNTFIDIFDQQAALIQDVNWLAQGTIYPDVIESAAGKTGKAHVIKSHHNVGGLPDDMQFKLIEPLRELFKDEVRKIGLELGLPYDMVYRHPFPGPGLGVRILGEVKKEYADILREADAIFLEELHAADWYHKTSQAFVVFLPVKSVGVVGDGRRYEYVVALRAVETVDFMTARWAHLPYELLEKVSNRIINEISGISRVAYDVSSKPPATIEWE

SEQ ID NO: 7902 - protein, 190 aa, Agrobacterium tumefaciens str. C58
MNAHLQPTGSAYFIQKETAAVENHTLSVLVSNEPGVLARVIGLFSGRGYNIESLTVSETEHEAHLSRITIVTRGTPIVLEQIKAQLERIVPVHRVLDLTVRARELGQERPIEREVALIKVAGTGEVRAEALRLADAFQAKVVDATVEHFIFEITGKSSKIDQFVAIIKPLGLIEICRTGIAAMNRGSQGM

SEQ ID NO: 7903 - protein, 269 aa, Zea mays
GDATLTTAKPFQATTHNRSNHGRRRRASIGTVDRRSRGGLRRGRAPGRAGGAGAPALHGSPRERVRARRGAPVPGPGLPIRRRRARGRSPLRTVGFSVDHASGRNSLSPPRTTAPTMDAGAARPSAPSTAAVAGASVADEPRDARVVRELLRSMGLRESEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQ

SEQ ID NO: 7904 - protein, 169 aa, Methanococcus maripaludis S2
MEHKHIISVLVLHKPGVLQRISGLFTRRWFNISSMTVGSTENPDVARMTIVVQGDDTVLEQVVKQLNKLVEVVKVTDLNSNKSVQRELCLVKVYAPTEDSKSQVIQYANIFRGKIIDLSTETLTVEITGDEQKVNAFLDLVRPMGIKEIARTGLTALMRGSKILKSNKA

SEQ ID NO: 7905 - protein, 375 aa, Magnaporthe grisea 70-15
MFRHGIRRFTTSSIRAAVAAAAEPTQHTINVSRAQGVAKGLTGAIGNTPLIRLNKLSEETGCEILGKAEFMNPGGSVKDRAALYVVKDAEERGLLRPGGTVVEGTAGNTGIGLAHVCRSKGYKLVIYMPNTQSQGKIDLLRLLGAEVYPVPAVAFDNPQNYNHQARRHAERLDNAVWTNQFDNTANRRAHIETTGPEIWAQTDGKVDAFTCATGTAGTLAGVTRFLKDASGGRVKSFLADPPGSVLHSYIVSGGKLIERTGSSITEGIGQGRITDNLQPDLALLDGALHISDEKSIEMVYRCLDEEGLYLGASSSLNVVAAKEVAEKLGKGHTVVTMLCDGAYRYADRLFSRKWLEDKKLLSAIPKHLEKYIVLP

SEQ ID NO: 7906 - protein, 215 aa, Mycoplasma pulmonis UAB CTIP
MKYIAPSLLNLKKDQRLNIANELLENGIKWIHYDVMDGKFVPNHAIEIEEIIHIKTNAKKHIADAHLMVENPLYYFEKLWDKVEYLTFHFEALKDENEIWKIIQKYKSKVKIGISLKPETKIEKLDPFLKDIDLVLIMSVEPGKGGQKFIDSSLEKIAYIKEKINKQNLNLVIQVDGGINNITAKQAFKSGGDVLVAGTYLVFEPTKEKIASLLD

SEQ ID NO: 7907 - protein, 509 aa, marine gamma proteobacterium HTCC2143
MENNQTHRTRPLWLPDAKKLVDRIDVLQPVAELIGSTSLEGDLKTLKTVGLKLRHFTQSVSRGTIYDNPTVRHELRNLTSAIIGYSEFVLEEMEQTVDGLLYDSLQTILALCHQLSAYDDREDPLADTTGPSIKTIGGTILIVDDQIESRDLLKRYLQLNKTTVLEASNGTSMFAVLTENEVDLILLDLILPEMDGDELLELLKQDEKLRAIPVIVVSGNKETDRVIRCIEAGAEDYLFKPFNPILLQARISAGVERKRWHNKELQYRRELERNQDFIRSVFGRYLSEDIVTRILENPEGLDLGGSQRKVTVLMADIRGFSSIAEQLPPQRVVRLLNNYLGVMSDVVMRYGGTVDEFIGDAILAIFGAPTTSDDDSDRAVQAAIAMQQAMVLINQQNRADQLPEISMGVSINTGLVVAGNIGSEKRAKYGIVGHTVNLTSRIGGYCQAGEILITEATRNDCRSSLAVGPAQHIQAKGILTAIQVYRLEGASPAKTKNSDTSAKNPEAIG

SEQ ID NO: 7908 - protein, 352 aa, Arabidopsis thaliana
MEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 7909 - protein, 321 aa, Methanococcus maripaludis S2
MDRGAIQLKKTLWKLTKFSEDYFALLVILGSIIGFFNPSIFGWAIPHISLFLGIIMFGMGMTLNKDDFKTVLERPIDVVFGSILQFSLMPLLAFLVITIFHLPTELALGFILLGSCPGGTASNVITYLAKGDVALSVAITTFSTLLAPMITPILVLWFAGAWIDVSAYSMFLSIVKIVLIPVILGVIINNSLGKKIDSIRQVLPLLSVVAIVLIVGAIIGVNSEKIVSSGVIVLLAVIIHNALGLLLGYIGTKLIGMDEKKSRAVTIEVGVQNSGLAVALATIHFSPLAAVPGAIFSVWHNITGPILANYWSKKDKKESFV

SEQ ID NO: 7910 - protein, 331 aa, Mesorhizobium sp. BNC1
MSGTSTIAKNAAPVIAASSIDEGHRTKPIPFGNALIELARTRPEIVGMSADLAKYTDMHIFAEAYPDRFYQMGMSEQLMATAAGGLAKEGFIPFATTYATFASRRCYDFMSQAVAEQDASVKLIGGLPGLTTGYGPSHQATDDIAIFRAMPNMVVIDPCDAHEIEQMVPAIADYDGPVYSRILRGNVAVVLDEYDYRFELGKAALLRGGRDVLIISTGFMTMRALDSAKELQADGIDVAVLHVPTIKPLDEMTILREAKRTGRLIVTAENHSCVGGLGEAVASCLSMNGVSAEMRRIALPDRFLAAGTLEVLQERYGITRAAVSRNIRRWL

SEQ ID NO: 7911 - protein, 189 aa, Gossypium aridum
  misc_feature (56)..(56): Xaa can be any naturally occurring amino acid
  misc_feature (121)..(121): Xaa can be any naturally occurring amino acid
  misc_feature (150)..(150): Xaa can be any naturally occurring amino acid
HVGLNGNGEPFVACHDCNFPICKTCFDYELKEGRKACLRCGNPYDENRLDDAEKAXGDRSTIAAHMDKSQDAGIHARHISSVSTLDSEMTEDNGNPIWKNRVESWKEKKNKKKKTSIKVEXEAQVPPEQLMEDKPAADAFQPLSTVIPIXKSRLAPYRTVIIMRLIILGLFFHYRVTNPVDSAFALWLT

SEQ ID NO: 7912 - protein, 320 aa, Mycoplasma pulmonis UAB CTIP
MTTELLDNYKIITKIGEGGMARVYLAQDPQGNQVAIKKLILNDKEPARKLRFEHEINLYKKINSEYVAKFLDGKFNPEPYIVMEYIDGPILKDFIKKHGGRLSYNLAAKLAIQLCTGFGELHANAITHRDIKSSNIIVTKNNKVKIIDFGIAITPDSQRYTSDGKLIGSVHYMAPEILTKEPASEKSDIYSLGILLFEMLAGSVPFNGSNMAQTLSMQKTESLPDLRRYNPEIPIALINIVAKATAKNPAQRYASMYEMRRALQTYLNPDHNFDLKLDPNKPSRRSISMFLQSKWFWPVFALAVAVFIAVVVILILVVTK

SEQ ID NO: 7913 - protein, 296 aa, Pseudomonas fluorescens Pf-5
MRLLKTLLAHRRPSLAHAGFRAISVFIAPLGVKRACMTVTLKTPEDIAKMRVAGKLAADVLEMIAEHVKPGVTTEELDRICHDYIVNVQGAIPAPLNYKGFPKSICTSINHVVCHGIPNEKPLKDGDTLNIDVTVIKDGYHGDTSRMFHVGTVPVWAERLSQITQECMYKAIELVKPGCRLGDIGEVIQKHAEKNGFSVVREFCGHGIGKVFHEEPQILHYGRAGTGMELKAGMTFTIEPMINQGKADTKVLGDGWTAITKDRKLSAQWEHTLLVTETGYEIFTLRSDDTIARVSA

SEQ ID NO: 7914 - protein, 552 aa, Nicotiana langsdorffii x Nicotiana sanderae
MASTCLQPLYNPTVTLSKPPLLSLSKKQIVTARSLSQCTRRNCSFMARNNERKLPLLPLGRLRLKVSASSGEEAESNNAESAYLEEFSWSSVILPFLFPALGGLLFGYDIGATSGATISLQSAELSGTTWYNFSAVQLGLVVSGSLYGALFGSILAYPFADFLGRRRELIIAALLYAAGGSLTAYAPGLGALLLGRLVYGLGIGLAMHGAPLYIAETCPPQIRGTLVSLKELAIVLGILLGYFVGSYEINVVGGWRYMFGLSAPIALLMGLGMWSLPPSPRWLLLRAIQSKGPLQEYKEKAMGALSKLRGRPAGDKVSEKQIEDTIISLKTAYSDEEAEGNFLEVFQGPSLKAFIIGGGLVLFQQITGQPSVLYYAGSILQSAGFSAAADAARVSVVIGIFKSLMTAVAVLKADDLGRRPLLIGGVSGIALSLFLLSAYYKFLGSFPFVAVAALLLYVGCYQISFGPISWLMVSEIFPLRTRGKGISLAVLTNFGSNAIVTFAFSPLKEFLGAENLFLLFGAIALLSLLFVVTSVPETKGLSLEEIESKILK

SEQ ID NO: 7915 - protein, 189 aa, Gossypium aridum
  misc_feature (150)..(150): Xaa can be any naturally occurring amino acid
HVGLNGNGEPFVACHDCNFPICKTCFDYELKEGRKACLRCGNPYDENRLDDAEKASGDRSTIAAHMDKSQDAGIHARHISSVSTLDSEMTEDNGNPIWKNRVESWKEKKNKKKKTSIKVEMEAQVPPEQLMEDKPAADAFQPLSTVIPIXKSRLAPYRTVIIMRLIILGLFFHYRVTNPVDSAFALWLT

SEQ ID NO: 7916 - protein, 298 aa, Nostoc sp. PCC 7120
MQANVFTNVILPLALAIIMLGMGLSLQIEDFKRITKYPKAVSIGSATQLILLPIMGFLVAKVVPMQPEIAVGLVILSLCPGGPSSNMITYLAQGDVALSVTLTVVSSMVTIFTIPIFANLALQHFLGQTAAIALPIGSTMLQIFLITIVPIGLGMYIKRIFPATALRLEKATNRLAIAFLALIILILVIREWNRIPGFIVQVGVGVVILNILAMLSGWCMSKFFKLNIPQQICVAIEVGIQNGTLAIAITAGLLQNEDMAIPAAIYSLFMNLTAFAAIYYGRKLSATNSVSNHLVGKV

SEQ ID NO: 7917 - protein, 438 aa, Borrelia garinii PBi
MGFHIYEIKARQIIDSRGNPTVEADVILEDGTCGRSAVPSGASTGINEAVELRDGDKSVYMGKGVLKAIENIKNIIAPELEGMSALNQVAIDRKMLELDGTPTKEKLGANAILAVSMATAKAAAKYLGLKVYQYLGAYKANILPTPMCNIINGGAHSDNSVDFQEFMIMPVGAKTFSEAIRMAVEVFHTLKGILNGKGYATSVGDEGGFAPNLKSNEEACEMIIEAIKKAGYEPGKDIAIALDPATSELYDPKTKKYVLKWSTKEELTSEQMVEYWSKWVEKYPIISIEDGMAEEDWDGWKKLTDKIGHKIQLVGDDLFVTNTSFLKKGIEMGVANSILIKVNQIGTLTETFEAVEMAKKAGYTAIVSHRSGETEDTTIADLVVALGTGQIKTGSLSRTDRIAKYNQLIRIEEELETTAEYHGKNVFYSIKQKQIKSL

SEQ ID NO: 7918 - protein, 321 aa, Zea mays
HFFYIIKNRADILCYLFHYQVDELYSLDLDALNDLQPIYGLILLYKWRPPEKDERPVIKDAIPNLFFANQIINKACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFLKILEEKQQLKPLIEKAKAKQKSHGPS

SEQ ID NO: 7919 - protein, 189 aa, Gossypium aridum
HVGLNGNGEPFVACHDCNFPICKTCFDYELKEGRKACLRCGNPYDENRLDDAEKASGDRSTIAAHMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 7920 - protein, 488 aa, Sphingomonas elodea
MPPPPRRKRGWPSSCAGIWSIIKAETGADAEGPLPNGADLMTFEWPAHGLTLQARIESRTATIGVIGMGYVGLPLAVAFGEAGCSVLGFDLDPEKVVALNQGESYIKHIPGDRIAPLVAEQRITATADLDRLGEVDVLLICVPTPLTRHLEPDLKYVEHTTRAIARSLRKGQLVILESTTYPGTTREVMQPILEEEGLVAGRDFFLAYSPEREDPGNPTFSTTKIPKVVGADDPASAGLAMALYRHIVPQAIQVSSAATAEAVKITENVFRAVNIALVNELKLIFTAMDIDVWEVIDAAKSKPFGFMPFYPGPGLGGHCIPIDPFYLTWKAREYNQHTRFIELAGQINADMPQHVIRVLADTLDARFGRGLRGARVLVLGVAYKKNVDDIRESPSLRLMEMIEARGATADFHDPHVAQINGTREHPTLNFRHGIAWDEATIAGYDAVLIATDHDAVDYAALAASAKLVIDTRNACGKAGVTGANIARA

SEQ ID NO: 7921 - protein, 188 aa, Gossypium aridum
  misc_feature (1)..(2): Xaa can be any naturally occurring amino acid
  misc_feature (67)..(67): Xaa can be any naturally occurring amino acid
  misc_feature (134)..(134): Xaa can be any naturally occurring amino acid
XXLNGNGEPFVACHDCNFPICKTCFDYELKEGRKACLRCGNPYDENRLDDAEKASGDRSTIAAHMDXSQDAGIHARHISSVSTLDSEMTEDNGNPIWKNRVESWKEKKNKKKKTSIKVEIEAQVPPEQLMEDKXAADAFQPLSTVIPIPKSRLAPYRTVIIMRLIILGLFFHYRVTNPVDSAFALWLT

SEQ ID NO: 7922 - protein, 301 aa, Gibberella zeae PH-1
MSKFGAMVMGPAGAGKSTFCAALITHLNLNRRSAFYINLDPAAESFEHEPDLDIKELISLKDAMEEVGLGPNGGLIYCFEFLMENLDWLTDALEGLTEEYLIIIDMPGQIELYTHVPILPALVKFLSQPGSLDVRMAAVYLLEATFVVDRAKFFSGTLSAMSAMLMLEVPHINILSKMDLVKGQVKKKDLKRFLTPDVGLLDDDPVEHTRRIAEGQDAEDDESKAPDEKDQVMKGASFRRLNRAVAGLIESFSMINYHKLDVTNEDSVAAILSYIDDCIQFHEAQDPKEPHDDEETEEFEG

SEQ ID NO: 7923 - protein, 361 aa, Salmonella enterica subsp. arizonae serovar 62:z4,z23:--
MSANGGAFIGAFFISGVSTCIIKRIHYNTIGGLMPLHHLTRFPRLEFIGAPTPLEYLPRLSDYLGREIYIKRDDVTPIAMGGNKLRKLEFLVADALREGADTLVTAGAIQSNHVRQTAAVAAKLGLHCVALLENPIGTAAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDIELIGVTVSRSVSGQKPKVVALQQAIAGKLALTATADIHLWDDYFAPGYGVPNDAGMEAVKLLARLEGVLLDPVYTGKAMAGLIDGISQKRFKDEGPILFIHTGGAPALFAYHPHV

SEQ ID NO: 7924 - protein, 203 aa, Wigglesworthia glossinidia endosymbiont of Glossina brevipalpis
MNNIKFLLSANNLFNLPKDNGLEIAFFGRSNSGKSKAINALFDKKKISISSKKPGRTNFINVFIMNKKLRIIDLPGFGYSKISKKKSKIKYLLDDYFKSRKSLKILIILEDIRRSVSEFNEKLIYLSFNLKIPVLILLSKSDKINFEKRKKKLSLFKKYIEKTTHTKNIYIEVLTFSSISRDGILFTKKILNKWTNIKLFKLN

SEQ ID NO: 7925 - protein, 481 aa, Synechococcus sp. RS9916
MTAIRSICCIGAGYVGGPTMAVIADRCPELQVTVVDLNEQRIAAWNDADLSKLPVYEPGLDAVVGRARGRNLTFSTAVDEAIAAADMVFISVNTPTKTKGLGAGQASDLRWVEACARQVAKVATGHTIVVEKSTLPVRTAQAIKEILAAAQGEGSSDRSFAVLSNPEFLAEGTAISDLEGPDRVLIGGEDAAAIDALASVYAHWVPQDKILRTNLWSSELSKLTANAFLAQRISSINSIAAFCEATGADVREVARAIGTDSRIGPKFLQAGPGFGGSCFQKDILNLVYLCRHFGLPEVADYWESVVALNTWQQHRISRLVVQKLFGTVTGKRLAVLGFAFKADTNDTREAPAIRICRDLLEEGAQLAIHDPKVESGQIARDLQQEASAVPDPKAGPSRAALSGEGTWWKGADVAATVAGADAVLILTEWQHYRQLDWSALAPLMRQPAWIFDARSVVDPAAVAAAGLQLWRVGDGGDPVSG

SEQ ID NO: 7926 - protein, 309 aa, Magnetococcus sp. MC-1
MSKAQILLVDDQPINLEILSEYLRDEGYRLCIARDGQEAWELLEKNPLNFHALLLDRMMPRMDGMEVLARMKQHDELRMVPVIMQTAKASQEEIVEGLEGGAHYYLTKPYRKEMLRAIVRTAVDDYNNYRAIRDRSREAQDKAVDSVLSMRLMDSGQFRFQTIKQAQDLAALLSHSCPDPERVVLGLSELLINAVEHGNLGITYEDKSRLLKNRDDWWQEVHRRQSLPENCQKWGRIRFTKSEDRLEILIQDEGNGFDWRGFLEFDQARAFDSHGRGIAMAKMLSFDRLEYHDPGNTVVVRVNLPPKSE

SEQ ID NO: 7927 - protein, 344 aa, Synechococcus sp. RS9916
MTDTRSRPILVTGAAGFIGAALCQRLLQRGDQVIGIDNLNTYYDPALKQARLEAIDAMAPSGAWRFEQIALEDGDALLALFAAERPRVVVNLAAQAGVRYSLENPAAYIQSNLVGFGHILEGCRHHGVENLVYASSSSVYGGNRNLPFDERQPVNHPVSLYAASKKANELMAHTYSHLYGLPATGLRFFTVYGPWGRPDMAPMLFAKAILAGKPIRVFNHGQMQRDFTYIDDIVEGVLRCCDKPATANPDFDPLAPDPATAAAPHRVFNIGNSQPTPLLRFIEVMEQALGREAIKDFQPMQPGDVVATAANTAALEEWVGFKPSTPIETGVQRFADWYRAFYGV

SEQ ID NO: 7928 - protein, 119 aa, Oryza sativa
  misc_feature (118)..(118): Xaa can be any naturally occurring amino acid
MFRSLTVRFSPVFRSRQVHLSRFSTSTITSKMSGAANLGGHGKKHKVTVVGSGNWGSTISKIVAENTRQYSDLFEEEVQMWVYEEDVTIGKDSKLYDEFIGDKPQKLTEVINKHHENXK
